US009434946B2

(12) United States Patent
Adamsky et al.

(10) Patent No.: US 9,434,946 B2
(45) Date of Patent: Sep. 6, 2016

(54) COMBINATION THERAPY FOR TREATING HEARING AND BALANCE DISORDERS

(71) Applicant: QUARK PHARMACEUTICALS, INC., Fremont, CA (US)

(72) Inventors: Svetlana Adamsky, Gedera (IL); Elena Feinstein, Rehovot (IL)

(73) Assignee: QUARK PHARMACEUTICALS, INC., Fremont, CA (US)

( * ) Notice: Subject to any disclaimer, the term of this patent is extended or adjusted under 35 U.S.C. 154(b) by 0 days.

(21) Appl. No.: 14/588,955

(22) Filed: Jan. 4, 2015

(65) Prior Publication Data

US 2015/0126586 A1 May 7, 2015

Related U.S. Application Data

(63) Continuation of application No. 14/367,939, filed as application No. PCT/US2013/020918 on Jan. 10, 2013, now abandoned.

(60) Provisional application No. 61/585,672, filed on Jan. 12, 2012.

(30) Foreign Application Priority Data

Aug. 3, 2012 (WO) ................ PCT/US2012/049616

(51) Int. Cl.
| | |
|---|---|
| *C12N 15/11* | (2006.01) |
| *A61K 48/00* | (2006.01) |
| *C07H 21/02* | (2006.01) |
| *C07H 21/04* | (2006.01) |
| *C12N 15/113* | (2010.01) |

(52) U.S. Cl.
CPC ......... *C12N 15/113* (2013.01); *C12N 2310/14* (2013.01); *C12N 2320/31* (2013.01)

(58) Field of Classification Search
USPC .......................................... 514/44; 536/24.5
See application file for complete search history.

(56) References Cited

U.S. PATENT DOCUMENTS

| | | | |
|---|---|---|---|
| 7,618,814 | B2 | 11/2009 | Bentwich |
| 2011/0142917 | A1 | 6/2011 | Alpert et al. |
| 2011/0178157 | A1 | 7/2011 | Jin et al. |

FOREIGN PATENT DOCUMENTS

| | | |
|---|---|---|
| WO | 02/04605 A2 | 1/2002 |
| WO | 2009/147684 A2 | 12/2009 |

(Continued)

OTHER PUBLICATIONS

Ambros, V., "The Functions of Animal MicroRNAs," Nature, 431, Sep. 16, 2004; pp. 350-355.

(Continued)

*Primary Examiner* — Terra C Gibbs
(74) *Attorney, Agent, or Firm* — Nutter McClennen & Fish LLP; Konstantin Linnik; Isaac A. Hubner

(57) ABSTRACT

The present application relates to combinations of inhibitors directed at down-regulation of genes associated with hearing loss including HES1, HES5, HEY2, CDKN1B and NOTCH1, exhibiting a beneficial effect and useful in treating or attenuating hearing loss, treating balance impairment, promoting the replacement, regeneration, or protection of otic (sensory) hair cells of the inner ear, and or effecting hearing restoration/regeneration.

17 Claims, 3 Drawing Sheets

(56) References Cited

FOREIGN PATENT DOCUMENTS

| WO | 2011/153348 A2 | 12/2011 |
| WO | 2013/020097 A1 | 2/2013 |

OTHER PUBLICATIONS

Bark, S., "Silence of the Transcripts," J. Mol. Med., (2005) 83: 764-773.
Bellon et al., "Amino-Linked Ribozymes: Post-Synthetic Conjugation of Half-Ribozymes," Nucleosides and Nucleotides, 16:7-9, 951-954.
Bellon et al., "Post-Synthetically Ligated Ribozymes: An Alternative Approach to Iterative Solid-Phase Synthesis," Bioconjugate Chem. 1997, 8, 204-212.
Bernstein et al., "Role for a Bidentate Ribonuclease in the Initiation Step of RNA Interference," Nature, (2001) 409, pp. 363-366.
Bitko et al., "Inhibition of Respiratory Viruses by Nasally Administered siRNA," Nature Med., (2005) 11:1; pp. 50-55.
Braasch et al., "RNA Interference in Mammalian Cells by Chemically-Modified RNA," Biochemistry 2003, 42, 7967-7975.
Breuskin et al., "Strategies to regenerate hair cells: Identification of progenitors and critical genes", Hearing Res., vol. 236, No. 1-2, Jan. 30, 2008, pp. 1-10.
Caruthers, et al., "Chemical Synthesis of Deoxyoligonucleotides by the Phosphoramidite Method," Meth. Enzymol. 154; pp. 287-313.
Chakraborty, C., "Potentiality of Small Interfering RNAs (siRNA) as Recent Therapeutic Targets for Gene-Silencing," Curr. Drug Targets, 2007, 8, pp. 469-482.
Chalk et al., "Improved and Automated Prediction of Effective siRNA," Biochem. Biophys. Res. Comm., 319, (2004), 264-274.
Choi et al., "Effect of Poly(ethylene glycol) Grafting on Polyethylenimine as a Gene Transfer Vector in vitro," Bull. Korean Chem. Soc. 2001, vol. 22, No. 1; pp. 46-52.
Doetzlhofer et al.: "Hey2 Regulation by FGF Provides a Notch-Independent Mechanism for Maintaining Pillar Cell Fate in the Organ of Corti", Devel. Cell, vol. 16, No. 1, Jan. 1, 2009, pp. 58-69.
Eckstein, F., "Nucleoside Phosphorothioates," Ann. Rev. Biochem. (1985), 54:367-402.
Furgeson, et al., "Modified Linear Polyethylenimine-Cholesterol Conjugates for DNA Complexation," Bioconjugate Chem. 2003, 14, 840-847.
Gil et al., Induction of apoptosis by the dsRNA-dependent protein kinase (PKR): Mechanism of action; Apoptosis 2000; 5: 107-114.
Godbey et al., "Poly(ethylenimine) and its role in gene delivery," Journal of Controlled Release 60 (1999) 149-160.
Gonzalez et al., "New Class of Polymers for the Delivery of Macromolecular Therapeutics," Bioconjugate Chem. 1999, 10, 1068-1074.
International Search Report and Written Opinion for Application No. PCT/US2012/049616, mailed Jan. 9, 2013 (11 pages).
International Preliminary Report on Patentability for Application No. PCT/US2012/049616, issued Feb. 4, 2014 (8 pages).
International Search Report and Written Opinion for Application No. PCT/US2013/020918, mailed Apr. 10, 2013 (13 pages).
International Preliminary Report on Patentability for Application No. PCT/US2013/020918, issued Jul. 15, 2014 (8 pages).
Izant et al., "Constitutive and Conditional Suppression of Exogenous and Endogenous Genes by Anti-Sense RNA," Science, (1985) 229, pp. 345-352.
Kashani-Sabet et al., "Reversal of the Malignant Phenotype by an Anti-ras Ribozyme," Antisense Res. and Devel., 2:3-15 (1992).
Kunath et al., "The Structure of PEG-Modified Poly(Ethylene Imines) Influences Biodistribution and Pharmacokinetics of Their Complexes with NF- B Decoy in Mice," Pharmaceutical Research, vol. 19, No. 6, Jun. 2002, pp. 810-817.
Lee et al., "The nuclear RNase III Drosha initiates microRNA Processing," Nature, (2003) 425, pp. 415-419.
Lewis et al., "Efficient Delivery of siRNA for Inhibition of Gene Expression in Postnatal Mice," Nature Genetics, (2002) 32, pp. 107-108.
Lieber et al., "Stable High-Level Gene Expression in Mammalian Cells by T7 Phage RNA Polymerase," Methods in Enzymology, (1993) 217, pp. 47-66.
McManus et al., "Gene Silencing in Mammals by Small Interfering RNAs," Nature Reviews Genetics; (2002) 3, pp. 737-747.
Ono K., et al., "RNA interference for p27kip1 induce supporting cell proliferation in organotypic cultures of postnatal mammalian cochlea," vol. 58, Jan. 1, 2007.
Paddison et al., "siRNAs and shRNAs: Skeleton keys to the human genome," Curr. Opinion Molec. Therapeutics 2003 5(3):217-224.
Paul et al., "Effective expression of small interfering RNA in human cells," Nature Biotech. (2002) 29; pp. 505-508.
Simantov et al., "Dopamine-induced Apoptosis in Human Neuronal Cells: Inhibition by Nucleic Acids Antisense to the Dopamine Transporter," Neuroscience, (1996) vol. 74, No. 1, pp. 39-50.
Sioud et al., "Potential Design Rules and Enzymatic Synthesis of siRNAs," From: Methods in Molec. Biol., (2004), 252: 457-69.
Sorensen et al., "Gene Silencing by Systemic Delivery of Synthetic siRNAs in Adult Mice," J. Mol. Biol. (2003) 327, 761-766.
Soukup et al., "Little but loud: Small RNAs have a resounding affect on ear development", Brain Res, 2009, 1277:104-114.
Tateya et al.: "Cooperative functions of Hes/Hey genes in auditory hair cell and supporting cell development", Devel. Biol., vol. 352, No. 2, Jan. 28, 2011, pp. 329-340.
Tolentino et al., "Intravitreal Injection of Vascular Endothelial Growth Factor Small Interfering RNA Inhibits Growth and Leakage in a Nonhuman Primate, Laser-Induced Model of Choroidal Neovascularization," Retina; (2004) 24:1, pp. 132-138.
Wincott et al., "A Practical Method for the Production of RNA and Ribozymes," Methods in Molec. Biol., (1997) v. 74, pp. 59-68.
Zhang et al., "Pifithrin-alpha suppresses p53 and protects cochlear and vestibular hair cells from cisplatin-induced apoptosis," Neuroscience. 2003;120(1):191-205.
Zine et al.: "Notch signaling regulates the pattern of auditory hair cell differentiation in mammals", Development, vol. 127, No. 15, Aug. 2000, pp. 3373-3383.

1KHz

4 KHz

8 KHz

16 KHz

32 KHz

LEGEND

- CONTRALATERAL
- PBS + VEHICLE
- KM + EA
- KM + EA + VEHICLE
- KM + EA + combination of HES1 dsRNA + HES5 dsRNA+ HEY2 dsRNA
- KM + EA + combination of HES1 dsRNA +HEY2 dsRNA +EGFP dsRNA
- KM + EA + combination of NOTCH1 dsRNA +CDKN1B dsRNA + HEY2 dsRNA
- KM + EA + EGFP dsRNA

COMBINATION THERAPY FOR TREATING HEARING AND BALANCE DISORDERS

RELATED APPLICATIONS

This is a continuation of U.S. patent application Ser. No. 14/367,939, filed Jun. 23, 2014, now abandoned, which is the U.S. National Stage of International Patent Application No. PCT/US2013/020918, filed Jan. 10, 2013, which claimed the benefit of U.S. Provisional Application No. 61/585,672 filed Jan. 12, 2012, and PCT Application No. PCT/US12/49616 filed Aug. 3, 2012, which are incorporated herein by reference in their entirety and for all purposes.

SEQUENCE LISTING

This application incorporates-by-reference nucleotide and/or amino acid sequences which are present in the file named "237-PCT2.5T25.txt", which is 5.044 megabytes in size, and which was created on Jan. 9, 2013 in the IBM-PC machine format, having an operating system compatibility with MS-Windows, and is submitted herewith.

FIELD OF THE INVENTION

The present disclosure relates to combination therapy, including compositions and methods useful for treating hearing loss, treating balance impairment, promoting the replacement, regeneration, or protection of otic hair (sensory) cells of the inner ear, or effecting hearing restoration/regeneration.

BACKGROUND OF THE INVENTION

PCT application No. PCT/US12/49616 to the assignee of the present application relates to double stranded RNA compounds, pharmaceutical compositions comprising same and methods of use thereof for the down-regulation of target genes associated with hearing loss and balance impairment, including HES1, HES5, HEY1, HEY2, ID1, ID2, ID3, CDKN1B, and NOTCH1, the inhibition of which is useful for treating hearing loss, treating balance impairment, promoting the replacement, regeneration, or protection of otic hair (sensory) cells of the inner ear, or effecting hearing restoration/regeneration.

SUMMARY OF THE INVENTION

It has now been found that certain tripartite combinations of inhibitors directed at down-regulation of certain target genes associated with hearing and balance disorders are beneficial in treating or attenuating hearing loss, treating balance impairment, promoting the replacement, regeneration, or protection of otic (sensory) hair cells of the inner ear, and/or effecting hearing restoration/regeneration. In particular, the combination includes a first agent targeting HES1, a second agent targeting HES5 and a third agent targeting HEY2, or includes a first agent targeting CDKN1B, a second agent targeting NOTCH1 and a third agent targeting HEY2.

In one aspect, provided herein is a combination of a HES1 inhibitor, a HES5 inhibitor and a HEY2 inhibitor for use in therapy. In some embodiments the therapy comprises preventing, treating, or delaying of progression of a hearing disorder, a hearing loss, and/or a balance impairment, or for preventing the loss of otic (sensory) hair cells of the inner ear in a subject. In another aspect provided herein is a composition comprising a combination of a HES1 inhibitor, or a pharmaceutically acceptable salt or prodrug thereof, a HES5 inhibitor, or a pharmaceutically acceptable salt or prodrug thereof and a HEY2 inhibitor, or a pharmaceutically acceptable salt or prodrug thereof; and a pharmaceutically acceptable carrier. In yet another aspect provided herein is a method of preventing, treating, or delaying of progression of a hearing disorder, a hearing loss, and/or a balance impairment, or of preventing the loss of otic (sensory) hair cells of the inner ear in a subject, comprising administering to the subject a HES1 inhibitor, a HES5 inhibitor and a HEY2 inhibitor. In another aspect provided herein is a product, a kit or a commercial package comprising a HES1 inhibitor, a HES5 inhibitor and a HEY2 inhibitor or a composition thereof as disclosed hereinabove.

In yet another aspect provided herein is a combination of a CDKN1B inhibitor, a NOTCH1 inhibitor, and a HEY2 inhibitor for use in for use in therapy. In some embodiments the therapy comprises preventing, treating, or delaying of progression of a hearing disorder, a hearing loss, and/or a balance impairment, or for preventing the loss of otic (sensory) hair cells of the inner ear in a subject. In another aspect provided herein is a composition comprising at least one CDKN1B inhibitor, or a pharmaceutically acceptable salt or prodrug thereof, at least one NOTCH1 inhibitor, or a pharmaceutically acceptable salt or prodrug thereof; and at least one HEY2 inhibitor, or a pharmaceutically acceptable salt or prodrug thereof; and a pharmaceutically acceptable carrier. In yet another aspect provided herein is a method of preventing, treating, or delaying of progression of a hearing disorder, a hearing loss, and/or a balance impairment, or of preventing the loss of otic (sensory) hair cells of the inner ear in a subject, comprising administering to the subject a CDKN1B inhibitor, a NOTCH1 inhibitor and a HEY2 inhibitor In another aspect provided herein is a product, a kit or a commercial package comprising a CDKN1B inhibitor, a NOTCH1 inhibitor and a HEY2 inhibitor or a composition thereof as disclosed hereinabove.

In various aspects and embodiments of the combinations and methods provided herein a therapeutically effective amount of each of the inhibitors is administered substantially simultaneously, separately or sequentially and in any order, and the components are administered separately or as a fixed combination (for example in a single dosage form). In some embodiments of the combinations and methods provided herein, each of the inhibitors is administered substantially simultaneously or sequentially and in any order. In other embodiments of the combinations and methods provided herein, a therapeutically effective amount of two of the inhibitors is administered simultaneously or substantially simultaneously and the third inhibitor is administered separately.

In one embodiment, provided herein is a combination of a HES1 inhibitor, a HES5 inhibitor and a HEY2 inhibitor, for substantially simultaneous or sequential use in preventing, treating, or delaying of progression of a hearing disorder, a hearing loss, and/or a balance impairment, or for preventing the loss of otic (sensory) hair cells of the inner ear in a subject.

In another embodiment, provided herein is a combination of a CDKN1B inhibitor, a NOTCH1 inhibitor and a HEY2 inhibitor, for substantially simultaneous or sequential use in preventing, treating, or delaying of progression of a hearing disorder, a hearing loss, and/or a balance impairment, or for preventing the loss of otic (sensory) hair cells of the inner ear in a subject.

In one embodiment provided are methods for treating, including preventing, the incidence or severity of hearing loss in a subject in which expression of HES1, HES5, and HEY2 genes is associated with the etiology or progression of the hearing disorder/hearing loss.

In another embodiment, provided are methods for treating, including preventing, the incidence or severity of balance impairment in a subject in which expression of HES1, HES5, and HEY2 genes is associated with the etiology or progression of the balance impairment.

In yet another embodiment, provided are methods for treating, including preventing, the incidence or severity of loss of otic (sensory) hair cells of the inner ear in a subject, in which expression of HES1, HES5, and HEY2, genes is associated with the etiology or progression of the otic (sensory) hair cell loss.

In one embodiment, provided are methods for treating, including preventing, the incidence or severity of hearing loss in a subject in which expression of CDKN1B, NOTCH1 and HEY2 genes is associated with the etiology or progression of the hearing disorder/hearing loss.

In another embodiment, provided are methods for treating, including preventing, the incidence or severity of balance impairment in a subject in which expression of CDKN1B, NOTCH1 and HEY2 genes is associated with the etiology or progression of the balance impairment.

In yet another embodiment, provided are methods for treating, including preventing, the incidence or severity of loss of otic (sensory) hair cells of the inner ear of a subject, in which expression of CDKN1B, NOTCH1 and HEY2, genes is associated with the etiology or progression of the otic (sensory) hair cell loss.

In one embodiment provided herein is a method of preventing, treating or delaying progression of a hearing disorder, a hearing loss, and/or a balance impairment, or of preventing the loss of otic (sensory) hair cells of the inner ear in a subject, comprising administering to the subject a HES1 inhibitor, a HES5 inhibitor and a HEY2 inhibitor.

In another embodiment provided herein is a method of preventing, treating, or delaying of progression of a hearing disorder, a hearing loss, and/or a balance impairment, or of preventing the loss of otic (sensory) hair cells of the inner ear in a subject, comprising administering to the subject a CDKN1B inhibitor, a NOTCH1 inhibitor and a HEY2 inhibitor.

In some embodiments the subject is a mammal. In a preferred embodiment the subject is a human subject.

Further provided is a method of preventing degeneration of the auditory nerve in a subject comprising administering to the subject a combination disclosed herein.

Such methods involve administering to a mammal in need of such treatment a combination or a composition comprising prophylactically or therapeutically effective amount of a HES1 inhibitor, a HES5 inhibitor and a HEY2 inhibitor. In another embodiment, such methods involve administering to a mammal in need of such treatment a combination or a composition comprising prophylactically or therapeutically effective amount of a CDKN1B inhibitor, a NOTCH1 inhibitor and a HEY2 inhibitor.

In various embodiments, each inhibitor (the HES1 inhibitor, the HES5 inhibitor, the HEY2 inhibitor, the CDKN1B inhibitor, and the NOTCH1 inhibitor) is independently selected from the group consisting of a small organic molecule; a protein, an antibody or a fragment thereof, a peptide, a peptidomimetic and a nucleic acid molecule.

In preferred embodiments, each inhibitor comprises a therapeutic nucleic acid molecule, or a pharmaceutically acceptable salt thereof. In some embodiments, the nucleic acid compound is applied directly to the round window membrane of the cochlea or administered by transtympanic injection or via a transtympanic device including a canula or an implant. Methods include sustained delivery and controlled delivery for local or systemic delivery including delivery of inhibitors using, for example, a pump, a slow or sustained release composition or an implant comprising a drug depot.

In preferred embodiments of the compositions, combinations, methods, commercial packages and kits provided herein, each inhibitor comprises a separate nucleic acid molecule, or a pharmaceutically acceptable salt thereof. In some embodiments of the compositions, combinations, methods, commercial packages and kits provided herein, the nucleic acid molecules are linked one to the other. In some embodiments of the compositions, combinations, methods, commercial packages and kits provided herein, the nucleic acid molecules are annealed and covalently linked in a multi-arm formation (RNAistar).

In preferred embodiments of the compositions, combinations, methods, commercial packages and kits provided herein, each inhibitor comprises a nucleic acid compound. Preferably, the nucleic acid compound is applied directly to the round window membrane of the cochlea or administered by transtympanic injection or via a transtympanic device including a canula.

Thus, the compositions, combinations, methods, commercial packages and kits provided herein preferably involve use of nucleic acid molecules (for example, short interfering nucleic acid (siNA), short interfering RNA (siRNA), double-stranded RNA (dsRNA), micro-RNA (miRNA) or short hairpin RNA (shRNA)) that bind a nucleotide sequence (such as an mRNA sequence) or portion thereof, encoding HES1, HES5, HEY2, CDKN1B, or NOTCH1, for example, the mRNA coding sequence (SEQ ID NOS:1, 2, 10, 7, and 11) for human HES1, HES5, HEY2, CDKN1B, or NOTCH1 mRNA, respectively, encoding one or more proteins or protein subunits exemplified by SEQ ID NOS:12, 13, 21, 18 and 22, respectively. In certain preferred embodiments, the compositions, combinations, methods, commercial packages and kits disclosed herein down-regulate or inhibit expression of HES1, HES5 and HEY2, or CDKN1B, NOTCH1, and HEY2 genes. In various embodiments each nucleic acid molecule is selected from the group consisting of unmodified or chemically modified dsRNA compound such as a chemically modified siRNA or shRNA that down-regulates HES1, HES5, HEY2, CDKN1B or NOTCH1, expression.

In some preferred embodiments the HES1 inhibitor is a synthetic, chemically modified double stranded RNA (dsRNA) compound that down-regulates HES1 expression. In certain preferred embodiments, "HES1" refers to human HES1 gene. In some preferred embodiments the HES5 inhibitor is a synthetic, chemically modified double stranded RNA (dsRNA) compound that down-regulates HES5 expression. In certain preferred embodiments, "HES5" refers to human HES5 gene. In some preferred embodiments the HEY2 inhibitor is a synthetic, chemically modified double stranded RNA (dsRNA) compound that down-regulates HEY2 expression. In certain preferred embodiments, "HEY2" refers to human HEY2 gene. In some preferred embodiments the CDKN1B inhibitor is a synthetic, chemically modified double stranded RNA (dsRNA) compound that down-regulates CDKN1B expression. In certain preferred embodiments, "CDKN1B" refers to human CDKN1B gene. In some preferred embodiments the NOTCH1 inhibitor is a synthetic, chemically modified double stranded RNA (dsRNA) compound that down-regulates NOTCH1 expression. In certain preferred embodiments, "NOTCH1" refers to human NOTCH1 gene.

In some preferred embodiments of the compositions, combinations, methods, commercial packages and kits provided herein, the first nucleic acid molecule is a double-stranded oligonucleotide that binds a nucleotide sequence encoding a HES1 gene, the second nucleic acid molecule is a double-stranded oligonucleotide that binds a nucleotide sequence encoding a HES5 gene, and the third nucleic acid molecule is a double-stranded oligonucleotide that binds a nucleotide sequence encoding a HEY2 gene.

In some preferred embodiments of the compositions, combinations, methods, commercial packages and kits provided herein, the first nucleic acid molecule is a double-stranded oligonucleotide that binds a nucleotide sequence encoding a CDKN1B gene, the second nucleic acid molecule is a double-stranded oligonucleotide that binds a nucleotide sequence encoding a NOTCH1 gene, and the third nucleic acid molecule is a double-stranded oligonucleotide that binds a nucleotide sequence encoding a HEY2 gene.

In various preferred embodiments of the compositions, combinations, methods, commercial packages and kits provided herein, each of the double-stranded oligonucleotides (for example double-stranded RNA (dsRNA)) comprises a sense strand and an antisense strand.

In some preferred embodiments of the compositions, combinations, methods, commercial packages and kits provided herein, each of the double-stranded oligonucleotides comprises a sense strand and an antisense strand, wherein (a) each strand is independently 18 to 49 nucleotides in length; (b) a 18 to 49 nucleotide sequence of the antisense strand is complementary to a sequence of an mRNA encoding a target gene; and (c) a 18 to 49 nucleotide sequence of the sense strand is complementary to the antisense strand. In various embodiment the mRNA encoding a target gene is selected from mammalian HES1 (SEQ ID NO:1), HES5 (SEQ ID NO:2), HEY2 (SEQ ID NO:10), CDKN1B (SEQ ID NO:7), or NOTCH1 (e.g., SEQ ID NO:11 or portion thereof; and the sense strand and the antisense strand comprise sequence pairs set forth in any of SEQ ID NOS:23-1495 or 26667-26706 (HES1), SEQ ID NOS:1496-2703 or 26707-26732 (HES5), SEQ ID NOS:13004-16621 or 26779-26788 (HEY2), SEQ ID NOS:7444-10533 or 26867-26900 (CDKN1B) or SEQ ID NOS:16622-26666 or 26901-26912 (NOTCH1).

In some preferred embodiments of the compositions, combinations, methods, commercial packages and kits provided herein, a first double-stranded oligonucleotide comprises a sense strand and an antisense strand, wherein;
(a) each strand is independently 18 to 49 nucleotides in length;
(b) a 18 to 49 nucleotide sequence of the antisense strand is complementary to a sequence of an mRNA encoding HES1; and
(c) a 18 to 49 nucleotide sequence of the sense strand is complementary to the antisense strand;
a second double-stranded oligonucleotide comprises a sense strand and an antisense strand, wherein;
(a) each strand is independently 18 to 49 nucleotides in length;
(b) a 18 to 49 nucleotide sequence of the antisense strand is complementary to a sequence of an mRNA encoding HES5; and
(c) a 18 to 49 nucleotide sequence of the sense strand is complementary to the antisense strand; and
a third double-stranded oligonucleotide comprises a sense strand and an antisense strand, wherein;
(a) each strand is independently 18 to 49 nucleotides in length;
(b) a 18 to 49 nucleotide sequence of the antisense strand is complementary to a sequence of an mRNA encoding HEY2; and
(c) a 18 to 49 nucleotide sequence of the sense strand is complementary to the antisense strand.

In other preferred embodiments of the compositions, combinations, methods, commercial packages and kits provided herein, a first double-stranded oligonucleotide is a dsRNA molecule comprising a sense strand and an antisense strand, wherein;
(a) each strand is independently 18 to 49 nucleotides in length;
(b) a 18 to 49 nucleotide sequence of the antisense strand is complementary to a sequence of an mRNA encoding CDKN1B; and
(c) a 18 to 49 nucleotide sequence of the sense strand is complementary to the antisense strand; a second double-stranded oligonucleotide comprises a sense strand and an antisense strand, wherein;
(a) each strand is independently 18 to 49 nucleotides in length;
(b) a 18 to 49 nucleotide sequence of the antisense strand is complementary to a sequence of an mRNA encoding NOTCH1; and
(c) a 18 to 49 nucleotide sequence of the sense strand is complementary to the antisense strand; and
a third double-stranded oligonucleotide comprises a sense strand and an antisense strand, wherein;
(a) each strand is independently 18 to 49 nucleotides in length;
(b) a 18 to 49 nucleotide sequence of the antisense strand is complementary to a sequence of an mRNA encoding HEY2; and
(c) a 18 to 49 nucleotide sequence of the sense strand is complementary to the antisense strand.

In some embodiments the dsRNA molecule has a structure set forth as Structure (A1) or Structure (A2), disclosed herein.

In particular embodiments, compositions, combinations, methods, commercial packages and kits provided herein are useful in the treatment of an ear (otic, aural) condition or pathology, particularly pathologies involving death of otic (sensory) hair cells if the inner ear, are provided herein.

In another aspect provided is use of a combination of a HES1 inhibitor, a HES5 inhibitor and a HEY2 inhibitor, for the preparation of a medicament for the treatment of a disease or disorder of the inner ear or of the middle ear. In another aspect provided is use of a combination of a CDKN1B inhibitor, a NOTCH1 inhibitor and a HEY2 inhibitor, for the preparation of a medicament for the treatment of a disease or disorder of the inner ear or of the middle ear.

In particular embodiments, provided herein are combinations, compositions and methods of use thereof in the treatment of auditory and vestibular diseases, disorders, injuries and conditions including, without being limited to ototoxin induced hearing loss, age-related hearing loss, a hearing impairment due to end-organ lesions involving inner ear hair cells, e.g., acoustic trauma, viral endolymphatic labyrinthitis, Meniere's disease; tinnitus which may be intermittent or continuous, wherein there is diagnosed a sensorineural loss; hearing loss due to bacterial or viral infection, such as in herpes zoster oticus; purulent labyrinthitis arising from acute otitis media, purulent meningitis, chronic otitis media, sudden deafness including that of viral origin, e.g., viral endolymphatic labyrinthitis caused by viruses including mumps, measles, influenza, chicken pox, mononucleosis and adenoviruses; congenital hearing loss such as that caused by rubella, anoxia during birth, bleeding into the inner ear due to trauma during delivery, ototoxic drugs administered to the mother, erythroblastosis fetalis, and hereditary conditions including Waardenburg's syndrome and Hurler's syndrome.

In another aspect provided herein is a commercial package or a kit comprising any of the composition or the combination disclosed herein. In some embodiments, the commercial package or kit, includes a label or package insert that provides certain information about how the composition or combination disclosed herein may be used. In some embodiments of the commercial package or kit, the label or package insert includes dosing information. In some embodiments of the commercial package or kit, the label or package insert includes indications for use. In some embodiments of the commercial package or kit, the label or package insert indicates that the composition or the combination is suitable for use in therapy. In some embodiments of the commercial package or kit, wherein the label or package insert indicates that the composition or the combination is suitable for use in preventing, treating, or delaying of progression of a hearing disorder, a hearing loss, and/or a balance impairment, or for preventing the loss of otic (sensory) hair cells of the inner ear in a subject.

The preferred methods, materials, and examples that will now be described are illustrative only and are not intended to be limiting; materials and methods similar or equivalent to those described herein can be used in practice or testing of the invention. Other features and advantages of the invention will be apparent from the following figures, detailed description, and from the claims.

BRIEF DESCRIPTION OF THE FIGURES

FIG. 1A shows the ABR response obtained in this study at Day 0, after 3 weeks, after 5 weeks, after 7 weeks and after 9 weeks for 1 KHz stimulus.

FIG. 1B shows the ABR response obtained in this study at Day 0, after 3 weeks, after 5 weeks, after 7 weeks and after 9 weeks for 4 KHz stimulus.

FIG. 1C shows the ABR response obtained in this study at Day 0, after 3 weeks, after 5 weeks, after 7 weeks and after 9 weeks for 8 KHz stimulus.

FIG. 1D shows the ABR response obtained in this study at Day 0, after 3 weeks, after 5 weeks, after 7 weeks and after 9 weeks for 16 KHz stimulus.

FIG. 1E shows the ABR response obtained in this study at Day 0, after 3 weeks, after 5 weeks, after 7 weeks and after 9 weeks for 32 KHz stimulus.

DETAILED DESCRIPTION OF THE INVENTION

Figure 1A:
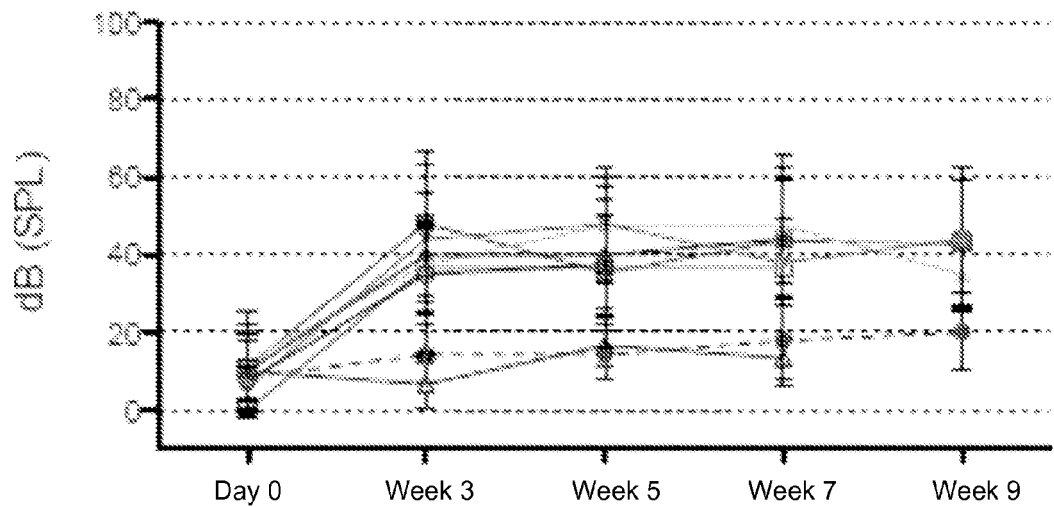
FIGS. 1A-1E show the ABR response obtained in this study at Day 0, after 3 weeks, after 5 weeks, after 7 weeks and after 9 weeks.

Provided herein are compositions and combinations which down-regulate expression of certain genes associated with hearing loss and their use in treating a subject suffering from hearing loss and/or balance impairment, for promoting the replacement, regeneration, or protection of otic (sensory) hair cells of the inner ear, and or effecting hearing restoration/regeneration. In preferred embodiments the methods comprise partial or full hearing regeneration. Inhibition of expression of a combination of the HES1, HES5 and HEY2 genes, or of a combination of the CDKN1B, NOTCH1 and HEY2 genes was shown to be beneficial in regeneration of hearing. The present application relates in particular to use of therapeutic agents, for example double-stranded oligonucleotide molecules, including dsRNA/small interfering RNA (siRNA) compounds which inhibit expression of HES1, HES5, CDKN1B, HEY2 and NOTCH1 and to the use of these dsRNA molecules in the treatment of hearing loss. Sense strands and complementary antisense strands useful in generating the compositions and the combinations of dsRNA molecules as provided herein are set forth in SEQ ID NOS:23-1495 or 26667-26706 (HES1), SEQ ID NOS: 1496-2703 or 26707-26732 (HES5), SEQ ID NOS:13004-16621 or 26779-26788 (HEY2), SEQ ID NOS:7444-10533 or 26867-26900 (CDKN1B) or SEQ ID NOS:16622-26666 or 26901-26912 (NOTCH1). Certain currently preferred sense strand and antisense strand pairs are set forth in tables I-V infra.

Provided herein are methods, combinations and compositions for inhibiting expression of HES1, HES5 and HEY2 genes, or for inhibiting expression of CDKN1B, NOTCH1 and HEY2 genes in vivo. In general, the method includes administering oligoribonucleotide combination/composition, such as combination/composition of dsRNA molecules, including small interfering RNAs (i.e., dsRNAs), that are targeted to the target mRNAs, and hybridize to, or interact with, the mRNAs under biological conditions (within the cell), or a nucleic acid material that can produce siRNAs in a cell, in an amount sufficient to down-regulate expression of a target gene by an RNA interference mechanism. Details of target genes are presented in Table A, hereinbelow.

TABLE A

Target genes

| No. | Gene abbrev | Full name and gi and accession numbers |
|---|---|---|
| 1 | HES1 | hairy and enhancer of split 1, (*Drosophila*) Alternative Names: bHLHb39; FLJ20408; HES-1; HHL; HRY gi|8400709|ref|NM_005524.2|(SEQ ID NO: 1) |
| 2 | HES5 | hairy and enhancer of split 5 (*Drosophila*) Alternative Names: bHLHb 38gi|145301612|ref|NM_001010926.2|(SEQ ID NO: 2) |
| 3 | ID1 | inhibitor of DNA binding 1, dominant negative HLH protein. Alternative Names: bHLHb24; ID gi|31317298|ref|NM_002165.2|transcript v.1 (SEQ ID NO: 3) gi|31317296|ref|NM_181353.1|transcript v.2 (SEQ ID NO: 4) |

TABLE A-continued

Target genes

| No. | Gene abbrev | Full name and gi and accession numbers |
|---|---|---|
| 4 | ID2 | inhibitor of DNA binding 2, dominant negative HLH protein Alternative Names: bHLHb26; GIG8; ID2A; ID2H; MGC26389 gi|33946335|ref|NM_002166.4|(SEQ ID NO: 5) |
| 5 | ID3 | inhibitor of DNA binding 3, dominant negative HLH protein. Alternative Names: bHLHb25; HEIR-1 gi|156119620|ref|NM_002167.3|(SEQ ID NO: 6) |
| 6 | CDKN1B | cyclin-dependent kinase inhibitor 1B (p27, Kip1) Alternative Names: CDKN4; KIP1; MEN1B; MEN4; P27KIP1 gi|17978497|ref|NM_004064.2|(SEQ ID NO: 7) |
| 7 | HEY1 | HEY1—hairy/enhancer-of-split related with YRPW motif 1 gi|105990527|ref|NM_012258.3|transcript v.1 (SEQ ID NO: 8) gi|105990525|ref|NM_001040708.1|transcript v.2 (SEQ IDNO: 9) |
| 8 | HEY2 | HEY2—hairy/enhancer-of-split related with YRPW motif 2 gi|105990529|ref|NM_012259.2|(SEQ ID NO: 10) |
| 9 | NOTCH1 | NOTCH1 Notch homolog 1, translocation-associated (*Drosophila*) gi|148833507|ref|NM_017617.3|*Homo sapiens* mRNA (SEQ ID NO: 11) |

Preferred targets are HES1 (mRNA SEQ ID NO:1; polypeptide SEQ ID NO:12), HES5 (mRNA SEQ ID NO:2; polypeptide SEQ ID NO:13), HEY2 (mRNA SEQ ID NO:10; polypeptide SEQ ID NO:21); CDKN1B (mRNA SEQ ID NO:7; polypeptide SEQ ID NO:18) and NOTCH1 (mRNA SEQ ID NO:11; polypeptide SEQ ID NO:22).

In various embodiments, provided is the use of compositions/combinations of double stranded RNAs, (dsRNAs) including chemically modified small interfering RNAs (siRNAs), in the treatment of various diseases and medical conditions. Particular diseases and conditions to be treated are related to hearing loss and/or balance loss.

Preferred sense and antisense nucleic acid sequences useful in generating dsRNA for use in the combinations, compositions and methods as provided herein were prioritized based on their score according to a proprietary algorithm as the best sequences for targeting the human gene expression. SEQ ID NOS:23-693 and 26691-26706 (HES1); SEQ ID NOS:1496-2029 and 26725-26732 (HES5); SEQ ID NOS:7444-9007 and 26887-26900 (CDKN1B); SEQ ID NOS:13004-14801 and 26785-26788 (HEY2); SEQ ID NOS:16622-18643 and 26922-26912 (NOTCH1) set forth 19-mer oligomers. SEQ ID NOS:694-1495 (HES1); SEQ ID NOS:2030-2703 (HES5); SEQ ID NOS:9008-10533 (CDKN1B); SEQ ID NOS:14802-16389 (HEY2); SEQ ID NOS:18644-26666 (NOTCH1) set forth 18-mer oligomers useful in generating dsRNA molecules according to Structure A2, as described hereinbelow.

DEFINITIONS

For convenience certain terms employed in the specification, examples and claims are described herein.

It is to be noted that, as used herein, the singular forms "a", "an" and "the" include plural forms unless the content clearly dictates otherwise.

Where aspects or embodiments of the invention are described in terms of Markush groups or other grouping of alternatives, those skilled in the art will recognize that the invention is also thereby described in terms of any individual member or subgroup of members of the group.

An "inhibitor" is a compound, which is capable of reducing (partially or fully) the expression of a gene or the activity of the product of such gene to an extent sufficient to achieve a desired biological or physiological effect. The term "inhibitor" as used herein refers to one or more of a small organic molecule, a protein, an antibody or fragments thereof, a peptide, a peptidomimetic and a nucleic acid molecule, including siRNA, shRNA, synthetic shRNA; miRNA, antisense RNA and DNA and ribozymes.

A "dsRNA molecule" or "dsRNA inhibitor" is a compound which is capable of down-regulating or reducing the expression of a gene or the activity of the product of such gene to an extent sufficient to achieve a desired biological or physiological effect and includes one or more of a siRNA, shRNA, synthetic shRNA; miRNA. Inhibition may also be referred to as down-regulation or, for RNAi, silencing.

The term "inhibit" as used herein refers to reducing the expression of a gene or the activity of the product of such gene to an extent sufficient to achieve a desired biological or physiological effect. Inhibition is either complete or partial.

As used herein, the term "inhibition" of a target gene means attenuation, reduction or down regulation of gene expression (transcription or translation) or polypeptide activity of a target gene wherein the target gene is selected from a gene transcribed into an mRNA set forth in any one of SEQ ID NOS:1, 2, 10, 7, or 11 or an SNP (single nucleotide polymorphism) or other variants thereof. The gi number for the mRNA of each target gene is set forth in Table A ("v" refers to transcript variant). The polynucleotide sequence of the target mRNA sequence, or the target gene having a mRNA sequence refer to the mRNA sequences set forth in SEQ ID NO:1, 2, 10, 7 or 11, or any homologous sequences thereof preferably having at least 70% identity, more preferably 80% identity, even more preferably 90% or 95% identity to any one of mRNA set forth in SEQ ID NO:1, 2, 10, 7 or 11. Therefore, polynucleotide sequences derived from any one of SEQ ID NO:1, 2, 10, 7 or 11 which have undergone mutations, alterations or modifications as described herein are encompassed in the present invention. The terms "mRNA polynucleotide sequence", "mRNA sequence" and "mRNA" are used interchangeably.

As used herein, the terms "polynucleotide" and "nucleic acid" may be used interchangeably and refer to nucleotide sequences comprising deoxyribonucleic acid (DNA), and ribonucleic acid (RNA). The terms are to be understood to include, as equivalents, analogs of either RNA or DNA made from nucleotide analogs. Throughout this application, mRNA sequences are set forth as representing the corresponding genes.

"Oligonucleotide" or "oligomer" refers to a deoxyribonucleotide or ribonucleotide sequence from about 2 to about 50 nucleotides. Each DNA or RNA nucleotide may be independently natural or synthetic, and or modified or unmodified. Modifications include changes to the sugar moiety, the base moiety and or the linkages between nucleotides in the oligonucleotide. The compounds according to various aspect and embodiments of the present disclosure encompass molecules comprising deoxyribonucleotides, ribonucleotides, modified deoxyribonucleotides, modified ribonucleotides, unconventional moieties and combinations thereof.

"Substantially complementary" refers to complementarity of greater than about 84%, to another sequence. For example in a duplex region consisting of 19 base pairs one mismatch results in 94.7% complementarity, two mismatches results in about 89.5% complementarity and 3 mismatches results in about 84.2% complementarity, rendering the duplex region substantially complementary. Accordingly substantially identical refers to identity of greater than about 84%, to another sequence.

"Nucleotide" is meant to encompass deoxyribonucleotides and ribonucleotides, which may be natural or synthetic, and or modified or unmodified. Modifications include changes to the sugar moiety, the base moiety and or the linkages between ribonucleotides in the oligoribonucleotide. As used herein, the term "ribonucleotide" encompasses natural and synthetic, unmodified and modified ribonucleotides. Modifications include changes to the sugar moiety, to the base moiety and/or to the linkages between ribonucleotides in the oligonucleotide.

The nucleotides can be selected from naturally occurring or synthetic modified bases. Naturally occurring bases include adenine, guanine, cytosine, thymine and uracil. Modified bases of nucleotides include inosine, xanthine, hypoxanthine, 2-aminoadenine, 6-methyl, 2-propyl and other alkyl adenines, 5-halo uracil, 5-halo cytosine, 6-aza cytosine and 6-aza thymine, pseudo uracil, 4-thiouracil, 8-halo adenine, 8-aminoadenine, 8-thiol adenine, 8-thiolkyl adenines, 8-hydroxyl adenine and other 8-substituted adenines, 8-halo guanines, 8-amino guanine, 8-thiol guanine, 8-thioalkyl guanines, 8-hydroxyl guanine and other substituted guanines, other aza and deaza adenines, other aza and deaza guanines, 5-trifluoromethyl uracil and 5-trifluoro cytosine. In some embodiments one or more nucleotides in an oligomer is substituted with inosine.

According to some embodiments the present disclosure provides use of inhibitory oligonucleotide compounds comprising unmodified and modified nucleotides and or unconventional moieties. The compounds comprise at least one modified nucleotide selected from the group consisting of a sugar modification, a base modification and an internucleotide linkage modification and may contain DNA, and modified nucleotides such as LNA (locked nucleic acid), ENA (ethylene-bridged nucleic acid), PNA (peptide nucleic acid), arabinoside, phosphonocarboxylate or phosphinocarboxylate nucleotide (PACE nucleotide), mirror nucleotide, or nucleotides with a 6 carbon sugar.

All analogs of, or modifications to, a nucleotide/oligonucleotide are employed with the present embodiments, provided that said analog or modification does not substantially adversely affect the function of the nucleotide/oligonucleotide. Acceptable modifications include modifications of the sugar moiety, modifications of the base moiety, modifications in the internucleotide linkages and combinations thereof.

A sugar modification includes a modification on the 2' moiety of the sugar residue and encompasses amino, fluoro, alkoxy e.g. methoxy, alkyl, amino, fluoro, chloro, bromo, CN, CF, imidazole, carboxylate, thioate, $C_1$ to $C_{10}$ lower alkyl, substituted lower alkyl, alkaryl or aralkyl, $OCF_3$, OCN, O—, S—, or N— alkyl; O-, S, or N-alkenyl; $SOCH_3$; $SO_2CH_3$; $ONO_2$; $NO_2$, $N_3$; heterozycloalkyl; heterozycloalkaryl; aminoalkylamino; polyalkylamino or substituted silyl, as, among others, described in European patents EP 0 586 520 B1 or EP 0 618 925 B1.

In one embodiment a dsRNA molecule useful in methods, compositions, combinations, commercial packages and kits provided herein, comprises at least one ribonucleotide comprising a 2' modification on the sugar moiety ("2' sugar modification"). In certain embodiments the compound comprises 2'O-alkyl or 2'-fluoro or 2'O-allyl or any other 2' modification, optionally on alternate positions. Other stabilizing modifications are also possible (e.g. terminal modifications). In some embodiments a preferred 2'O-alkyl is 2'O-methyl (methoxy) sugar modification.

In some embodiments the backbone of the oligonucleotides is modified and comprises phosphate-D-ribose entities but may also contain thiophosphate-D-ribose entities, triester, thioate, 2'-5' bridged backbone (also may be referred to as 5'-2'), PACE and the like.

As used herein, the terms "non-pairing nucleotide analog" means a nucleotide analog which comprises a non-base pairing moiety including but not limited to: 6 des amino adenosine (Nebularine), 4-Me-indole, 3-nitropyrrole, 5-nitroindole, Ds, Pa, N3-Me ribo U, N3-Me riboT, N3-Me dC, N3-Me-dT, N1-Me-dG, N1-Me-dA, N3-ethyl-dC, N3-Me dC. In some embodiments the non-base pairing nucleotide analog is a ribonucleotide. In other embodiments it is a deoxyribonucleotide. In addition, analogues of polynucleotides may be prepared wherein the structure of one or more nucleotide is fundamentally altered and better suited as therapeutic or experimental reagents. An example of a nucleotide analogue is a peptide nucleic acid (PNA) wherein the deoxyribose (or ribose) phosphate backbone in DNA (or RNA) is replaced with a polyamide backbone which is similar to that found in peptides. PNA analogues have been shown to be resistant to enzymatic degradation and to have extended stability in vivo and in vitro. Other modifications that can be made to oligonucleotides include polymer backbones, cyclic backbones, acyclic backbones, thiophosphate-D-ribose backbones, triester backbones, thioate backbones, 2'-5' bridged backbone, artificial nucleic acids, morpholino nucleic acids, glycol nucleic acid (GNA), threose nucleic acid (TNA), arabinoside, and mirror nucleoside (for example, beta-L-deoxyribonucleoside instead of beta-D-deoxyribonucleoside). Examples of dsRNA molecules comprising LNA nucleotides are disclosed in Elmen et al., (NAR 2005, 33(1):439-447). The compounds useful in accordance with the present disclosure can be synthesized using one or more inverted nucleotides, for example inverted thymidine or inverted adenine (see, for example, Takei, et al., 2002, JBC 277(26):23800-06).

Other modifications include terminal modifications on the 5' and/or 3' part of the oligonucleotides and are also known as capping moieties. Such terminal modifications are selected from a nucleotide, a modified nucleotide, a lipid, a peptide, a sugar and inverted abasic moiety.

An "alkyl moiety or derivative thereof" refers to straight chain or branched carbon moieties and moieties per se or further comprising a functional group including alcohols, phosphodiester, phosphorothioate, phosphonoacetate and also includes amines, carboxylic acids, esters, amides aldehydes. "Hydrocarbon moiety" and "alkyl moiety" are used interchangeably.

"Terminal functional group" includes halogen, alcohol, amine, carboxylic, ester, amide, aldehyde, ketone, ether groups.

Provided are methods, compositions and combinations for inhibiting expression of target genes in vivo. In certain embodiments, the methods include administering a composition or a combination of oligoribonucleotides, in particular small interfering RNAs (i.e. siRNAs) that target mRNAs transcribed from target genes in an amount sufficient to down-regulate expression of target genes by, e.g. an RNA interference mechanism. In particular, the subject methods can be used to inhibit expression of target genes for treatment of a disease. Provided herein are compositions and combinations of dsRNA molecules directed to target genes disclosed herein and useful as therapeutic agents to treat various otic and vestibular system pathologies.

Provided are methods, combinations and compositions for inhibiting expression of a hearing loss-associated gene in vivo. In general, the methods includes administering combinations of oligoribonucleotides, in particular double-stranded RNAs (such as, for example, siRNAs), that target mRNAs, or pharmaceutical compositions comprising them, in an amount sufficient to down-regulate expression of target genes by, e.g. an RNA interference mechanism. In particular, the subject methods can be used to inhibit expression of a hearing loss-associated genes for treatment of a disease or a disorder or a condition disclosed herein.

Provided herein are methods, combinations and compositions for inhibiting expression of HES1, HES5 and HEY2, in vivo. Provided herein are methods and compositions for inhibiting expression of HEY2, CDKN1B and NOTCH1, in vivo. In general, the methods includes administering oligoribonucleotides, in particular double stranded RNAs (i.e. dsRNAs) or a nucleic acid material that can produce dsRNA in a cell, that target mRNAs transcribed from HES1, HES5 and HEY2 genes or HEY2, CDKN1B and NOTCH1 genes in an amount sufficient to down-regulate expression of the target genes e.g., by an RNA interference mechanism.

dsRNA and RNA Interference

RNA interference (RNAi) is a phenomenon involving double-stranded (ds) RNA-dependent gene-specific post-transcriptional silencing. Initial attempts to study this phenomenon and to manipulate mammalian cells experimentally were frustrated by an active, non-specific antiviral defense mechanism which was activated in response to long dsRNA molecules (Gil et al., Apoptosis, 2000. 5:107-114). Later, it was discovered that synthetic duplexes of 21 nucleotide RNAs could mediate gene specific RNAi in mammalian cells, without stimulating the generic antiviral defense mechanisms Elbashir et al. Nature 2001, 411:494-498 and Caplen et al. PNAS 2001, 98:9742-9747). As a result, small interfering RNAs (siRNAs), which are short double-stranded RNAs, have been widely used to inhibit gene expression and understand gene function.

RNA interference (RNAi) is mediated by small interfering RNAs (siRNAs) (Fire et al, Nature 1998, 391:806) or microRNAs (miRNAs) (Ambros V. Nature 2004, 431:350-355); and Bartel D P. Cell. 2004 116(2):281-97). The corresponding process is commonly referred to as specific post-transcriptional gene silencing when observed in plants and as quelling when observed in fungi.

A siRNA compound is a double-stranded RNA which down-regulates or silences (i.e. fully or partially inhibits) the expression of an endogenous or exogenous gene/mRNA.

RNA interference is based on the ability of certain dsRNA species to enter a specific protein complex, where they are then targeted to complementary cellular RNAs and specifically degrades them. Thus, the RNA interference response features an endonuclease complex containing a siRNA, commonly referred to as an RNA-induced silencing complex (RISC), which mediates cleavage of single-stranded RNA having a sequence complementary to the antisense strand of the siRNA duplex. Cleavage of the target RNA may take place in the middle of the region complementary to the antisense strand of the siRNA duplex (Elbashir, et al., Genes Dev., 2001, 15:188). In more detail, longer dsRNAs are digested into short (17-29 bp) dsRNA fragments (also referred to as short inhibitory RNAs or "siRNAs") by type III RNAses (DICER, DROSHA, etc., (see Bernstein et al., Nature, 2001, 409:363-6 and Lee et al., Nature, 2003, 425:415-9). The RISC protein complex recognizes these fragments and complementary mRNA. The whole process is culminated by endonuclease cleavage of target mRNA (McManus and Sharp, Nature Rev Genet, 2002, 3:737-47; Paddison and Hannon, Curr Opin Mol Ther. 2003, 5(3): 217-24). (For additional information on these terms and proposed mechanisms, see for example, Bernstein, et al., RNA. 2001, 7(11):1509-21; Nishikura, Cell. 2001, 107(4): 415-8 and PCT Publication No. WO 01/36646).

The selection and synthesis of dsRNA compounds corresponding to known genes has been widely reported; see for example Ui-Tei et al., J Biomed Biotechnol. 2006; 65052; Chalk et al., BBRC. 2004, 319(1):264-74; Sioud and Leirdal, Met. Mol. Biol.; 2004, 252:457-69; Levenkova et al., Bioinform. 2004, 20(3):430-2; Ui-Tei et al., NAR 2004, 32(3):936-48. For examples of the use of, and production of, modified siRNA see Braasch et al., Biochem., 2003, 42(26): 7967-75; Chiu et al., RNA, 2003, 9(9):1034-48; PCT publications WO 2004/015107 (atugen); WO 02/44321 (Tuschl et al), and U.S. Pat. Nos. 5,898,031 and 6,107,094.

Several groups have described the development of DNA-based vectors capable of generating siRNA within cells. The method generally involves transcription of short hairpin RNAs that are efficiently processed to form siRNAs within cells (Paddison et al. PNAS USA 2002, 99:1443-1448; Paddison et al. Genes & Dev 2002, 16:948-958; Sui et al. PNAS USA 2002, 8:5515-5520; and Brummelkamp et al. Science 2002, 296:550-553). These reports describe methods of generating siRNAs capable of specifically targeting numerous endogenously and exogenously expressed genes.

Studies have revealed that siRNA can be effective in vivo in mammals, including humans. Specifically, Bitko et al., showed that specific siRNAs directed against the respiratory syncytial virus (RSV) nucleocapsid N gene are effective in treating mice when administered intranasally (Nat. Med. 2005, 11(1):50-55). For reviews of therapeutic applications of siRNAs see for example Barik (Mol. Med. 2005, 83: 764-773) and Chakraborty (Current Drug Targets 2007 8(3):469-82). In addition, clinical studies with short siRNAs that target the VEGFR1 receptor in order to treat age-related macular degeneration (AMD) have been conducted in human patients (Kaiser, Am J Ophthalmol. 2006 142(4): 660-8). Further information on the use of siRNA as therapeutic agents may be found in Durcan, 2008. Mol. Pharma. 5(4):559-566; Kim and Rossi, 2008. BioTechniques 44:613-616; Grimm and Kay, 2007, JCI, 117(12):3633-41.

A dsRNA useful with the combination therapy or compositions is a duplex oligoribonucleotide in which the sense strand is substantially complementary to an 18-40 consecutive nucleotide segment of the mRNA polynucleotide sequence of a target gene, and the antisense strand is substantially complementary to the sense strand. In general, some deviation from the target mRNA sequence is tolerated without compromising the siRNA activity (see e.g. Czauderna et al., Nuc. Acids Res. 2003, 31(11):2705-2716). A siRNA of the invention inhibits gene expression on a post-transcriptional level with or without destroying the mRNA. Without being bound by theory, siRNA may target the mRNA for specific cleavage and degradation and/or may inhibit translation from the targeted message.

In some embodiments the dsRNA is blunt ended, on one or both ends. More specifically, the dsRNA may be blunt ended on the end defined by the 5'-terminus of the first strand and the 3'-terminus of the second strand, or the end defined by the 3'-terminus of the first strand and the 5'-terminus of the second strand.

In other embodiments at least one of the two strands may have an overhang of at least one nucleotide at the 5'-terminus; the overhang may consist of at least one deoxyribonucleotide. At least one of the strands may also optionally have an overhang of at least one nucleotide at the 3'-terminus. The overhang may consist of from about 1 to about 5 nucleotides.

The length of RNA duplex is from about 18 to about 49 ribonucleotides, preferably 19 to 23 ribonucleotides. Further, the length of each strand (oligomer) may independently have a length selected from the group consisting of about 18 to about 49 bases, preferably 18 to 23 bases and more preferably 19, 20 or 21 ribonucleotides.

Additionally, in certain preferred embodiments the complementarity between said first strand and the target nucleic acid is perfect. In some embodiments, the strands are substantially complementary, i.e. having one, two or up to three mismatches between said first strand and the target nucleic acid.

Further, the 5'-terminus of the first strand of the siRNA may be linked to the 3'-terminus of the second strand, or the 3'-terminus of the first strand may be linked to the 5'-terminus of the second strand, said linkage being via a nucleic acid linker typically having a length between 3-100 nucleotides, preferably about 3 to about 10 nucleotides.

The dsRNAs compounds useful in methods, combinations and compositions disclosed herein, possess structures and modifications which impart one or more of increased activity, increased stability, reduced toxicity, reduced off target effect, and/or reduced immune response. The siRNA structures as disclosed herein, are beneficially applied to double-stranded RNA useful in methods, combinations and compositions disclosed herein for use in preventing or attenuation target gene expression, in particular the target genes discussed herein.

According to one aspect, the present disclosure provides use of combinations or compositions of chemically modified double-stranded oligonucleotides comprising at least one modified nucleotide selected from the group consisting of a sugar modification, a base modification and an internucleotide linkage modification. Accordingly, the chemically modified double stranded oligonucleotide compounds useful in the methods, compositions and combinations provided herein, may contain modified nucleotides such as DNA, LNA (locked nucleic acid), ENA (ethylene-bridged nucleic acid), PNA (peptide nucleic acid), arabinoside, PACE, mirror nucleoside, or nucleotides with a 6 carbon sugar. Examples of PACE nucleotides and analogs are disclosed in U.S. Pat. Nos. 6,693,187 and 7,067,641 both incorporated herein by reference. The oligonucleotide may further comprise 2'O-methyl or 2'-fluoro or 2'O-allyl or any other 2' modification, optionally on alternate positions. Other stabilizing modifications, which do not significantly reduce the activity are also possible (e.g. terminal modifications). The backbone of the active part of the oligonucleotides may comprise phosphate-D-ribose entities but may also contain thiophosphate-D-ribose entities, triester, thioate, 2'-5' bridged backbone (also may be referred to as 5'-2'), PACE or any other type of modification. Terminal modifications on the 5' and/or 3' part of the oligonucleotides are also possible. Such terminal modifications may be lipids, peptides, sugars, inverted abasic moieties or other molecules.

Chemical Synthesis of Oligonucleotide Compounds

The oligonucleotide compounds for use in the methods, compositions, combinations, commercial packages and kits disclosed herein can be synthesized by any of the methods that are well-known in the art for synthesis of ribonucleic (or deoxyribonucleic) oligonucleotides. Such synthesis is, among others, described in Beaucage and Iyer, Tetrahedron 1992; 48:2223-2311; Beaucage and Iyer, Tetrahedron 1993; 49: 6123-6194 and Caruthers, et. al., Methods Enzymol. 1987; 154: 287-313; the synthesis of thioates is, among others, described in Eckstein, Annu. Rev. Biochem. 1985; 54: 367-402, the synthesis of RNA molecules is described in Sproat, in Humana Press 2005 edited by Herdewijn P.; Kap. 2: 17-31 and respective downstream processes are, among others, described in Pingoud et. al., in IRL Press 1989 edited by Oliver R. W. A.; Kap. 7: 183-208.

Other synthetic procedures are known in the art e.g. the procedures as described in Usman et al., 1987, J. Am. Chem. Soc., 109, 7845; Scaringe et al., 1990, NAR., 18, 5433; Wincott et al., 1995, NAR. 23, 2677-2684; and Wincott et al., 1997, Methods Mol. Bio., 74, 59, and these procedures may make use of common nucleic acid protecting and coupling groups, such as dimethoxytrityl at the 5'-end, and phosphoramidites at the 3'-end. The modified (e.g. 2'-β-methylated) nucleotides and unmodified nucleotides are incorporated as desired.

The oligonucleotides useful in accordance with embodiments provided herein can be synthesized separately and joined together post-synthetically, for example, by ligation (Moore et al., 1992, Science 256, 9923; Draper et al., International Patent Publication No. WO 93/23569; Shabarova et al., 1991, NAR 19, 4247; Bellon et al., 1997, Nucleosides & Nucleotides, 16, 951; Bellon et al., 1997, Bioconjugate Chem. 8, 204), or by hybridization following synthesis and/or deprotection.

It is noted that a commercially available machine (available, inter alia, from Applied Biosystems) can be used; the oligonucleotides are prepared according to the sequences disclosed herein. Overlapping pairs of chemically synthesized fragments can be ligated using methods well known in the art (e.g., see U.S. Pat. No. 6,121,426). The strands are synthesized separately and then are annealed to each other in the tube. Then, the double-stranded siRNAs are separated from the single-stranded oligonucleotides that were not annealed (e.g. because of the excess of one of them) by HPLC. In relation to the dsRNAs or dsRNA fragments useful in accordance with embodiments of present disclosure, two or more such sequences can be synthesized and linked together for use in the methods, compositions and combinations disclosed herein.

The compounds for use in accordance with can also be synthesized via tandem synthesis methodology, as described for example in US Patent Publication No. US 2004/0019001 (McSwiggen), wherein both siRNA strands are synthesized as a single contiguous oligonucleotide fragment or strand separated by a cleavable linker which is subsequently cleaved to provide separate siRNA fragments or strands that hybridize and permit purification of the siRNA duplex. The linker can be a polynucleotide linker or a non-nucleotide linker.

The present disclosure provides for a pharmaceutical composition comprising three dsRNA molecules for the treatment of any of the diseases and conditions mentioned herein, whereby at least two of the molecules may be physically mixed together in the pharmaceutical composition in amounts which generate equal or otherwise beneficial activity, or may be covalently or non-covalently bound, or joined together by a nucleic acid linker of a length ranging from 2-100, preferably 2-50 or 2-30 nucleotides. In one embodiment, the dsRNA molecules are comprised of a double-stranded nucleic acid structure as described herein, wherein the dsRNA molecules are selected from the oligonucleotides described herein. Thus, the dsRNA molecules may be covalently or non-covalently bound or joined by a linker to form a tandem or a triplet dsRNA compound. Such tandem dsRNA molecules comprising two siRNA sequences are typically of 38-150 nucleotides in length, more preferably 38 or 40-60 nucleotides in length, and longer accordingly if more than two siRNA sequences are included in the tandem molecule. A longer tandem compound comprised of two or more longer sequences which encode siRNA produced via internal cellular processing, e.g., long dsRNAs, is also envisaged, as is a tandem molecule encoding two or more shRNAs. Such tandem molecules are also considered to be a part of the disclosure. A compound comprising two (tandem) or more (RNAistar) dsRNA sequences disclosed herein is envisaged. Examples of such "tandem" or "star" molecules are provided in PCT patent publication no. WO 2007/091269, assigned to the assignee of the present application and incorporated herein by reference in its entirety.

The dsRNA molecules that target HES1, HES5, and HEY2, or HEY2, CDKN1B and NOTCH1 may be the main active components in a pharmaceutical composition, Simultaneous inhibition of said additional gene(s) will likely have an additive or synergistic effect for treatment of the diseases disclosed herein.

Additionally, the dsRNA disclosed herein or any nucleic acid molecule comprising or encoding such dsRNA can be linked or bound (covalently or non-covalently) to antibodies (including aptamer molecules) against cell surface internalizable molecules expressed on the target cells, in order to achieve enhanced targeting for treatment of the diseases disclosed herein. For example, anti-Fas antibody (preferably a neutralizing antibody) may be combined (covalently or non-covalently) with any dsRNA. In another example, an aptamer which can act like a ligand/antibody may be combined (covalently or non-covalently) with any dsRNA.

The nucleic acid molecules disclosed herein can be delivered either directly or with viral or non-viral vectors. When delivered directly, the sequences are generally rendered nuclease resistant. Alternatively the sequences can be incorporated into expression cassettes or constructs such that the sequence is expressed in the cell as discussed herein below. Generally the construct contains the proper regulatory sequence or promoter to allow the sequence to be expressed in the targeted cell. Vectors optionally used for delivery of the compounds of the present invention are commercially available, and may be modified for the purpose of delivery of the compounds of the present invention by methods known to one of skill in the art.

dsRNA Useful for Combination Therapy

In particular embodiments of compositions, combinations, methods, commercial packages and kits provided herein, the double-stranded oligonucleotide (for example dsRNA) possess modifications which may increase activity, increase stability, minimize toxicity and/or affect delivery of the double-stranded oligonucleotide to the middle and inner ear when compared to the corresponding unmodified double-stranded oligonucleotide compound. The double-stranded oligonucleotide molecules are designed to down-regulate target gene expression and attenuate target gene function. In certain embodiments the target gene is transcribed into any one of the mRNA polynucleotides set forth in SEQ ID NOS:1, 2, 7, 10 and 11. In particular embodiments of compositions, combinations, methods, commercial packages and kits provided herein, the double-stranded oligonucleotide (for example dsRNA) possess a sense strand sequence and an antisense strand sequence selected from sense strand oligonucleotide and corresponding antisense strand oligonucleotide set forth in SEQ ID NOS:23-1495 or 26667-26706 (HES1), SEQ ID NOS:1496-2703 or 26707-26732 (HES5), SEQ ID NOS:13004-16621 or 26779-26788 (HEY2), SEQ ID NOS:7444-10533 or 26867-26900 (CDKN1B) or SEQ ID NOS:16622-26666 or 26901-26912 (NOTCH1) useful in generating the chemically modified double-stranded oligonucleotide molecules.

In various embodiments of compositions, combinations, methods, commercial packages and kits, as disclosed herein, in each of a double-stranded oligonucleotide molecule (e.g., dsRNA molecule) the antisense strand may be 18 to 49 nucleotides in length (e.g., 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48 or 49 nucleotides in length); or 18-35 nucleotides in length; or 18-30 nucleotides in length; or 18-25 nucleotides in length; or 18-23 nucleotides in length; or 19-21 nucleotides in length; or 25-30 nucleotides in length; or 26-28 nucleotides in length. compositions, combinations, methods, commercial packages and kits, as disclosed herein, in each of a double-stranded oligonucleotide molecule (e.g., dsRNA molecule), the antisense strand is 19 nucleotides in length. Similarly the sense strand of a double-stranded oligonucleotide molecule (e.g., dsRNA molecule) may be 18 to 49 nucleotides in length (e.g., 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48 or 49 nucleotides in length); or 18-35 nucleotides in length; or 18-30 nucleotides in length; or 18-25 nucleotides in length; or 18-23 nucleotides in length; or 19-21 nucleotides in length; or 25-30 nucleotides in length; or 26-28 nucleotides in length. In various preferred embodiments of compositions, combinations, methods, commercial packages and kits, as disclosed herein, in each double-stranded oligonucleotide (e.g., dsRNA molecule), the sense strand is 19 nucleotides in length and the antisense strand is 19 nucleotides in length. In various preferred embodiments of compositions, combinations, methods, commercial packages and kits, as disclosed herein, the duplex region of the double-stranded oligonucleotide molecule (e.g., dsRNA molecule) may be 18-49 nucleotides in length (e.g., about 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48 or 49 nucleotides in length), 18-35 nucleotides in length; or 18-30 nucleotides in length; or 18-25 nucleotides in length; or 18-23 nucleotides in length; or 18-21 nucleotides in length; or 25-30 nucleotides in length; or 25-28 nucleotides in length. In various preferred embodiments of compositions, combinations, methods, commercial packages and kits, as disclosed herein, the duplex region of the double-stranded oligonucleotide molecule is 19 nucleotides in length.

In various embodiments of compositions, combinations, methods, commercial packages and kits, as disclosed herein, the sense strand and the antisense strand of the double-stranded oligonucleotide (e.g., an dsRNA molecule) are separate oligonucleotide strands. In some embodiments, the separate sense strand and antisense strand form a double stranded structure, also known as a duplex, via hydrogen bonding, for example, Watson-Crick base pairing. In some embodiments one or more nucleotide pairs form non-Watson-Crick base pairing. In some embodiments the sense strand and the antisense strand are two separate strands that are covalently linked to each other. In other embodiments, the sense strand and the antisense strands are part of a single oligonucleotide having both a sense and antisense region; in some preferred embodiments the oligonucleotide has a hairpin structure.

In certain embodiments of compositions, combinations, methods, commercial packages and kits, as disclosed herein, the double-stranded oligonucleotide is symmetrical with regard to overhangs, and has a blunt end on both ends. In other embodiments the double-stranded oligonucleotide is a dsRNA molecule that is symmetrical with regard to overhangs, and has a nucleotide or a non-nucleotide or a combination of a nucleotide and non-nucleotide overhang on both ends of the dsRNA molecule. In certain preferred embodiments, the nucleic acid molecule is a dsRNA molecule that is asymmetrical with regard to overhangs, and has a blunt end on one end of the molecule and an overhang on the other end of the molecule. In some embodiments an asymmetrical dsRNA molecule has a 3'-overhang on one side of a duplex occurring on the sense strand; and a blunt end on the other side of the molecule occurring on both the 5'-end of the sense strand and the 5'-end of the antisense strand. In some embodiments an asymmetrical dsRNA molecule has a 5'-overhang on one side of a duplex occurring on the sense strand; and a blunt end on the other side of the molecule occurring on both the 3'-end of the sense strand and the 3'-end of the antisense strand. In other embodiments an asymmetrical dsRNA molecule has a 3'-overhang on one side of a duplex occurring on the antisense strand; and a blunt end on the other side of the molecule occurring on both the 5'-end of the sense strand and the 5'-end of the antisense strand. In some embodiments an asymmetrical dsRNA molecule has a 5'-overhang on one side of a duplex occurring on the antisense strand; and a blunt end on the other side of the molecule occurring on both the 3'-end of the sense strand and the 3'-end of the antisense strand. In some embodiments the overhangs are nucleotide overhangs, in other embodiments the overhangs are non-nucleotide overhangs. In some embodiments the overhangs are 5' overhangs; in alternative embodiments the overhangs are 3' overhangs.

In certain embodiments of compositions, combinations, methods, commercial packages and kits, as disclosed herein, the double-stranded oligonucleotide has a hairpin structure (having the sense strand and antisense strand on one oligonucleotide), with a loop structure on one end and a blunt end on the other end. In some embodiments, the double-stranded oligonucleotide has a hairpin structure, with a loop structure on one end and an overhang end on the other end; in certain embodiments, the overhang is a 3'-overhang; in certain embodiments the overhang is a 5'-overhang; in certain embodiments the overhang is on the sense strand; in certain embodiments the overhang is on the antisense strand.

In certain embodiments of compositions, combinations, methods, commercial packages and kits, as disclosed herein, the double-stranded oligonucleotide (e.g., dsRNA molecule) may include one or more modifications or modified nucleotides such as described herein. For example, the double-stranded oligonucleotide (e.g., dsRNA molecule) may include a modified nucleotide having a modified sugar; a modified nucleotide having a modified nucleobase; or a modified nucleotide having a modified phosphate group, a modified phosphodiester backbone and/or a modified terminal phosphate group.

In certain embodiments of compositions, combinations, methods, commercial packages and kits, as disclosed herein, the double-stranded oligonucleotide (e.g., dsRNA molecules) may have one or more ribonucleotides that include a modified sugar moiety, for example as described herein. A non-limiting example of a modified sugar moiety is a 2' alkoxy modified sugar moiety. In some preferred embodiments the nucleic acid comprises at least one 2'-O-methyl sugar modified ribonucleotide.

In certain embodiments of compositions, combinations, methods, commercial packages and kits, as disclosed herein, the double-stranded oligonucleotide (e.g., dsRNA molecule) may have one or more modified nucleobase(s), for example as described herein.

In certain embodiments of compositions, combinations, methods, commercial packages and kits, as disclosed herein, the double-stranded oligonucleotide (e.g., dsRNA molecule) may have one or more modifications to the phosphodiester backbone, for example as described herein.

In certain embodiments of compositions, combinations, methods, commercial packages and kits, as disclosed herein, the double-stranded oligonucleotide (e.g., dsRNA molecule) may have one or more modified phosphate group(s), for example as described herein.

In various embodiments of compositions, combinations, methods, commercial packages and kits, as disclosed herein, the double-stranded oligonucleotide (e.g., dsRNA molecule) may include an unmodified antisense strand and a sense strand having one or more modifications. In some embodiments the double-stranded oligonucleotide (e.g., dsRNA molecule) may include an unmodified sense strand and an antisense strand having one or more modifications. In preferred embodiments, the double-stranded oligonucleotide (e.g., dsRNA molecule) may include one or more modified nucleotides in the both the sense strand and the antisense strand.

In various embodiments of compositions, combinations, methods, commercial packages and kits, as disclosed herein, the double-stranded oligonucleotide (e.g., dsRNA molecules) may include a phosphate group at the 5' end of the sense and/or the antisense strand (i.e. a 5'-terminal phosphate group). In some embodiments the double-stranded oligonucleotide may include a phosphate group at the 5' terminus of the antisense strand.

In various embodiments of compositions, combinations, methods, commercial packages and kits, as disclosed herein, the double-stranded oligonucleotide (e.g., dsRNA molecules) may include a phosphate group at the 3' end of the sense and/or the antisense strand (i.e. a 3'-terminal phosphate group). In some embodiments the double-stranded oligonucleotide may include a phosphate group at the 3' terminus of the antisense strand.

In some embodiments of compositions, combinations, methods, commercial packages and kits, as disclosed herein, the double-stranded oligonucleotide (e.g., dsRNA molecules) may include a phosphate group at the 3' terminus of the antisense strand and the sense strand.

In some embodiments of compositions, combinations, methods, commercial packages and kits, as disclosed herein, the double-stranded oligonucleotide (e.g., dsRNA molecules) the antisense strand and the sense strand of the nucleic acid molecule are non-phosphorylated at both the 3' terminus and at the 5' terminus.

In various embodiments of compositions, combinations, methods, commercial packages and kits, as disclosed herein, at least one double-stranded oligonucleotide is independently having the structure (A1):

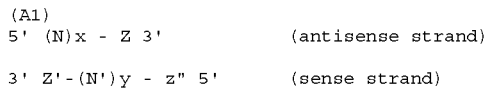

wherein each N and N' is a ribonucleotide which may be unmodified or modified, or an unconventional moiety;
wherein each of (N)x and (N')y is an oligonucleotide in which each consecutive N or N' is joined to the next N or N' by a covalent bond;
wherein each of Z and Z' is independently present or absent, but if present independently comprises 1-5 consecutive nucleotides, 1-5 consecutive non-nucleotide moieties or a combination thereof covalently attached at the 3' terminus of the strand in which it is present;
wherein z" may be present or absent, but if present is a capping moiety covalently attached at the 5' terminus of (N')y;
each of x and y is independently an integer from 18 to 40;
wherein the sequence of (N')y is complementary to the sequence of (N)x; and wherein (N)x comprises an antisense sequence to a consecutive sequence in an mRNA selected from an mRNA encoding HES1, an mRNA encoding HES5, an mRNA encoding HEY2, an mRNA encoding CDKN1B and an mRNA encoding NOTCH1.

In various embodiments of compositions, combinations, methods, commercial packages and kits, as disclosed herein, at least one double-stranded oligonucleotide is independently having the structure (A1), (N)x comprises an antisense sequence and (N')y comprises a sense sequence set forth in any one of SEQ ID NOS:23-693 and 26691-26706 (HES1); SEQ ID NOS:1496-2029 and 26725-26732 (HES5); SEQ ID NOS:7444-9007 and 26887-26900 (CDKN1B); SEQ ID NOS:13004-14801 and 26785-26788 (HEY2); SEQ ID NOS:16622-18643 and 26922-26912 (NOTCH1). In some embodiments preferred (N)x and (N')y are set forth in any one of SEQ ID NOS:26691-26706 (HES1); SEQ ID NOS:26725-26732 (HES5); SEQ ID NOS: 26887-26900 (CDKN1B); SEQ ID NOS:26785-26788 (HEY2); SEQ ID NOS:26922-26912 (NOTCH1).

In various embodiments of compositions, combinations, methods, commercial packages and kits, as disclosed herein, at least one double-stranded oligonucleotide is independently having the structure (A1) and the covalent bond joining each consecutive N and/or N' is a phosphodiester bond.

In various embodiments of compositions, combinations, methods, commercial packages and kits, as disclosed herein, at least one double-stranded oligonucleotide is independently having the structure (A1) x=y and each of x and y is 19, 20, 21, 22 or 23. In preferred embodiments x=y=19.

In some embodiments of compositions, combinations, methods, commercial packages and kits, as disclosed herein, at least one double-stranded oligonucleotide comprise a DNA moiety or a mismatch to the target at position 1 of the antisense strand (5' terminus). In some embodiments of compositions, combinations, methods, commercial packages and kits, as disclosed herein, at least one double-stranded oligonucleotide has a structure (A2) set forth below:

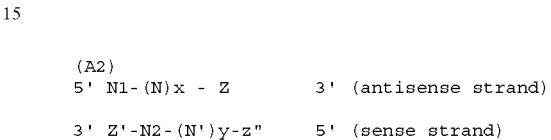

wherein each N1, N2, N and N' is independently an unmodified or modified nucleotide, or an unconventional moiety;
wherein each of (N)x and (N')y is an oligonucleotide in which each consecutive N or N' is joined to the adjacent N or N' by a covalent bond;
wherein each of x and y is independently an integer between 17 and 39;
wherein N2 is covalently bound to (N')y;
wherein N1 is covalently bound to (N)x and is mismatched to the target mRNA or is a complementary DNA moiety to the target mRNA;
wherein N1 is a moiety selected from the group consisting of natural or modified: uridine, deoxyribouridine, ribothymidine, deoxyribothymidine, adenosine or deoxyadenosine, an abasic ribose moiety and an abasic deoxyribose moiety;
wherein z" may be present or absent, but if present is a capping moiety covalently attached at the 5' terminus of N2-(N')y;
wherein each of Z and Z' is independently present or absent, but if present is independently 1-5 consecutive nucleotides, 1-5 consecutive non-nucleotide moieties or a combination thereof covalently attached at the 3' terminus of the strand in which it is present; and
wherein the sequence of (N')y has complementarity to the sequence of (N)x; and wherein the sequence of (N)x is an antisense sequence to a consecutive sequence in HES1 mRNA (SEQ ID NO:1); HES5 mRNA (SEQ ID NO:2), HEY2 mRNA (SEQ ID NO:10), CDKN1B mRNA (SEQ ID NO:7) or NOTCH1 mRNA (SEQ ID NO:11).

In some embodiments of compositions, combinations, methods, commercial packages and kits, as disclosed herein, at least one double-stranded oligonucleotide has a structure (A2) wherein the sequence of (N')y is complementary to the sequence of (N)x; and wherein the sequence of (N)x comprises an antisense sequence and (N')y comprises a sense sequence set forth in any one of SEQ ID NOS:694-1495 and 26667-26690 (HES1); SEQ ID NOS:2030-2703 and 26707-26724 (HES5); SEQ ID NOS:9008-10533 and 26867-26886 (CDKN1B); SEQ ID NOS:14802-16389 and 26779-26784 (HEY2); SEQ ID NOS:18644-26666 and 26901-26910 (NOTCH1). Preferred (N)x and (N')y are set forth in any one of SEQ ID NOS:26667-26690 (HES1); SEQ ID NOS: 26707-26724 (HES5); SEQ ID NOS:26867-26886 (CDKN1B); SEQ ID NOS:26779-26784 (HEY2); SEQ ID NOS:26901-26910 (NOTCH1). Molecules covered by the description of Structure (A2) are also referred to herein as "18+1" or "18+1 mer". In some embodiments, the N2-(N')y and N1-(N)x useful in generating double-stranded oligonucleotides having Structure (A2) are presented in Tables I-V, particularly the sequences designated as "18+1" type. In certain preferred embodiments (N)x and (N')y are selected from the sequence pairs shown in Tables I-V.

In preferred In some embodiments of compositions, combinations, methods, commercial packages and kits, as disclosed herein, at least one double-stranded oligonucleotide has a structure (A2), the sequence of (N')y is fully complementary to the sequence of (N)x. In various embodiments sequence of N2-(N')y is complementary to the sequence of N1-(N)x. In some embodiments (N)x comprises an antisense that is fully complementary to about 17 to about 39 consecutive nucleotides in a target mRNA set forth in any one of SEQ ID NOS:1, 2, 10, 7 or 11. In other embodiments (N)x comprises an antisense that is substantially complementary to about 17 to about 39 consecutive nucleotides in a target mRNA set forth in SEQ ID NOS:1, 2, 10, 7 or 11. In some embodiments, at least one double-stranded oligonucleotide has a structure (A2) and N1 and N2 form a Watson-Crick base pair. In other embodiments, at least one double-stranded oligonucleotide has a structure (A2) and N1 and N2 form a non-Watson-Crick base pair. In some embodiments a base pair is formed between a ribonucleotide and a deoxyribonucleotide.

In some embodiments of compositions, combinations, methods, commercial packages and kits, as disclosed herein, at least one double-stranded oligonucleotide has a structure (A2), x=y=18, x=y=19 or x=y=20. In preferred embodiments x=y=18. When x=18 in N1-(N)x, N1 refers to position 1 and positions 2-19 are included in (N)$_{18}$. When y=18 in N2-(N')y, N2 refers to position 19 and positions 1-18 are included in (N')$_{18}$. In some embodiments at least one double-stranded oligonucleotide has a structure (A2), N1 is covalently bound to (N)x and is mismatched to the target mRNA set forth in SEQ ID NO:1, 2, 10, 7 or 11. In various embodiments at least one double-stranded oligonucleotide has a structure (A2), N1 is covalently bound to (N)x and is a DNA moiety complementary to the target mRNA set forth in SEQ ID NO:1, 2, 10, 7 or 11.

In some embodiments of compositions, combinations, methods, commercial packages and kits, as disclosed herein, at least one double-stranded oligonucleotide has a structure (A2), a uridine in position 1 of the antisense strand is substituted with an N1 selected from natural or modified: adenosine, deoxyadenosine, uridine, deoxyuridine (dU), ribothymidine or deoxythymidine. In various embodiments, at least one double-stranded oligonucleotide has a structure (A2), N1 is selected from natural or modified: adenosine, deoxyadenosine or deoxyuridine. For example, in some embodiments a cytidine in position 1 is replaced with an adenine or a uridine; a guanosine in position 1 is replaced with an adenine or a uridine; or an adenine is replaced with a uridine.

In some embodiments of compositions, combinations, methods, commercial packages and kits, as disclosed herein, at least one double-stranded oligonucleotide has a structure (A2), guanosine in position 1 (N1) of the antisense strand is substituted with a natural or modified: adenosine, deoxyadenosine, uridine, deoxyuridine, ribothymidine or deoxythymidine. In various embodiments N1 is selected from a natural or modified: adenosine, deoxyadenosine, uridine or deoxyuridine.

In some embodiments of compositions, combinations, methods, commercial packages and kits, as disclosed herein, at least one double-stranded oligonucleotide has a structure (A2), cytidine in position 1 (N1) of the antisense strand is substituted with a natural or modified: adenosine, deoxyadenosine, uridine, deoxyuridine, ribothymidine or deoxythymidine. In various embodiments N1 is selected from a natural or modified: adenosine, deoxyadenosine, uridine or deoxyuridine.

In some embodiments of compositions, combinations, methods, commercial packages and kits, as disclosed herein, at least one double-stranded oligonucleotide has a structure (A2), adenosine in position 1 (N1) of the antisense strand is substituted with a natural or modified: deoxyadenosine, deoxyuridine, ribothymidine or deoxythymidine.

In some embodiments of compositions, combinations, methods, commercial packages and kits, as disclosed herein, at least one double-stranded oligonucleotide has a structure (A2), N1 and N2 form a base pair between natural or modified: uridine or deoxyuridine, and adenosine or deoxyadenosine. In other embodiments N1 and N2 form a base pair between natural or modified: deoxyuridine and adenosine.

In some embodiments of compositions, combinations, methods, commercial packages and kits, as disclosed herein, the double-stranded oligonucleotide molecules are also referred to as "duplexes". In some embodiments at least one double-stranded oligonucleotide has a structure (A2), and the double stranded oligonucleotide is a chemically modified dsRNA.

In certain preferred embodiments of compositions, combinations, methods, commercial packages and kits, as disclosed herein, the double-stranded oligonucleotide molecules has Structure (A2), and x=y=18. In some embodiments x=y=18 and (N)x consists of an antisense oligonucleotide present in SEQ ID NOS:694-1495 and 26667-26690 (HES1); SEQ ID NOS:2030-2703 and 26707-26724 (HES5); SEQ ID NOS:9008-10533 and 26867-26886 (CDKN1B); SEQ ID NOS:14802-16389 and 26779-26784 (HEY2); SEQ ID NOS:18644-26666 and 26901-26910 (NOTCH1).

In some embodiments of compositions, combinations, methods, commercial packages and kits, as disclosed herein, at least one double-stranded oligonucleotide has Structure (A2) and N1 is selected from a natural uridine and a modified uridine. In some embodiments, N1 is a natural uridine. In some embodiments, (N)x comprises an antisense oligonucleotide and (N')y comprises a sense oligonucleotide present in sequence pairs set forth in SEQ ID NOS:694-1495 (HES1); SEQ ID NOS:2030-2703 (HES5); SEQ ID NOS: 9008-10533 (CDKN1B); SEQ ID NOS:14802-16389 (HEY2); SEQ ID NOS:18644-26666 (NOTCH1).

In some embodiments of compositions, combinations, methods, commercial packages and kits, as disclosed herein, at least one double-stranded oligonucleotide has Structure (A2), x=y=18 and N1-(N)x comprises an antisense oligonucleotide and N2-(N')y comprises a sense oligonucleotide present in sequence pairs set forth in SEQ ID 26667-26690 (HES1); SEQ ID NOS: 26707-26724 (HES5); SEQ ID NOS: 26867-26886 (CDKN1B); SEQ ID NOS: 26779-26784 (HEY2); SEQ ID NOS: 26901-26910 (NOTCH1).

In some embodiments, at least one double-stranded oligonucleotide has Structure (A2), x=y=18 and N1 is selected from a natural or modified uridine, a natural or modified adenine, and a natural or modified thymidine.

In some embodiments at least one double-stranded oligonucleotide has Structure (A2), wherein N1 is a 2'OMe sugar-modified uridine or a 2'OMe sugar-modified adenosine. In certain embodiments at least one double-stranded oligonucleotide has Structure (A2), N2 is a 2'OMe sugar modified ribonucleotide or deoxyribonucleotide.

In some embodiments of Structure (A1) and/or Structure (A2), each N consists of an unmodified ribonucleotide. In some embodiments of Structure (A1) and/or Structure (A2) each N' consists of an unmodified ribonucleotide. In preferred embodiments at least one of N and/or N' comprises a chemically modified ribonucleotide, an unmodified deoxyribonucleotide, a chemically modified deoxyribonucleotide or an unconventional moiety. In some embodiments the unconventional moiety is selected from a mirror nucleotide, an abasic ribose moiety and an abasic deoxyribose moiety. In some embodiments the unconventional moiety is a mirror nucleotide, preferably an L-DNA moiety. In some embodiments at least one of N or N' comprises a 2'OMe sugar-modified ribonucleotide.

In some embodiments of Structure (A1) and/or Structure (A2) the sequence of (N')y is fully complementary to the sequence of (N)x. In other embodiments of Structure (A1) and/or Structure (A2) the sequence of (N')y is substantially complementary to the sequence of (N)x.

In some embodiments of Structure (A1) and/or Structure (A2) (N)x includes an antisense sequence that is fully complementary to about 17 to about 39 consecutive nucleotides in a target mRNA set forth in any one of SEQ ID NO:1, 2, 10, 7 OR 11. In other embodiments of Structure A1 and/or Structure A2 (N)x includes an antisense that is substantially complementary to about 17 to about 39 consecutive nucleotides in a target mRNA set forth in any one of SEQ ID NO:1, 2, 10, 7 OR 11. In some embodiments of Structure (A1) and/or Structure (A2), the dsRNA compound is blunt ended, for example, wherein each of z", Z and Z' is absent. In an alternative embodiment, at least one of z", Z or Z' is present.

In various embodiments Z and Z' independently include one or more covalently linked modified and or unmodified nucleotides, including deoxyribonucleotides and ribonucleotides, or one or more unconventional moieties for example inverted abasic deoxyribose moiety or abasic ribose moiety or a mirror nucleotide; one or more non-nucleotide C3 moiety or a derivative thereof, non-nucleotide C4 moiety or a derivative thereof or non-nucleotide C5 moiety or a derivative thereof, an non-nucleotide amino-C6 moiety or a derivative thereof, as defined herein, and the like. In some embodiments Z' is absent and Z is present and includes one or more non-nucleotide C3 moieties. In some embodiments Z is absent and Z' is present and includes one or more non-nucleotide C3 moieties. In some embodiments each of Z and Z' independently comprises one or more non-nucleotide C3 moieties or one or more non-nucleotide amino-C6 moieties. In some embodiments z" is present and is selected from a mirror nucleotide, an abasic moiety and an inverted abasic moiety. In some embodiments of Structures (A1) and/or (A2) each of Z and Z' includes an abasic moiety, for example a deoxyriboabasic moiety (referred to herein as "dAb") or riboabasic moiety (referred to herein as "rAb"). In some embodiments each of Z and/or Z' comprises two covalently linked abasic moieties and is for example dAb-dAb or rAb-rAb or dAb-rAb or rAb-dAb, wherein each moiety is covalently attached to an adjacent moiety, preferably via a phospho-based bond. In some embodiments the phospho-based bond includes a phosphorothioate, a phosphonoacetate or a phosphodiester bond. In preferred embodiments the phospho-based bond is a phosphodiester bond.

In some embodiments each of Z and/or Z' independently includes an alkyl moiety, optionally propane [(CH2)3] moiety (C3) or a derivative thereof including propanol (C3OH) and phospho derivative of propanediol ("C3Pi"). In some embodiments each of Z and/or Z' includes two alkyl moieties and in some examples is C3Pi-C3OH. In the example of C3Pi-C3OH, the 3' terminus of the antisense strand and/or the 3' terminus of the sense strand is covalently attached to a C3 moiety via a phospho-based bond and the C3 moiety is covalently bound to a C3OH moiety via a phospho-based bond. In some embodiments the phospho-based bonds include a phosphorothioate, a phosphonoacetate or a phosphodiester bond. In preferred embodiments the phospho-based bond is a phosphodiester bond.

In specific embodiments of Structures (A1) and (A2), Z comprises C3Pi-C3OH. In specific embodiments of Structures (A1) and (A2), Z' comprises C3Pi or C3OH. In some embodiments of Structures (A1) and (A2), a double stranded nucleic acid molecule includes a C3Pi-C3OH moiety covalently attached to the 3' terminus of the antisense strand and a C3Pi or C3OH moiety covalently attached to the 3' terminus of the sense strand.

In some embodiments of Structure (A1) and/or Structure (A2) each N consists of an unmodified ribonucleotide. In some embodiments of Structure (A1) and/or Structure (A2) each N' consists of an unmodified ribonucleotide. In preferred embodiments, at least one of N and/or N' is a chemically modified ribonucleotide, an unmodified deoxyribonucleotide, a chemically modified deoxyribonucleotide or an unconventional moiety.

In other embodiments a compound of Structure (A1) and/or (A2) includes at least one ribonucleotide modified in its sugar residue. In some embodiments the compound comprises a modification at the 2' position of the sugar residue. In some embodiments the modification in the 2' position comprises the presence of an amino, a fluoro, an alkoxy or an alkyl moiety. In certain embodiments the 2' modification includes an alkoxy moiety. In preferred embodiments the alkoxy moiety is a methoxy moiety (also referred to as 2'-O-methyl; 2'OMe; 2'OMe; 2'-OCH3). In some embodiments a nucleic acid compound includes 2'OMe sugar modified alternating ribonucleotides in one or both of the antisense strand and the sense strand. In other embodiments a compound includes 2'OMe sugar modified ribonucleotides in the antisense strand, (N)x or N1-(N)x, only. In some embodiments, the 2'OMe sugar modified ribonucleotides alternate with unmodified nucleotides. In certain embodiments the middle ribonucleotide of the antisense strand; e.g. ribonucleotide in position 10 in a 19-mer strand, is unmodified. In various embodiments the nucleic acid compound includes at least 5 alternating 2'OMe sugar modified ribonucleotides and unmodified ribonucleotides. In additional embodiments a compound of Structure (A1) and/or (A2) includes modified ribonucleotides in alternating positions wherein each ribonucleotide at the 5' terminus and at the 3' terminus of (N)x or N1-(N)x is modified in its sugar residue, and each ribonucleotide at the 5' terminus and at the 3' terminus of (N')y or N2-(N)y is unmodified in its sugar residue. In various embodiments the ribonucleotides in alternating positions are modified at the 2' position of the sugar residue.

In some embodiments the nucleic acid compound includes at least 5 alternating 2'OMe sugar modified ribonucleotides and unmodified ribonucleotides, for example at positions 1, 3, 5, 7 and 9 or at positions 11, 13, 15, 17, 19 (5'>3'). In some embodiments, (N)x of Structure (A1) or N1-(N)x of Structure (A2) includes 2'OMe sugar modified ribonucleotides in positions 2, 4, 6, 8, 11, 13, 15, 17 and 19. In some embodiments, (N)x of Structure (A1) or N1-(N)x of Structure (A2) includes 2'OMe sugar modified ribonucleotides in positions 1, 3, 5, 7, 9, 11, 13, 15, 17 and 19. In some embodiments, (N)x of Structure (A1) or N1-(N)x of Structure (A2) includes 2'OMe sugar modified ribonucleotides in one or more pyrimidines.

In some embodiments of Structure (A1) and/or (A2), neither of the sense strand nor the antisense strand is phosphorylated at the 3' terminus and at the 5' terminus. In other embodiments one or both of the sense strand and/or the antisense strand are phosphorylated at the 3' termini. In other embodiments one or both of the sense strand and/or the antisense strand are phosphorylated at the 5' terminus.

In some embodiments the double stranded molecule disclosed herein includes one or more of the following modifications:
N in at least one of positions 5, 6, 7, 8, or 9 from the 5' terminus of the antisense strand is selected from a DNA, TNA, a 2'5' nucleotide or a mirror nucleotide;
N' in at least one of positions 9 or 10 from the 5' terminus of the sense strand is selected from a TNA, 2'5' nucleotide and a pseudoUridine;
N' in 4, 5, or 6 consecutive positions at the 3' terminus of (N')y comprises a 2'5' ribonucleotide;
one or more pyrimidine ribonucleotides are 2' sugar modified in the sense strand, the antisense strand or both the sense strand and the antisense strand.

In some embodiments the double stranded molecule disclosed herein includes a combination of the following modifications:
the antisense strand includes a DNA, TNA, a 2'5' nucleotide or a mirror nucleotide in at least one of positions 5, 6, 7, 8, or 9 from the 5' terminus;
the sense strand includes at least one of a TNA, a 2'5' nucleotide and a pseudoUridine in positions 9 or 10 from the 5' terminus; and
one or more pyrimidine ribonucleotides are 2' modified in the sense strand, the antisense strand or both the sense strand and the antisense strand.

In some embodiments the double stranded molecule disclosed herein includes a combination of the following modifications:
the antisense strand includes a DNA, 2'5' nucleotide or a mirror nucleotide in at least one of positions 5, 6, 7, 8, or 9 from the 5' terminus;
the sense strand includes 4, 5, or 6 consecutive 2'5' nucleotides at the 3' penultimate or 3' terminal positions; and
one or more pyrimidine ribonucleotides are 2' sugar modified in the sense strand, the antisense strand or both the sense strand and the antisense strand.

In some embodiments of Structure (A1) and/or (A2) (N)y includes at least one unconventional moiety selected from a mirror nucleotide, a 2'5' ribonucleotide and a TNA. In some embodiments the unconventional moiety is a mirror nucleotide. In various embodiments the mirror nucleotide is selected from an L-ribonucleotide (L-RNA) and an L-deoxyribonucleotide (L-DNA). In preferred embodiments the mirror nucleotide is L-DNA. In certain embodiments the sense strand comprises an unconventional moiety in position 9 or 10 (from the 5' terminus). In preferred embodiments the sense strand includes an unconventional moiety in position 9 (from the 5' terminus). In some embodiments the sense strand is 19 nucleotides in length and comprises 4, 5, or 6 consecutive unconventional moieties in positions 15 (from the 5' terminus). In some embodiments the sense strand includes 4 consecutive 2'5' ribonucleotides in positions 15, 16, 17, and 18. In some embodiments the sense strand includes 5 consecutive 2'5' ribonucleotides in positions 15, 16, 17, 18 and 19. In various embodiments the sense strand further comprises Z'. In some embodiments Z' includes a C3OH moiety or a C3Pi moiety.

In some embodiments of Structure (A1) and/or (A2) (N)y comprises at least one unconventional moiety selected from a mirror nucleotide and a nucleotide joined to an adjacent nucleotide by a 2'-5' internucleotide phosphate bond. In some embodiments the unconventional moiety is a mirror nucleotide. In various embodiments the mirror nucleotide is selected from an L-ribonucleotide (L-RNA) and an L-deoxyribonucleotide (L-DNA). In preferred embodiments the mirror nucleotide is L-DNA.

In some embodiments of Structure A1 (N')y comprises at least one L-DNA moiety. In some embodiments x=y=19 and (N')y consists of unmodified ribonucleotides at positions 1-17 and 19 and one L-DNA at the 3' penultimate position (position 18). In other embodiments x=y=19 and (N')y consists of unmodified ribonucleotides at position 1-16 and 19 and two consecutive L-DNA nucleotides at the 3' penultimate position (positions 17 and 18). In various embodiments the unconventional moiety is a nucleotide joined to an adjacent nucleotide by a 2'-5' internucleotide phosphate linkage. According to various embodiments (N')y comprises 2, 3, 4, 5, or 6 consecutive ribonucleotides at the 3' terminus linked by 2'-5' internucleotide linkages. In one embodiment, four consecutive ribonucleotides at the 3' terminus of (N')y are joined by three 2'-5' phosphodiester bonds. In one embodiment, five consecutive ribonucleotides at the 3' terminus of (N')y are joined by four 2'-5' phosphodiester bonds. In some embodiments, wherein one or more of the 2'-5' ribonucleotides form a 2'-5' phosphodiester bonds the nucleotide further comprises a 3'-O-methyl (3'OMe) sugar modification. In some embodiments the 3' terminal nucleotide of (N')y comprises a 3'OMe sugar modification. In certain embodiments x=y=19 and (N')y comprises two or more consecutive nucleotides at positions 15, 16, 17, 18 and 19 which are joined to an adjacent nucleotide by a 2'-5' internucleotide bond. In various embodiments, the nucleotide forming the 2'-5' internucleotide bond comprises a ribonucleotide. In preferred embodiments the 2'-5' internucleotide bond is a phosphosdiester internucleotide bond. In various embodiments the nucleotide forming the 2'-5' internucleotide bond comprises a 3' deoxyribose nucleotide or a 3' methoxy nucleotide. In various embodiments, the ribonucleotide forming the 2'-5' internucleotide bond comprises a 3' deoxyribose ribonucleotide or a 3' methoxy ribonucleotide. In some embodiments x=y=19 and (N')y comprises nucleotides joined to the adjacent nucleotide by a 2'-5' internucleotide bond between positions 15-16, 16-17 and 17-18 or between positions 16-17, 17-18 and 18-19. In some embodiments x=y=19 and (N')y comprises nucleotides joined to the adjacent nucleotide by a 2'-5' internucleotide bond between positions 16-17 and 17-18 or between positions 17-18 and 18-19 or between positions 15-16 and 17-18. In various embodiments, the nucleotides forming the 2'-5' internucleotide bond comprise ribonucleotides. In various embodiments, the nucleotides forming the 2'-5' internucleotide bond are ribonucleotides. In other embodiments the pyrimidine ribonucleotides (rU, rC) in (N')y are substituted with a ribonucleotide joined to the adjacent ribonucleotide by a 2'-5' internucleotide bond.

In some embodiments of Structure (A2), (N)y comprises at least one L-DNA moiety. In some embodiments x=y=18 and N2-(N')y, consists of unmodified ribonucleotides at positions 1-17 and 19 and one L-DNA at the 3' penultimate position (position 18). In other embodiments x=y=18 and N2-(N')y consists of unmodified ribonucleotides at position 1-16 and 19 and two consecutive L-DNA at the 3' penultimate position (positions 17 and 18). In various embodiments the unconventional moiety is a nucleotide joined to an adjacent nucleotide by a 2'-5' internucleotide phosphate linkage. According to various embodiments N2-(N')y comprises 2, 3, 4, 5, or 6 consecutive ribonucleotides at the 3' terminus linked by 2'-5' internucleotide linkages. In one embodiment, four consecutive ribonucleotides at the 3' terminus of N2-(N')y are joined by three 2'-5' phosphodiester bonds, wherein one or more of the 2'-5' ribonucleotides which form the 2'-5' phosphodiester bonds further comprises a 3'-O-methyl (3'OMe) sugar modification. In some embodiments the 3' terminal ribonucleotide of N2-(N')y comprises a 2'OMe sugar modification. In certain embodiments x=y=18 and N2-(N')y comprises two or more consecutive nucleotides at positions 15, 16, 17, 18 and 19 joined to an adjacent nucleotide by a 2'-5' internucleotide bond. In various embodiments the nucleotide forming the 2'-5' internucleotide bond comprises a 3' deoxyribose nucleotide or a 3' methoxy nucleotide. In various embodiments, the ribonucleotide forming the 2'-5' internucleotide bond comprises a 3' deoxyribose ribonucleotide or a 3' methoxy ribonucleotide. In some embodiments x=y=18 and N2-(N')y comprises nucleotides joined to the adjacent nucleotide by a 2'-5' internucleotide bond between positions 16-17 and 17-18 or between positions 17-18 and 18-19 or between positions 15-16 and 17-18. In various embodiments, the nucleotides forming the 2'-5' internucleotide bond comprise ribonucleotides. In various embodiments, the nucleotides forming the 2'-5' internucleotide bond are ribonucleotides. In other embodiments a pyrimidine ribonucleotide (rU, rC) in (N')y comprises a ribonucleotide joined to the adjacent ribonucleotide by a 2'-5' internucleotide bond.

In further embodiments of Structures (A1) and/or (A2) (N')y comprises 1-8 modified ribonucleotides wherein the modified ribonucleotide is a deoxyribose (DNA) nucleotide. In certain embodiments (N')y comprises 1, 2, 3, 4, 5, 6, 7, or up to 8 DNA moieties.

In presently preferred embodiments the inhibitor provided herein is a synthetic, chemically modified double-stranded oligonucleotide (e.g. dsRNA) compound, selected form: a double-stranded oligonucleotide that down-regulates HES1 expression and includes an oligonucleotide pair selected from Table I; a double-stranded oligonucleotide that down-regulates HES5 expression and includes an oligonucleotide pair selected from Table II; a double-stranded oligonucleotide that down-regulates HEY2 expression and includes an oligonucleotide pair selected from Table III; a double-stranded oligonucleotide that down-regulates CDKN1B expression and includes an oligonucleotide pair selected from Table IV; a double-stranded oligonucleotide that down-regulates NOTCH1 expression and includes an oligonucleotide pair selected from Table V. Tables I-V are provided herein below.

TABLE I

Selected HES1_dsRNA

| dsRNA Name | SEQ ID NO: | Sense strand (5' > 3') | SEQ ID NO: | Antisense strand (5' > 3') | Type |
| --- | --- | --- | --- | --- | --- |
| HES1_12 | 26667 | GCCAGCUGAUAUAAUGGAA | 26679 | UUCCAUUAUAUCAGCUGGC | 18 + 1 |
| HES1_13 | 26668 | GCCAGUGUCAACACGACAA | 26680 | UUGUCGUGUUGACACUGGC | 18 + 1 |
| HES1_14 | 26669 | CAGCGAGUGCAUGAACGAA | 26681 | UUCGUUCAUGCACUCGCUG | 18 + 1 |
| HES1_16 | 26670 | GAACGAGGUGACCCGCUUA | 26682 | UAAGCGGGUCACCUCGUUC | 18 + 1 |
| HES1_19 | 26671 | CCAGUGUCAACACGACACA | 26683 | UGUGUCGUGUUGACACUGG | 18 + 1 |
| HES1_20 | 26672 | CGAGUGCAUGAACGAGGUA | 26684 | UACCUCGUUCAUGCACUCG | 18 + 1 |
| HES1_21 | 26673 | UGUCAACACGACACCGGAA | 26685 | UUCCGGUGUCGUGUUGACA | 18 + 1 |
| HES1_22 | 26674 | CAGUGUCAACACGACACCA | 26686 | UGGUGUCGUGUUGACACUG | 18 + 1 |
| HES1_24 | 26675 | GGCGGACUCCAUGUGGAGA | 26687 | UCUCCACAUGGAGUCCGCC | 18 + 1 |
| HES1_28 | 26676 | CGGAUAAACCAAAGACAGA | 26688 | UCUGUCUUUGGUUUAUCCG | 18 + 1 |
| HES1_33 | 26677 | AGUGCAUGAACGAGGUGAA | 26689 | UUCACCUCGUUCAUGCACU | 18 + 1 |
| HES1_36 | 26678 | CAGCGAGUGCAUGAACGAU | 26690 | AUCGUUCAUGCACUCGCUG | 18 + 1 |
| HES1_10 | 26691 | GUAUUAAGUGACUGACCAU | 26699 | AUGGUCAGUCACUUAAUAC | 19 |
| HES1_11 | 26692 | GAAAACACUGAUUUUGGAU | 26700 | AUCCAAAAUCAGUGUUUUC | 19 |
| HES1_15 | 26693 | ACUGCAUGACCCAGAUCAA | 26701 | UUGAUCUGGGUCAUGCAGU | 19 |
| HES1_17 | 26694 | AGCCAGUGUCAACACGACA | 26702 | UGUCGUGUUGACACUGGCU | 19 |
| HES1_18 | 26695 | GUGUCAACACGACACCGGA | 26703 | UCCGGUGUCGUGUUGACAC | 19 |
| HES1_26 | 26696 | CAGUGAAGCACCUCCGGAA | 26704 | UUCCGGAGGUGCUUCACUG | 19 |
| HES1_27 | 26697 | CAUGGAGAAAAGACGAAGA | 26705 | UCUUCGUCUUUUCUCCAUG | 19 |
| HES1_35 | 26698 | CAGCUGAUAUAAUGGAGAA | 26706 | UUCUCCAUUAUAUCAGCUG | 19 |

TABLE II

Selected HES5 dsRNA

| dsRNA Name | SEQ ID NO: | Sense strand (5' > 3') | SEQ ID NO: | Antisense strand (5' > 3') | Type |
|---|---|---|---|---|---|
| HES5_19 | 26707 | GGAGUUCGCGCGGCACCAA | 26716 | UUGGUGCCGCGCGAACUCC | 18 + 1 |
| HES5_20 | 26708 | GCGACACGCAGAUGAAGCA | 26717 | UGCUUCAUCUGCGUGUCGC | 18 + 1 |
| HES5_22 | 26709 | CGGGCACAUUUGCCUUUUA | 26718 | UAAAAGGCAAAUGUGCCCG | 18 + 1 |
| HES5_23 | 26710 | CGCCAGCGACACGCAGAUA | 26719 | UAUCUGCGUGUCGCUGGCG | 18 + 1 |
| HES5_24 | 26711 | CCGACUGCGGAAGCCGGUA | 26720 | UACCGGCUUCCGCAGUCGG | 18 + 1 |
| HES5_26 | 26712 | GCGCGGCACCAGCCCAACA | 26721 | UGUUGGGCUGGUGCCGCGC | 18 + 1 |
| HES5_27 | 26713 | AACCGACUGCGGAAGCCGA | 26722 | UCGGCUUCCGCAGUCGGUU | 18 + 1 |
| HES5_28 | 26714 | CGACUGCGGAAGCCGGUGA | 26723 | UCACCGGCUUCCGCAGUCG | 18 + 1 |
| HES5_29 | 26715 | CGACACGCAGAUGAAGCUA | 26724 | UAGCUUCAUCUGCGUGUCG | 18 + 1 |
| HES5_10 | 26725 | CUGUAGAGGACUUUCUUCA | 26729 | UGAAGAAAGUCCUCUACAG | 19 |
| HES5_21 | 26726 | GCCAGCGACACGCAGAUGA | 26730 | UCAUCUGCGUGUCGCUGGC | 19 |
| HES5_25 | 26727 | GCGACACGCAGAUGAAGCU | 26731 | AGCUUCAUCUGCGUGUCGC | 19 |
| HES5_8 | 26728 | GGGUUCUAUGAUAUUUGUA | 26732 | UACAAAUAUCAUAGAACCC | 19 |

TABLE III

Selected HEY2 dsRNA

| dsRNA Name | SEQ ID NO: | Sense strand (5' > 3') | SEQ ID NO: | AntiSense strand (5' > 3') | Type |
|---|---|---|---|---|---|
| HEY2_1 | 26779 | GGGAGCGAGAACAAUUACA | 26782 | UGUAAUUGUUCUCGCUCCC | 18 + 1 |
| HEY2_2 | 26780 | GGGUAAAGGCUACUUUGAA | 26783 | UUCAAAGUAGCCUUUACCC | 18 + 1 |
| HEY2_5 | 26781 | GAAAAGGCGUCGGGAUCGA | 26784 | UCGAUCCCGACGCCUUUUC | 18 + 1 |
| HEY2_3 | 26785 | GGGUAAAGGCUACUUUGAC | 26787 | GUCAAAGUAGCCUUUACCC | 19 |
| HEY2_4 | 26786 | CCAUGGCCCACCACCAUCA | 26788 | UGAUGGUGGUGGGCCAUGG | 19 |

TABLE IV

Selected CDKN1B (p27) duplexes

| DsRNA Name | SEQ ID NO: | Sense strand (5' > 3') | SEQ ID NO: | Antisense strand (5' > 3') | Type |
|---|---|---|---|---|---|
| CDKN1B_29 | 26867 | AGCCAAAGUGGCAUGUUUA | 26877 | UAAACAUGCCACUUUGGCU | 18 + 1 |
| CDKN1B_30 | 26868 | GCAUACUGAGCCAAGUAUA | 26878 | UACAUCCUGGCUCUCCUGC | 18 + 1 |
| CDKN1B_31 | 26869 | CAGCGCAAGUGGAAUUUCA | 26879 | UGAAAUUCCACUUGCGCUG | 18 + 1 |
| CDKN1B_33 | 26870 | UGCAUACUGAGCCAAGUAA | 26880 | UAUGCCACUUUGGCUUGUA | 18 + 1 |
| CDKN1B_34 | 26871 | GGAGCGGAUGGACGCCAGA | 26881 | UCUGACAUCCUGGCUCUCC | 18 + 1 |
| CDKN1B_35 | 26872 | AGGGCAGCUUGCCCGAGUA | 26882 | UACUCGGGCAAGCUGCCCU | 18 + 1 |
| CDKN1B_36 | 26873 | GUACUACCUGUGUAUAUAG | 26883 | UUUGGCUCAGUAUGCAACC | 18 + 1 |
| CDKN1B_37 | 26874 | UGCAUACUGAGCCAAGUAU | 26884 | UUACUUGGCUCAGUAUGCA | 18 + 1 |
| CDKN1B_38 | 26875 | GAGUGUCUAACGGGAGCCA | 26885 | UCCGCUGACAUCCUGGCUC | 18 + 1 |

TABLE IV-continued

Selected CDKN1B (p27) duplexes

| DsRNA Name | SEQ ID NO: | Sense strand (5' > 3') | SEQ ID NO: | Antisense strand (5' > 3') | Type |
|---|---|---|---|---|---|
| CDKN1B_40 | 26876 | GCGCAAGUGGAAUUUCGAA | 26886 | UUCGAAAUUCCACUUGCGC | 18 + 1 |
| CDKN1B_3 | 26887 | CGCAUUUGGUGGACCCAAA | 26894 | UUUGGGUCCACCAAAUGCG | 19 |
| CDKN1B_4 | 26888 | GCAAUUAGGUUUUUCCUUA | 26895 | UAAGGAAAAACCUAAUUGC | 19 |
| CDKN1B_10 | 26889 | CAUUGUACUACCUGUGUAU | 26896 | AUACACAGGUAGUACAAUG | 19 |
| CDKN1B_11 | 26890 | GGUUUUUCCUUAUUUGCUU | 26897 | AAGCAAAUAAGGAAAAACC | 19 |
| CDKN1B_18 | 26891 | AGCGCAAGUGGAAUUUCGA | 26898 | UCGAAAUUCCACUUGCGCU | 19 |
| CDKN1B_28 | 26892 | GGUUGCAUACUGAGCCAAA | 26899 | AUCCUGGCUCUCCUGCGCC | 19 |
| CDKN1B_32 | 26893 | AGCCAAAGUGGCAUGUUUU | 26900 | AAAACAUGCCACUUUGGCU | 19 |

TABLE V

Selected NOTCH1 dsRNA

| Name | SEQ ID NO: | Sense strand 5' > 3' | SEQ ID NO: | Antisense strand 5' > 3' | |
|---|---|---|---|---|---|
| NOTCH1_1 | 26901 | CCUUCUACUGCGAGUGUCA | 26906 | UGACACUCGCAGUAGAAGG | 18 + 1 |
| NOTCH1_2 | 26902 | GCUACAACUGCGUGUGUGA | 26907 | UCACACACGCAGUUGUAGC | 18 + 1 |
| NOTCH1_3 | 26903 | UCCUUCUACUGCGAGUGUA | 26908 | UACACUCGCAGUAGAAGGA | 18 + 1 |
| NOTCH1_4 | 26904 | CUCCUUCUACUGCGAGUGA | 26909 | UCACUCGCAGUAGAAGGAG | 18 + 1 |
| NOTCH1_5 | 26905 | CAGCGCAGAUGCCAACAUA | 26910 | UAUGUUGGCAUCUGCGCUG | 18 + 1 |
| NOTCH1_6 | 26911 | ACAACUGCGUGUGUGUCAA | 26912 | UUGACACACGCAGUUGU | 19 |

In some embodiments of the combinations, compositions and methods, the double-stranded oligonucleotide molecule includes a sense strand and an antisense strand selected from the oligonucleotide pairs set forth in Tables I-V. Unless otherwise stated all positions along a sense strand or antisense strand are counted from the 5' to the 3' (5'-3').

In some embodiments the double stranded oligonucleotide includes a particular sense strand and a particular antisense strand set forth in SEQ ID NOS:23-1495 or 26667-26706 (HES1), SEQ ID NOS:1496-2703 or 26707-26732 (HES5), SEQ ID NOS:13004-16621 or 26779-26788 (HEY2), SEQ ID NOS:7444-10533 or 26867-26900 (CDKN1B) or SEQ ID NOS:16622-26666 or 26901-26912 (NOTCH1).

In some embodiments the double stranded nucleic acid molecule has the structure:

wherein each "|" represents base pairing between the ribonucleotides;
wherein each X is any one of A, C, G, U and is independently an unmodified or modified ribonucleotide, an unmodified or modified deoxyribonucleotide or an unconventional moiety;
wherein each of Z and Z' is independently present or absent, but if present is independently 1-5 consecutive nucleotides or non-nucleotide moieties or a combination thereof covalently attached at the 3' terminus of the strand in which it is present; and
wherein z" may be present or absent, but if present is a capping moiety covalently attached at the 5' terminus of the sense strand.

In preferred embodiments the double-stranded oligonucleotide molecule comprises modified ribonucleotides and unconventional moieties.

Chemical Modifications

All analogs of, or modifications to, a nucleotide/oligonucleotide may be employed with the present embodiments, provided that said analogue or modification does not substantially affect the function of the nucleotide/oligonucleotide. The nucleotides can be selected from naturally occurring or synthetic modified bases. Naturally occurring bases include adenine, guanine, cytosine, thymine and uracil. Modified bases of nucleotides are described herein.

In addition, analogues of polynucleotides can be prepared wherein the structure of one or more nucleotide is fundamentally altered and better suited as therapeutic or experimental reagents. An example of a nucleotide analogue is a peptide nucleic acid (PNA) wherein the deoxyribose (or ribose) phosphate backbone in DNA (or RNA is replaced with a polyamide backbone which is similar to that found in peptides. PNA analogues have been shown to be resistant to enzymatic degradation and to have extended stability in vivo and in vitro. Other modifications that can be made to oligonucleotides include polymer backbones, cyclic backbones, acyclic backbones, thiophosphate-D-ribose backbones, triester backbones, thioate backbones, 2'-5' bridged backbone, artificial nucleic acids, morpholino nucleic acids, locked nucleic acid (LNA), glycol nucleic acid (GNA), threose nucleic acid (TNA), arabinoside, and mirror nucleoside (for example, beta-L-deoxynucleoside instead of beta-D-deoxynucleoside). Examples of dsRNA molecules comprising LNA nucleotides are disclosed in Elmen et al., (NAR 2005, 33(1):439-447).

The nucleic acid compounds useful in methods, compositions and combinations disclosed herein can be synthesized using one or more inverted nucleotides, for example inverted thymidine or inverted adenine (see, for example, Takei, et al., 2002, JBC 277(26):23800-06).

The term "unconventional moiety" as used herein refers to abasic ribose moiety, an abasic deoxyribose moiety, a deoxyribonucleotide, a modified deoxyribonucleotide, a mirror nucleotide, a non-base pairing nucleotide analog and a nucleotide joined to an adjacent nucleotide by a 2'-5' internucleotide phosphate bond; C3, C4, C5 and C6 moieties; bridged nucleic acids including LNA and ethylene bridged nucleic acids.

The term "capping moiety" as used herein includes abasic ribose moiety, abasic deoxyribose moiety, modifications of abasic ribose and abasic deoxyribose moieties including 2' O alkyl modifications; inverted abasic ribose and abasic deoxyribose moieties and modifications thereof; C6-imino-Pi; a mirror nucleotide including L-DNA and L-RNA; 5'OMe nucleotide; and nucleotide analogs including 4',5'-methylene nucleotide; 1-(β-D-erythrofuranosyl)nucleotide; 4'-thio nucleotide, carbocyclic nucleotide; 5'-amino-alkyl phosphate; 1,3-diamino-2-propyl phosphate, 3-aminopropyl phosphate; 6-aminohexyl phosphate; 12-aminododecyl phosphate; hydroxypropyl phosphate; 1,5-anhydrohexitol nucleotide; alpha-nucleotide; threo-pentofuranosyl nucleotide; acyclic 3',4'-seco nucleotide; 3,4-dihydroxybutyl nucleotide; 3,5-dihydroxypentyl nucleotide, 5'-5'-inverted abasic moiety; 1,4-butanediol phosphate; 5'-amino; and bridging or non bridging methylphosphonate and 5'-mercapto moieties.

Abasic deoxyribose moiety includes for example abasic deoxyribose-3'-phosphate; 1,2-dideoxy-D-ribofuranose-3-phosphate; 1,4-anhydro-2-deoxy-D-ribitol-3-phosphate. Inverted abasic deoxyribose moiety includes inverted deoxyriboabasic; 3',5' inverted deoxyriboabasic 5'-phosphate.

A "mirror" nucleotide is a nucleotide with reversed chirality to the naturally occurring or commonly employed nucleotide, i.e., a mirror image (L-nucleotide) of the naturally occurring (D-nucleotide). The nucleotide can be a ribonucleotide or a deoxyribonucleotide and may further comprise at least one sugar, base and/or backbone modification. U.S. Pat. No. 6,602,858 discloses nucleic acid catalysts comprising at least one L-nucleotide substitution. Mirror nucleotide includes for example L-DNA (L-deoxyriboadenosine-3'-phosphate (mirror dA); L-deoxyribocytidine-3'-phosphate (mirror dC); L-deoxyriboguanosine-3'-phosphate (mirror dG); L-deoxyribothymidine-3'-phosphate (mirror image dT)) and L-RNA (L-riboadenosine-3'-phosphate (mirror rA); L-ribocytidine-3'-phosphate (mirror rC); L-riboguanosine-3'-phosphate (mirror rG); L-ribouracil-3'-phosphate (mirror dU).

In various embodiments of Structure A1 or Structure A2, Z and Z' are absent. In other embodiments Z or Z' is present.

In some embodiments each of Z and/or Z' independently includes a C2, C3, C4, C5 or C6 alkyl moiety, optionally a C3 [propane, —(CH2)3-] moiety or a derivative thereof including propanol (C3-OH/C3OH), propanediol, and phosphodiester derivative of propanediol ("C3Pi"). In preferred embodiments each of Z and/or Z' includes two hydrocarbon moieties and in some examples is C3Pi-C3OH or C3Pi-C3Pi. Each C3 is covalently conjugated to an adjacent C3 via a covalent bond, preferably a phospho-based bond. In some embodiments the phospho-based bond is a phosphorothioate, a phosphonoacetate or a phosphodiester bond.

In specific embodiments, at least one double-stranded oligonucleotide has Structure A1 x=y=19 and Z comprises at least one C3 alkyl overhang. In specific embodiments, at least one double-stranded oligonucleotide has Structure A2 x=y=18 and Z comprises at least one C3 alkyl overhang. In some embodiments the C3-C3 overhang is covalently attached to the 3' terminus of (N)x or (N')y via a covalent linkage, preferably a phosphodiester linkage. In some embodiments the linkage between a first C3 and a second C3 is a phosphodiester linkage. In some embodiments the 3' non-nucleotide overhang is C3Pi-C3Pi. In some embodiments the 3' non-nucleotide overhang is C3Pi-C3Ps. In some embodiments the 3' non-nucleotide overhang is C3Pi-C3OH (OH is hydroxy). In some embodiments the 3' non-nucleotide overhang is C3Pi-C3OH.

In various embodiments the alkyl moiety comprises an alkyl derivative including a C3 alkyl, C4 alkyl, C5 alky or C6 alkyl moiety comprising a terminal hydroxyl, a terminal amino, or terminal phosphate group. In some embodiments the alkyl moiety is a C3 alkyl or C3 alkyl derivative moiety. In some embodiments the C3 alkyl moiety comprises propanol, propylphosphate, propylphosphorothioate or a combination thereof. The C3 alkyl moiety is covalently linked to the 3' terminus of (N')y and/or the 3' terminus of (N)x via a phosphodiester bond. In some embodiments the alkyl moiety comprises propanol, propyl phosphate or propyl phosphorothioate. In some embodiments each of Z and Z' is independently selected from propanol, propyl phosphate propyl phosphorothioate, combinations thereof or multiples thereof in particular 2 or 3 covalently linked propanol, propyl phosphate, propyl phosphorothioate or combinations thereof. In some embodiments each of Z and Z' is independently selected from propyl phosphate, propyl phosphorothioate, propyl phospho-propanol; propyl phospho-propyl phosphorothioate; propylphospho-propyl phosphate; (propyl phosphate)3, (propyl phosphate)2-propanol, (propyl phosphate)2-propyl phosphorothioate. Any propane or propanol conjugated moiety can be included in Z or Z'.

Exemplary 3' terminal non-nucleotide moieties are as follows:

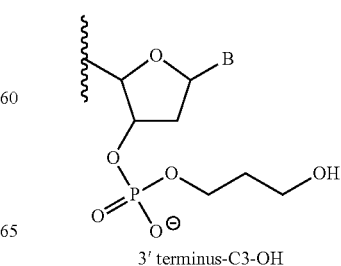

3' terminus-C3-OH

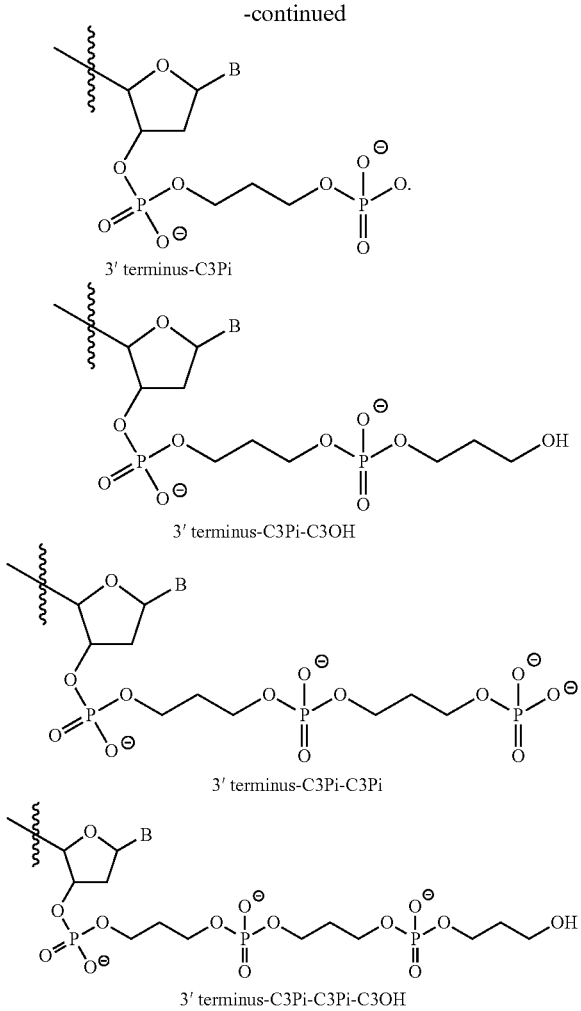

3' terminus-C3Pi

3' terminus-C3Pi-C3OH

3' terminus-C3Pi-C3Pi

3' terminus-C3Pi-C3Pi-C3OH

Indications

The molecules and compositions disclosed herein are useful in the treatment of diseases and disorders of the ear, as well as other diseases and conditions herein described.

The Human Ear

The human ear is comprised of three major structural components: the outer, middle, and inner ears, which function together to convert sound waves into nerve impulses that travel to the brain, where they are perceived as sound. The inner ear also helps to maintain balance.

The anatomy of the middle and the inner ear is well known to those of ordinary skill in the art (see, e.g., *Atlas of Sensory Organs: Functional and Clinical Analysis*, Andrs Csillag, Humana Press (2005), pages 1-82, incorporated herein by reference). In brief, the middle ear consists of the eardrum and a small air-filled chamber containing a sequence of three tiny bones known as the ossicles, which link the eardrum to the inner ear.

The inner ear (labyrinth) is a complex structure consisting of the cochlea, which is the organ of hearing and the vestibular system, the organ of balance. The vestibular system consists of the saccule and the utricle, which determine position sense, and the semicircular canals, which help maintain balance.

The cochlea houses the organ of Corti, which consists, in part, of about 20,000 specialized sensory cells, called "inner ear hair cells" or "hair cells". These cells have small hairline projections (cilia) that extend into the cochlear fluid. Sound vibrations transmitted from the ossicles in the middle ear to the oval window in the inner ear cause the fluid and cilia to vibrate. Hair cells in different parts of the cochlea vibrate in response to different sound frequencies and convert the vibrations into nerve impulses which are sent to the brain for processing and interpretation. The inner ear hair cells (IHC) are surrounded by inner ear support cells. Supporting cells underlie, at least partially surround, and physically support sensory hair cells within the inner ear. Representative examples of support cells include inner rod (pillar cells), outer rod (pillar cells), inner phalangeal cells, outer phalangeal cells (of Deiters), cells of Held, cells of Hensen, cells of Claudius, cells of Boettcher, interdental cells and auditory teeth (of Huschke).

The spiral ganglion is the group of nerve cells that send a representation of sound from the cochlea to the brain. The cell bodies of the spiral ganglion neurons are found in the spiral structure of the cochlea and are part of the central nervous system. Their dendrites make synaptic contact with the base of hair cells, and their axons are bundled together to form the auditory portion of the eighth cranial nerve (vestibulocochlear nerve).

Hearing Loss

Auditory hair cells are sensory receptors located in the organ of Corti of the cochlea involved in detecting sound. The cochlear hair cells come in two anatomically and functionally distinct types: the outer and inner hair cells. Auditory hair cells convert sound information into electrical signals that are sent via nerve fibers to the brain and processed.

Vestibular hair cells, located in the vestibular organs of the inner ear (utricle, saccule, ampullae), detect changes in head position and convey this information to the brain to help maintain balance posture and eye position.

In the absence of auditory hair cells, sound waves are not converted into neural signals and hearing deficits ensue, for example, decreased hearing sensitivity, i.e. sensorineural hearing loss. In the absence of vestibular hair cells, balance deficits ensue.

Despite the protective effect of the acoustic reflex, loud noise can damage and destroy hair cells. Irreversible hair cell death is elicited by metabolic or biochemical changes in the hair cells that involve reactive oxygen species (ROS). Exposure to certain drugs and continued exposure to loud noise, inter alia, cause progressive damage, eventually resulting in ringing in the ears (tinnitus) and or hearing loss.

Acquired hearing loss can be caused by several factors including exposure to harmful noise levels, exposure to ototoxic drugs such as cisplatin and aminoglycoside antibiotics and aging.

U.S. Ser. No. 11/655,610 to the assignee of the present invention relates to methods of treating hearing impairment by inhibiting a pro-apoptotic gene in general and p53 in particular. International Patent Publication No. WO 2005/119251 relates to methods of treating deafness. International Patent Publication No. WO/2005/055921 relates to foam compositions for treatment of ear disorders. U.S. Pat. No. 7,087,581 relates to methods of treating diseases and disorders of the inner ear. PCT Publication No. WO 2009/147684, assigned to the assignee of the present application, and incorporated herein by reference in its entirety discloses certain compounds and compositions for treating otic disorders and diseases.

Ear Disorders

The present disclosure is directed, inter alia, to compositions, combinations and methods useful in treating a patient suffering from or at risk of various ear disorders. Ear disorders include hearing loss induced for example by ototoxins, excessive noise or ageing. Middle and inner ear disorders produce many of the same symptoms, and a disorder of the middle ear may affect the inner ear and vice versa.

In addition to hearing loss, ear disorders include myringitis, an eardrum infection caused by a variety of viruses and bacteria; temporal bone fracture for example due to a blow to the head; auditory nerve tumors (acoustic neuroma, acoustic neurinoma, vestibular schwannoma, eighth nerve tumor).

In various embodiments, the methods, combinations and compositions disclosed herein are useful in treating various conditions of hearing loss. Without being bound by theory, the hearing loss may be due to apoptotic inner ear hair cell damage or loss (Zhang et al., Neuroscience 2003. 120:191-205; Wang et al., J. Neuroscience 23((24):8596-8607), wherein the damage or loss is caused by infection, mechanical injury, loud sound (noise), aging (presbycusis), or chemical-induced ototoxicity.

By "ototoxin" in the context disclosed herein is meant a substance that through its chemical action injures, impairs or inhibits the activity of the sound receptors component of the nervous system related to hearing, which in turn impairs hearing (and/or balance). In the context of the present invention, ototoxicity includes a deleterious effect on the inner ear hair cells. Ototoxic agents that cause hearing impairments include, but are not limited to, neoplastic agents such as vincristine, vinblastine, cisplatin and cisplatin-like compounds, taxol and taxol-like compounds, dideoxy-compounds, e.g., dideoxyinosine; alcohol; metals; industrial pollutants involved in occupational or environmental exposure; contaminants of food or medicinals; and over-doses of vitamins or therapeutic drugs, e.g., antibiotics such as penicillin or chloramphenicol, and megadoses of vitamins A, D, or B6, salicylates, quinines and loop diuretics. By "exposure to an ototoxic agent" is meant that the ototoxic agent is made available to, or comes into contact with, a mammal. Exposure to an ototoxic agent can occur by direct administration, e.g., by ingestion or administration of a food, medicinal, or therapeutic agent, e.g., a chemotherapeutic agent, by accidental contamination, or by environmental exposure, e.g., aerial or aqueous exposure. Typically, treatment is performed to prevent or reduce ototoxicity, especially resulting from or expected to result from administration of therapeutic drugs. Preferably a composition comprising a therapeutically effective amount of a chemically modified siRNA compound of the invention is given immediately after the exposure to prevent or reduce the ototoxic effect. More preferably, treatment is provided prophylactically, either by administration of the pharmaceutical composition of the invention prior to or concomitantly with the ototoxic pharmaceutical or the exposure to the ototoxin. Incorporated herein by reference are chapters 196, 197, 198 and 199 of The Merck Manual of Diagnosis and Therapy, 14th Edition, (1982), Merck Sharp & Dome Research Laboratories, N.J. and corresponding chapters in the most recent 16th edition, including Chapters 207 and 210) relating to description and diagnosis of hearing and balance impairments.

Accordingly, in one aspect provided are methods, combinations and pharmaceutical compositions for treating a mammal, preferably human, to prevent, reduce, or treat a hearing impairment, disorder or imbalance, preferably an ototoxin-induced hearing condition, by administering to a mammal in need of such treatment a combination or composition comprising inhibitors of target genes as disclosed herein. Some embodiments are directed to methods for treating a hearing disorder or impairment wherein the ototoxicity results from administration of a therapeutically effective amount of an ototoxic pharmaceutical drug. Typical ototoxic drugs are chemotherapeutic agents, e.g. antineoplastic agents, and antibiotics. Other possible candidates include loop-diuretics, quinines or a quinine-like compound, PDE-5 inhibitors and salicylate or salicylate-like compounds.

Ototoxicity is a dose-limiting side effect of antibiotic administration. From 4 to 15% of patients receiving 1 gram per day for greater than 1 week develop measurable hearing loss, which slowly becomes worse and can lead to complete permanent deafness if treatment continues. Ototoxic aminoglycoside antibiotics include but are not limited to neomycin, paromomycin, ribostamycin, lividomycin, kanamycin, amikacin, tobramycin, viomycin, gentamicin, sisomicin, netilmicin, streptomycin, dibekacin, fortimicin, and dihydrostreptomycin, or combinations thereof. Particular antibiotics include neomycin B, kanamycin A, kanamycin B, gentamicin C1, gentamicin C1a, and gentamicin C2, and the like that are known to have serious toxicity, particularly ototoxicity and nephrotoxicity, which reduce the usefulness of such antimicrobial agents (see Goodman and Gilman's The Pharmacological Basis of Therapeutics, 6th ed., A. Goodman Gilman et al., eds; Macmillan Publishing Co., Inc., New York, pp. 1169-71 (1980)).

Ototoxicity is also a serious dose-limiting side-effect for anti-cancer agents. Ototoxic neoplastic agents include but are not limited to vincristine, vinblastine, cisplatin and cisplatin-like compounds and taxol and taxol-like compounds. Cisplatin-like compounds include carboplatin (Paraplatin®), tetraplatin, oxaliplatin, aroplatin and transplatin inter alia and are platinum based chemotherapeutics.

Diuretics with known ototoxic side-effect, particularly "loop" diuretics include, without being limited to, furosemide, ethacrylic acid, and mercurials.

Ototoxic quinines include but are not limited to synthetic substitutes of quinine that are typically used in the treatment of malaria. In some embodiments the hearing disorder is side-effect of inhibitors of type 5 phosphodiesterase (PDE-5), including sildenafil (Viagra®), vardenafil (Levitra®) and tadalafil (Clalis).

Salicylates, such as aspirin, are the most commonly used therapeutic drugs for their anti-inflammatory, analgesic, anti-pyretic and anti-thrombotic effects. Unfortunately, they too have ototoxic side effects. They often lead to tinnitus ("ringing in the ears") and temporary hearing loss. Moreover, if the drug is used at high doses for a prolonged time, the hearing impairment can become persistent and irreversible.

In some embodiments of the methods provided herein, the subject is a mammal suffering of infection and treated by administration of an aminoglycoside antibiotic. The methods disclosed herein improve the outcome of such treatment by reducing or preventing ototoxin-induced hearing impairment associated with the antibiotic.

The methods, combinations and pharmaceutical compositions described herein are also effective in the treatment of acoustic trauma or mechanical trauma, preferably acoustic or mechanical trauma that leads to inner ear hair cell loss. With more severe exposure, injury can proceed from a loss of adjacent supporting cells to complete disruption of the organ of Corti. Death of the sensory cell can lead to progressive Wallerian degeneration and loss of primary auditory nerve fibers. The methods, combinations and compositions provided herein are useful in treating acoustic trauma caused by a single exposure to an extremely loud sound, or following long-term exposure to everyday loud sounds above 85 decibels, for treating mechanical inner ear trauma, for example, resulting from the insertion of an electronic device into the inner ear or for preventing or minimizing the damage to inner ear hair cells associated with the operation.

Another type of hearing loss is presbycusis, which is hearing loss that gradually occurs in most individuals as they age. About 30-35 percent of adults between the ages of 65 and 75 years and 40-50 percent of people 75 and older experience hearing loss. The methods, combinations and compositions disclosed herein are useful in preventing, reducing or treating the incidence and/or severity of inner ear disorders and hearing impairments associated with presbycusis.

Acoustic Trauma

Acoustic trauma is a type of hearing loss that is caused by prolonged exposure to loud noises. Without wishing to be bound to theory, exposure to loud noise causes the hair cells on the cochlea to become less sensitive. With more severe exposure, injury can proceed from a loss of adjacent supporting cells to complete disruption of the organ of Corti. Death of the sensory cell can lead to progressive Wallerian degeneration and loss of primary auditory nerve fibers. Disclosed herein are, inter alia, combinations, pharmaceutical compositions and methods useful in attenuating hearing loss due to acoustic trauma. In certain embodiments of the methods, combinations and compositions, dsRNA molecules that target HES1, HES5, and HEY2 are used for treating or preventing acoustic trauma in a subject exposed to acoustic trauma., In certain embodiments of the methods, combinations and compositions, dsRNA molecules that target CDKN1B, NOTCH1 and HEY2 are used for treating or preventing acoustic trauma in a subject exposed to acoustic trauma.

In certain embodiments, provided herein are methods of treating a subject suffering from or at risk of an ear disorder which comprises topically administering to the canal of the subject's ear a pharmaceutical composition comprising inhibitors to target genes associated with the disorder, such as dsRNA inhibitors, in an amount effective to treat the subject, and a pharmaceutically acceptable excipient or mixtures thereof, thereby treating the subject. In certain embodiments, provided herein are methods of treating a subject suffering from or at risk of an ear disorder which comprises transtympanically administering to the canal of the subject's ear a pharmaceutical composition comprising inhibitors to target genes associated with the disorder, such as oligonucleotide inhibitors, in an amount effective to treat the subject, and a pharmaceutically acceptable excipient or mixtures thereof, thereby treating the subject. In one embodiment, the pharmaceutical composition is delivered via a posterior semicircular canalostomy. In one embodiment, the pharmaceutical composition is delivered as ear drops. In another embodiment the pharmaceutical composition is delivered by a pump.

In some embodiments, the pharmaceutical composition is applied to the ear canal when the subject's head is tilted to one side and the treated ear is facing upward. In some embodiments, the pharmaceutical composition is applied to the ear using a receptacle for eardrops, for example using a dropper of for example, 10-100 microliter per drop, or a wick.

In some embodiments an ear disorder relates to chemical-induced hearing loss; for example hearing loss induced by inter alia cisplatin and its analogs; aminoglycoside antibiotics, quinine and its analogs; salicylate and its analogs; phosphodiesterase type 5 (PDE5) inhibitors or loop-diuretics. In some embodiments the ear disorder refers to noise-induced hearing loss. In other embodiments the ear disorder is age related hearing loss.

Without being bound by theory, inhibition of HES1, HES5, HEY2, CDKN1B or NOTCH1 results in regeneration of or protection of otic hair (sensory) cells of the inner ear, optionally via an increase in Atoh1 expression. The methods, compositions and combinations as disclosed herein, are useful in treating, ameliorating or preventing any disease, disorder or injury in which promoting proliferation of supporting cells of the inner ear or of outer hair cells or of inner hair cells in the cochlea is required. In various embodiments the methods, compositions and combinations provided herein are useful in treating hearing and balance disorders, such as, without being limited to, ototoxin-induced hearing loss, hearing loss associated with Meniere's disease, and trauma-induced hearing loss, such as acoustic trauma and pressure trauma, including blasts and surgical procedures in the inner and/or middle ear.

Diseases and Disorders of the Vestibular System

In various embodiments the nucleic acid compounds and pharmaceutical compositions disclosed herein are useful for treating disorders and diseases affecting the vestibular system in which expression of HES1, HES5, and HEY2, or CDKN1B, NOTCH1 and HEY2 is detrimental, for example Meniere's Disease. The vestibular sensory system in most mammals, including humans, contributes to balance, and to a sense of spatial orientation and stability. Together with the cochlea it constitutes the labyrinth of the inner ear. The vestibular system comprises two components: the semicircular canal system, which indicate rotational movements; and the otoliths, which indicate linear accelerations.

The primary morbidity associated with Meniere's disease is the debilitating nature of vertigo and the progressive hearing loss. Current therapies have not been successful at preventing progression of neuronal degeneration and associated hearing loss. A therapeutic treatment, which would protect the neurons of the inner ear including the vestibulocochlear nerve from damage and/or induce regeneration of the vestibulocochlear nerve and thereby attenuate or prevent hearing loss in Meniere's patients would be highly desirable.

In certain aspects and embodiments, the combinations, compositions, methods, commercial packages and kits provided herein are useful in treating subjects at risk of or suffering from Meniere's disease.

In conclusion, there are no effective modes of therapy for the prevention and/or treatment of the conditions disclosed herein. Treatments that are available suffer from, inter alia, the drawbacks of severe side effects due to the lack of selective targeting and there remains a need therefore to develop novel compositions and methods of treatment for these purposes.

In various embodiments the combinations and pharmaceutical compositions provided herein are useful in treating or preventing various diseases, disorders and injury that affect the ear, such as, without being limited to, the diseases, disorders and injury that are disclosed herein below. Without being bound by theory, it is believed that the combinations/compositions disclose herein prevent death or various types of cells within the ear and/or promote differentiation of supporting cells within the inner ear into otic sensory cells.

Pharmaceutical Compositions

Provided are compositions, combinations and methods for down-regulation of expression of HES1, HES5 and HEY2, or for down-regulation of expression of CDKN1B, HEY2 and NOTCH1. In certain embodiments, the compositions, combinations and methods use small nucleic acid molecules, such as short interfering nucleic acid (siNA), interfering RNA (RNAi), short interfering RNA (siRNA), double-stranded RNA (dsRNA), micro-RNA (miRNA), and short hairpin RNA (shRNA) molecules capable of mediating down-regulation of HES1, HES5, HEY2, CDKN1B, or NOTCH1 gene expression or that mediate RNA interference against HES1, HES5, HEY2, CDKN1B, or NOTCH1 gene expression.

While it may be possible for the molecules disclosed herein to be administered as the raw chemical, it is preferable to present them as a pharmaceutical composition. Accordingly provided is a pharmaceutical composition comprising one or more of the dsRNA molecules disclosed herein or pharmacological salts thereof; and a pharmaceutically acceptable carrier. The composition may comprise a mixture of two or three different nucleic acid compounds.

Compositions, methods and kits provided herein may include one or more nucleic acid molecules (e.g., dsRNA) and methods that independently or in combination modulate (e.g., down-regulate) the expression of HES1, HES5, HEY2, CDKN1B or NOTCH1 protein and/or genes encoding HES1, HES5, HEY2, CDKN1B or NOTCH1 protein, proteins and/or genes associated with the maintenance and/or development of diseases, conditions or disorders associated with HES1, HES5, HEY2, CDKN1B or NOTCH1, particularly disorders associated with the ear. The description of the various aspects and embodiments is provided with reference to exemplary genes HES1, HES5, HEY2, CDKN1B or NOTCH1. However, the various aspects and embodiments are also directed to other related genes, such as homolog genes and transcript variants, and polymorphisms (e.g., single nucleotide polymorphism, (SNPs)) associated with certain HES1, HES5, HEY2, CDKN1B or NOTCH1 genes. As such, the various aspects and embodiments are also directed to other genes that are involved in HES1, HES5, HEY2, CDKN1B or NOTCH1 mediated pathways of signal transduction or gene expression that are involved, for example, in the maintenance or development of diseases, traits, or conditions described herein. These additional genes can be analyzed for target sites using the methods described for the HES1, HES5, HEY2, CDKN1B or NOTCH1 gene herein. Thus, the down-regulation of other genes and the effects of such modulation of the other genes can be performed, determined, and measured as described herein.

Further provided is a pharmaceutical composition comprising at least one compound of the invention covalently or non-covalently bound to one or more compounds of the invention in an amount effective to down regulate HES1, HES5, HEY2, CDKN1B, or NOTCH1 expression; and a pharmaceutically acceptable carrier. Further provided are nucleic acid compounds which are processed intracellularly by endogenous cellular complexes to produce one or more oligoribonucleotides useful in accordance with the aspects and embodiments described herein.

Further provided is a pharmaceutical composition comprising a pharmaceutically acceptable carrier and one or more of the compounds useful in methods disclosed herein in an amount effective to inhibit expression in a cell of human HES1, HES5, HEY2, CDKN1B or NOTCH1, the compound comprising a sequence which is substantially complementary to a consecutive sequence selected from a sequence in HES1 mRNA, HES5 mRNA, HEY2 mRNA, CDKN1B mRNA or NOTCH1 mRNA.

Substantially complementary refers to complementarity of greater than about 84%, to another sequence. For example in a duplex region consisting of 19 base pairs one mismatch results in 94.7% complementarity, two mismatches results in about 89.5% complementarity and 3 mismatches results in about 84.2% complementarity, rendering the duplex region substantially complementary. Accordingly substantially identical refers to identity of greater than about 84%, to another sequence.

Additionally, provided herein are methods of preventing, treating, or delaying of progression of a hearing disorder, a hearing loss, and/or a balance impairment, or of preventing the loss of otic (sensory) hair cells of the inner ear in a subject, comprising inhibiting the expression of HES1, HES5, HEY2, CDKN1B or NOTCH1 gene by at least 20%, by at least 30% by at least 40%, preferably by 50%, 60% or 70%, more preferably by 75%, 80% or 90% as compared to a control comprising contacting an mRNA transcript of the respective gene with a HES1 inhibitor, a HES5 inhibitor, a HEY2 inhibitor, a CDKN1B inhibitor or a NOTCH1 inhibitor, In various embodiments as provided herein, the inhibitor is an oligoribonucleotide compound. Compositions, combinations and methods disclosed herein inhibit/down-regulate the HES1, HES5, HEY2, CDKN1B, or NOTCH1 gene, whereby the inhibition/down-regulation is selected from the group comprising inhibition/down-regulation of gene function, inhibition/down-regulation of polypeptide and inhibition/down-regulation of mRNA expression.

In certain embodiments, compositions, combinations and methods provided herein include a double-stranded short interfering nucleic acid (siNA) compound that down-regulates expression of a HES1, HES5, HEY2, CDKN1B or NOTCH1 gene (e.g., the mRNA coding sequence for human HES1, HES5, HEY2, CDKN1B or NOTCH1 exemplified by SEQ ID NO:1, 2, 10, 7 or 11, where the nucleic acid molecule includes about 18 to about 49 base pairs.

In some embodiments, a nucleic acid disclosed herein may be used to inhibit the expression of the HES1, HES5, HEY2, CDKN1B or NOTCH1 gene or a HES1, HES5, HEY2, CDKN1B, or NOTCH1 gene family where the genes or gene family sequences share sequence homology. Such homologous sequences can be identified as is known in the art, for example using sequence alignments. Nucleic acid molecules can be designed to target such homologous sequences, for example using perfectly complementary sequences or by incorporating non-canonical base pairs, for example mismatches and/or wobble base pairs, that can provide additional target sequences. In instances where mismatches are identified, non-canonical base pairs (for example, mismatches and/or wobble bases) can be used to generate nucleic acid molecules that target more than one gene sequence. In a non-limiting example, non-canonical base pairs such as UU and CC base pairs are used to generate nucleic acid molecules that are capable of targeting sequences for differing HES1, HES5, HEY2, CDKN1B, or NOTCH1 targets that share sequence homology. As such, one advantage of using dsRNAs disclosed herein is that a single nucleic acid can be designed to include nucleic acid sequence that is complementary to the nucleotide sequence that is conserved between the homologous genes. In this approach, a single nucleic acid can be used to inhibit expression of more than one gene instead of using more than one nucleic acid molecule to target the different genes.

Nucleic acid molecules may be used to target conserved sequences corresponding to a gene family or gene families such as HES1, HES5, HEY2, CDKN1B, or NOTCH1 family genes. As such, nucleic acid molecules targeting multiple HES1, HES5, HEY2, CDKN1B, or NOTCH1 targets can provide increased therapeutic effect. In addition, nucleic acid can be used to characterize pathways of gene function in a variety of applications. For example, nucleic acid molecules can be used to inhibit the activity of target gene(s) in a pathway to determine the function of uncharacterized gene(s) in gene function analysis, mRNA function analysis, or translational analysis. The nucleic acid molecules can be used to determine potential target gene pathways involved in various diseases and conditions toward pharmaceutical development. The nucleic acid molecules can be used to understand pathways of gene expression involved in, for example ear disorders.

In various embodiments of the compositions, combinations and methods provided herein, nucleic acid compounds inhibit the HES1, HES5, HEY2, CDKN1B, or NOTCH1 polypeptide, whereby the inhibition is selected from the group comprising inhibition of function (which may be examined by an enzymatic assay or a binding assay with a known interactor of the native gene/polypeptide, inter alia), down-regulation of protein or inhibition of protein (which may be examined by Western blotting, ELISA or immuno-precipitation, inter alia) and inhibition of mRNA expression (which may be examined by Northern blotting, quantitative RT-PCR, in-situ hybridisation or microarray hybridisation, inter alia).

In certain embodiments, the compositions, combinations and methods provided herein include a nucleic acid molecule having RNAi activity against HES1, HES5, HEY2, CDKN1B, or NOTCH1 RNA, where the nucleic acid molecule includes a sequence complementary to any RNA having HES1, HES5, HEY2, CDKN1B or NOTCH1 encoding sequence, such as that sequence set forth in SEQ ID NO:1, 2, 10, 7 or 11. In another embodiment, a nucleic acid molecule may have RNAi activity against HES1, HES5, HEY2, CDKN1B, or NOTCH1 RNA, where the nucleic acid molecule includes a sequence complementary to an RNA having variant HES1, HES5, HEY2, CDKN1B or NOTCH1 encoding sequence, for example mutatations in HES1, HES5, HEY2, CDKN1B or NOTCH1 genes not shown in SEQ ID NO:1, 2, 10, 7 or 11 but known in the art to be associated with the onset and/or maintenance and/or development of any of the disorders disclosed herein, for example a SNP. Chemical modifications as described herein can be applied to any nucleic acid construct disclosed herein. In another embodiment, a nucleic acid molecule disclosed herein includes a nucleotide sequence that can interact with nucleotide sequence of a HES1, HES5, HEY2, CDKN1B or NOTCH1 gene and thereby mediate down-regulation or silencing of HES1, HES5, HEY2, CDKN1B or NOTCH1 gene expression, for example, wherein the nucleic acid molecule mediates regulation of HES1, HES5, HEY2, CDKN1B or NOTCH1 gene expression by cellular processes that modulate the chromatin structure or methylation patterns of the gene and prevent transcription of the gene.

Delivery and Formulations

The inhibitors useful in accordance with the aspects and embodiments disclosed herein (e.g. dsRNA molecules) may be delivered to the ear of a subject by direct application of a pharmaceutical composition to the outer ear; by transtympanic injection, by a pump or by ear drops. In some embodiments the pharmaceutical composition is applied to the ear canal. Delivery to the ear may also be refereed to as aural or otic delivery comprising, e.g. siRNA; a penetration enhancer and a pharmaceutically acceptable vehicle.

In various embodiments, inhibitors, e.g. nucleic acid molecules, as disclosed herein may be delivered to the target tissue by direct application of the naked molecules prepared with a carrier or a diluent.

The terms "naked nucleic acid" or "naked dsRNA" or "naked siRNA" refers to nucleic acid molecules that are free from any delivery vehicle that acts to assist, promote or facilitate entry into the cell, including viral sequences, viral particles, liposome formulations, lipofectin or precipitating agents and the like. For example, dsRNA in PBS is "naked dsRNA".

In various embodiments, inhibitors, e.g. nucleic acid molecules disclosed herein, may be delivered or administered directly with a carrier or diluent that acts to assist, promote or facilitate entry to the cell, including viral vectors, viral particles, liposome formulations, lipofectin or precipitating agents and the like.

A nucleic acid molecule may include a delivery vehicle, including liposomes, for administration to a subject, carriers and diluents and their salts, and/or can be present in pharmaceutically acceptable formulations. In some embodiments, the dsRNA molecules of disclosed herein are delivered in liposome formulations and lipofectin formulations and the like and can be prepared by methods well known to those skilled in the art. Such methods are described, for example, in U.S. Pat. Nos. 5,593,972, 5,589,466, and 5,580,859, which are herein incorporated by reference.

Delivery systems aimed specifically at the enhanced and improved delivery of siRNA into mammalian cells have been developed, (see, for example, Shen et al., FEBS Let. 2003, 539:111-114; Xia et al., Nat. Biotech. 2002, 20:1006-1010; Reich et al., Mol. Vision. 2003, 9: 210-216; Sorensen et al., J. Mol. Biol. 2003. 327: 761-766; Lewis et al., Nat. Gen. 2002, 32: 107-108 and Simeoni et al., NAR 2003, 31,11: 2717-2724). siRNA has recently been successfully used for inhibition of gene expression in primates (see for example, Tolentino et al., Retina 24(4):660).

Delivery of naked or formulated RNA molecules to the ear, optionally the inner ear, is accomplished, inter alia, by transtympanic injection or by administration of the desired compounds formulated as an ear drop. Otic compositions comprising dsRNA are disclosed in US Publication No. 20110142917, to the assignee of the present application and incorporated herein by reference in its entirety.

Polypeptides that facilitate introduction of nucleic acid into a desired subject are known in the art, e.g. such as those described in US. Application Publication No. 20070155658 (e.g., a melamine derivative such as 2,4,6-Triguanidino Traizine and 2,4,6-Tramidosarcocyl Melamine, a polyarginine polypeptide, and a polypeptide including alternating glutamine and asparagine residues).

The pharmaceutically acceptable carriers, solvents, diluents, excipients, adjuvants and vehicles as well as implant carriers generally refer to inert, non-toxic solid or liquid fillers, diluents or encapsulating material not reacting with the active ingredients of the invention and they include liposomes and microspheres. Examples of delivery systems useful in the present invention include U.S. Pat. Nos. 5,225,182; 5,169,383; 5,167,616; 4,959,217; 4,925,678; 4,487,603; 4,486,194; 4,447,233; 4,447,224; 4,439,196; and 4,475,196. Many other such implants, delivery systems, and modules are well known to those skilled in the art.

In a particular embodiment, the administration comprises transtympanic administration. In another embodiment the administration comprises topical or local administration. The compounds are administered as eardrops, ear cream, ear ointment, a solution, a foam, a mousse or any of the above in combination with a delivery device. Implants of the compounds are also useful. Liquid forms are prepared as drops or for continuous application. The liquid compositions include aqueous solutions, with and without organic co-solvents, aqueous or oil suspensions, emulsions with edible oils, as well as similar pharmaceutical vehicles. These compositions may also be injected transtympanically. Eardrops may also be referred to as otic drops or aural drops. In a preferred embodiment, the ear drops remain in the ear canal for about 30 min in order to prevent leakage of the drops out of the canal. It is thus preferable that the subject receiving the drops keep his head on the side with the treated ear facing upward to prevent leakage of the drop out of the canal.

Methods for the delivery of nucleic acid molecules are described in Akhtar et al., Trends Cell Bio., 2: 139 (1992); Delivery Strategies for Antisense Oligonucleotide Therapeutics, ed. Akhtar, (1995), Maurer et al., Mol. Membr. Biol., 16: 129-140 (1999); Hofland and Huang, Handb. Exp. Pharmacol., 137: 165-192 (1999); and Lee et al., ACS Symp. Ser., 752: 184-192 (2000); U.S. Pat. Nos. 6,395,713; 6,235,310; 5,225,182; 5,169,383; 5,167,616; 4,959217; 4,925,678; 4,487,603; and 4,486,194 and Sullivan et al., PCT WO 94/02595; PCT WO 00/03683 and PCT WO 02/08754; and U.S. Patent Application Publication No. 2003077829. These protocols can be utilized for the delivery of virtually any nucleic acid molecule. Nucleic acid molecules can be administered to cells by a variety of methods known to those of skill in the art, including, but not restricted to, encapsulation in liposomes, by iontophoresis, or by incorporation into other vehicles, such as biodegradable polymers, hydrogels, cyclodextrins (see e.g., Gonzalez et al., Bioconjugate Chem., 10: 1068-1074 (1999); Wang et al., International PCT publication Nos. WO 03/47518 and WO 03/46185), poly(lactic-co-glycolic)acid (PLGA) and PLCA microspheres (see for example U.S. Pat. No. 6,447,796 and U.S. Application Publication No. 2002130430), biodegradable nanocapsules, and bioadhesive microspheres, or by proteinaceous vectors (O'Hare and Normand, International PCT Publication No. WO 00/53722). Alternatively, the nucleic acid/vehicle combination is locally delivered by direct injection or by use of an infusion pump. Direct injection of the nucleic acid molecules of the invention, whether intravitreal, subcutaneous, transtympanic, intramuscular, or intradermal, can take place using standard needle and syringe methodologies, or by needle-free technologies such as those described in Conry et al., Clin. Cancer Res., 5: 2330-2337 (1999) and Barry et al., International PCT Publication No. WO 99/31262. The molecules of the instant invention can be used as pharmaceutical agents. Pharmaceutical agents prevent, modulate the occurrence, or treat or alleviate a symptom to some extent (preferably all of the symptoms) of a disease state in a subject. In one specific embodiment of this invention topical and transdermal formulations may be selected.

The pharmaceutical compositions and combinations disclosed herein are administered and dosed in accordance with good medical practice, taking into account the clinical condition of the individual subject, the disease to be treated, the site and method of administration, scheduling of administration, patient age, sex, body weight and other factors known to medical practitioners.

In another embodiment, the administration comprises topical or local administration such as via eardrops or ointment. In a non-limiting example, dsRNA compounds that target HES1, HES5, HEY2, CDKN1B, or NOTCH1 are useful in treating a subject suffering from damage to the ear, wherein the dsRNA compounds are delivered to the ear via topical delivery (e.g., ear drops or ointments). Nucleic acid molecules may be complexed with cationic lipids, packaged within liposomes, or otherwise delivered to target cells or tissues. The nucleic acid or nucleic acid complexes can be locally administered to relevant tissues ex vivo, or in vivo through direct dermal application, transdermal application, or injection, with or without their incorporation in biopolymers. Preferred oligonucleotides useful in generating dsRNA molecules are disclosed herein.

Delivery systems may include surface-modified liposomes containing poly (ethylene glycol) lipids (PEG-modified, or long-circulating liposomes or stealth liposomes). These formulations offer a method for increasing the accumulation of drugs in target tissues. This class of drug carriers resists opsonization and elimination by the mononuclear phagocytic system (MPS or RES), thereby enabling longer blood circulation times and enhanced tissue exposure for the encapsulated drug (Lasic et al. Chem. Rev. 1995, 95, 2601-2627; Ishiwata et al., Chem. Pharm. Bull. 1995, 43, 1005-1011).

Nucleic acid molecules may be formulated or complexed with polyethylenimine (e.g., linear or branched PEI) and/or polyethylenimine derivatives, including for example polyethyleneimine-polyethyleneglycol-N-acetylgalactosamine (PEI-PEG-GAL) or polyethyleneimine-polyethyleneglycol-tri-N-acetylgalactosamine (PEI-PEG-triGAL) derivatives, grafted PEIs such as galactose PEI, cholesterol PEI, antibody derivatized PEI, and polyethylene glycol PEI (PEG-PEI) derivatives thereof (see for example Ogris et al., 2001, AAPA Pharm Sci, 3, 1-11; Furgeson et al., 2003, Bioconjugate Chem., 14, 840-847; Kunath et al., 2002, Pharmaceutical Research, 19, 810-817; Choi et al., 2001, Bull. Korean Chem. Soc., 22, 46-52; Bettinger et al., 1999, Bioconjugate Chem., 10, 558-561; Peterson et al., 2002, Bioconjugate Chem., 13, 845-854; Erbacher et al., 1999, Journal of Gene Medicine Preprint, 1, 1-18; Godbey et al., 1999, PNAS USA, 96, 5177-5181; Godbey et al., 1999, Journal of Controlled Release, 60, 149-160; Diebold et al., 1999, Journal of Biological Chemistry, 274, 19087-19094; Thomas and Klibanov, 2002, PNAS USA, 99, 14640-14645; Sagara, U.S. Pat. No. 6,586,524 and US Patent Application Publication No. 20030077829).

Nucleic acid molecules may be complexed with membrane disruptive agents such as those described in U.S. Patent Application Publication No. 20010007666. The membrane disruptive agent or agents and the nucleic acid molecule may also be complexed with a cationic lipid or helper lipid molecule, such as those lipids described in U.S. Pat. No. 6,235,310.

Delivery systems may include, for example, aqueous and nonaqueous gels, creams, multiple emulsions, microemulsions, liposomes, ointments, aqueous and nonaqueous solutions, lotions, aerosols, hydrocarbon bases and powders, and can contain excipients such as solubilizers, permeation enhancers (e.g., fatty acids, fatty acid esters, fatty alcohols and amino acids), and hydrophilic polymers (e.g., polycarbophil and polyvinylpyrolidone). In one embodiment, the pharmaceutically acceptable carrier is a liposome or a transdermal enhancer. Non-limiting examples of liposomes which can be used with the compounds of this invention include the following: (1) CellFectin, 1:1.5 (M/M) liposome formulation of the cationic lipid N,NI,NII,NIII-tetramethyl-N,NI,NII,NIII-tetrapalmit-y-spermine and dioleoyl phosphatidylethanolamine (DOPE) (GIBCO BRL); (2) Cytofectin GSV, 2:1 (M/M) liposome formulation of a cationic lipid and DOPE (Glen Research); (3) DOTAP (N-[1-(2,3-dioleoyloxy)-N,N,N-tri-methyl-ammoniummethylsulfate) (Boehringer Manheim); and (4) Lipofectamine, 3:1 (M/M) liposome formulation of the polycationic lipid DOSPA, the neutral lipid DOPE (GIBCO BRL) and Di-Alkylated Amino Acid (DiLA2).

Delivery systems may include patches, tablets, suppositories, pessaries, gels, aqueous and nonaqueous solutions, lotions and creams, and can contain excipients such as solubilizers and enhancers (e.g., propylene glycol, bile salts and amino acids), and other vehicles (e.g., polyethylene glycol, glycerol, fatty acid esters and derivatives, and hydrophilic polymers such as hydroxypropylmethylcellulose and hyaluronic acid).

Nucleic acid molecules may include a bioconjugate, for example a nucleic acid conjugate as described in Vargeese et al., U.S. Ser. No. 10/427,160; U.S. Pat. No. 6,528,631; U.S. Pat. No. 6,335,434; U.S. Pat. No. 6,235,886; U.S. Pat. No. 6,153,737; U.S. Pat. No. 5,214,136; U.S. Pat. No. 5,138,045.

Compositions, combinations, methods and kits disclosed herein may include an expression vector that includes a nucleic acid sequence encoding at least one nucleic acid molecule disclosed herein in a manner that allows expression of the nucleic acid molecule. Methods of introducing nucleic acid molecules or one or more vectors capable of expressing the strands of dsRNA into the environment of the cell will depend on the type of cell and the make up of its environment. The nucleic acid molecule or the vector construct may be directly introduced into the cell (i.e., intracellularly); or introduced extracellularly into a cavity, interstitial space, into the circulation of an organism, introduced orally, or may be introduced by bathing an organism or a cell in a solution containing dsRNA. The cell is preferably a mammalian cell; more preferably a human cell. The nucleic acid molecule of the expression vector can include a sense region and an antisense region. The antisense region can include a sequence complementary to a RNA or DNA sequence encoding HES1, HES5, HEY2, CDKN1B, or NOTCH1, and the sense region can include a sequence complementary to the antisense region. The nucleic acid molecule can include two distinct strands having complementary sense and antisense regions. The nucleic acid molecule can include a single strand having complementary sense and antisense regions.

Nucleic acid molecules that interact with target RNA molecules and down-regulate gene encoding target RNA molecules (e.g., HES1, HES5, HEY2, CDKN1B, or NOTCH1 mRNA, SEQ ID NO:1, 2, 10, 7 or 11) may be expressed from transcription units inserted into DNA or RNA vectors. Recombinant vectors can be DNA plasmids or viral vectors. Nucleic acid molecule expressing viral vectors can be constructed based on, but not limited to, adeno-associated virus, retrovirus, adenovirus, or alphavirus. The recombinant vectors capable of expressing the nucleic acid molecules can be delivered as described herein, and persist in target cells. Alternatively, viral vectors can be used that provide for transient expression of nucleic acid molecules. Such vectors can be repeatedly administered as necessary. Once expressed, the nucleic acid molecules bind and down-regulate gene function or expression, e.g., via RNA interference (RNAi). Delivery of nucleic acid molecule expressing vectors can be systemic, such as by intravenous or intramuscular administration, by local administration, by administration to target cells ex-planted from a subject followed by reintroduction into the subject, or by any other means that would allow for introduction into the desired target cell.

Expression vectors may include a nucleic acid sequence encoding at least one nucleic acid molecule disclosed herein, in a manner which allows expression of the nucleic acid molecule. For example, the vector may contain sequence(s) encoding both strands of a nucleic acid molecule that include a duplex. The vector can also contain sequence(s) encoding a single nucleic acid molecule that is self-complementary and thus forms a nucleic acid molecule. Non-limiting examples of such expression vectors are described in Paul et al., 2002, Nature Biotechnology, 19, 505; Miyagishi and Taira, 2002, Nature Biotechnology, 19, 497; Lee et al., 2002, Nature Biotechnology, 19, 500; and Novina et al., 2002, Nature Medicine, advance online publication doi: 10.1038/nm725. Expression vectors may also be included in a mammalian (e.g., human) cell An expression vector may encode one or both strands of a nucleic acid duplex, or a single self-complementary strand that self hybridizes into a nucleic acid duplex. The nucleic acid sequences encoding nucleic acid molecules can be operably linked in a manner that allows expression of the nucleic acid molecule (see for example Paul et al., 2002, Nature Biotechnology, 19, 505; Miyagishi and Taira, 2002, Nature Biotechnology, 19, 497; Lee et al., 2002, Nature Biotechnology, 19, 500; and Novina et al., 2002, Nature Medicine, advance online publication doi:10.1038/nm725).

An expression vector may include one or more of the following: a) a transcription initiation region (e.g., eukaryotic pol I, II or III initiation region); b) a transcription termination region (e.g., eukaryotic pol I, II or III termination region); c) an intron and d) a nucleic acid sequence encoding at least one of the nucleic acid molecules, wherein said sequence is operably linked to the initiation region and the termination region in a manner that allows expression and/or delivery of the nucleic acid molecule. The vector can optionally include an open reading frame (ORF) for a protein operably linked on the 5'-side or the 3'-side of the sequence encoding the nucleic acid molecule; and/or an intron (intervening sequences).

Transcription of the nucleic acid molecule sequences can be driven from a promoter for eukaryotic RNA polymerase I (pol I), RNA polymerase II (pol II), or RNA polymerase III (pol III). Transcripts from pol II or pol III promoters are expressed at high levels in all cells; the levels of a given pol II promoter in a given cell type depends on the nature of the gene regulatory sequences (enhancers, silencers, etc.) present nearby. Prokaryotic RNA polymerase promoters are also used, providing that the prokaryotic RNA polymerase enzyme is expressed in the appropriate cells (Elroy-Stein and Moss, 1990, Proc. Natl. Acad. Sci. USA, 87, 6743-7; Gao and Huang 1993, Nucleic Acids Res., 21, 2867-72; Lieber et al., 1993, Methods Enzymol., 217, 47-66; Zhou et al., 1990, Mol. Cell. Biol., 10, 4529-37). Several investigators have demonstrated that nucleic acid molecules expressed from such promoters can function in mammalian cells (e.g. Kashani-Sabet et al., 1992, Antisense Res. Dev., 2, 3-15; Ojwang et al., 1992, Proc. Natl. Acad. Sci. USA, 89, 10802-6; Chen et al., 1992, Nucleic Acids Res., 20, 4581-9; Yu et al., 1993, Proc. Natl. Acad. Sci. USA, 90, 6340-4; L'Huillier et al., 1992, EMBO J., 11, 4411-8; Lisziewicz et al., 1993, Proc. Natl. Acad. Sci. U.S.A, 90, 8000-4; Thompson et al., 1995, Nucleic Acids Res., 23, 2259; Sullenger & Cech, 1993, Science, 262, 1566). More specifically, transcription units such as the ones derived from genes encoding U6 small nuclear (snRNA), transfer RNA (tRNA) and adenovirus VA RNA are useful in generating high concentrations of desired RNA molecules such as siNA in cells (Thompson et al., supra; Couture and Stinchcomb, 1996, supra; Noonberg et al., 1994, Nucleic Acid Res., 22, 2830; Noonberg et al., U.S. Pat. No. 5,624,803; Good et al., 1997, Gene Ther., 4, 45; Beigelman et al., International PCT Publication No. WO 96/18736). The above nucleic acid transcription units can be incorporated into a variety of vectors for introduction into mammalian cells, including but not restricted to, plasmid DNA vectors, viral DNA vectors (such as adenovirus or adeno-associated virus vectors), or viral RNA vectors (such as retroviral or alphavirus vectors) (see Couture and Stinchcomb, 1996 supra).

Nucleic acid molecule may be expressed within cells from eukaryotic promoters (e.g., Izant and Weintraub, 1985, Science, 229, 345; McGarry and Lindquist, 1986, Proc. Natl. Acad. Sci., USA 83, 399; Scanlon et al., 1991, Proc. Natl. Acad. Sci. USA, 88, 10591-5; Kashani-Sabet et al., 1992, Antisense Res. Dev., 2, 3-15; Dropulic et al., 1992, J. Virol., 66, 1432-41; Weerasinghe et al., 1991, J. Virol., 65, 5531-4; Ojwang et al., 1992, Proc. Natl. Acad. Sci. USA, 89, 10802-6; Chen et al., 1992, Nucleic Acids Res., 20, 4581-9; Sarver et al., 1990 Science, 247, 1222-1225; Thompson et al., 1995, Nucleic Acids Res., 23, 2259; Good et al., 1997, Gene Therapy, 4, 45. Those skilled in the art realize that any nucleic acid can be expressed in eukaryotic cells from the appropriate DNA/RNA vector. The activity of such nucleic acids can be augmented by their release from the primary transcript by a enzymatic nucleic acid (Draper et al., PCT WO 93/23569, and Sullivan et al., PCT WO 94/02595; Ohkawa et al., 1992, Nucleic Acids Symp. Ser., 27, 15-6; Taira et al., 1991, Nucleic Acids Res., 19, 5125-30; Ventura et al., 1993, Nucleic Acids Res., 21, 3249-55; Chowrira et al., 1994, J. Biol. Chem., 269, 25856.

A viral construct packaged into a viral particle would accomplish both efficient introduction of an expression construct into the cell and transcription of dsRNA construct encoded by the expression construct.

Methods for oral introduction include direct mixing of RNA with food of the organism, as well as engineered approaches in which a species that is used as food is engineered to express an RNA, then fed to the organism to be affected. Physical methods may be employed to introduce a nucleic acid molecule solution into the cell. Physical methods of introducing nucleic acids include injection of a solution containing the nucleic acid molecule, bombardment by particles covered by the nucleic acid molecule, soaking the cell or organism in a solution of the RNA, or electroporation of cell membranes in the presence of the nucleic acid molecule. In one embodiment provided herein is a cell comprising a nucleic acid molecule disclosed herein.

Other methods known in the art for introducing nucleic acids to cells may be used, such as chemical mediated transport, such as calcium phosphate, and the like. Thus the nucleic acid molecules may be introduced along with components that perform one or more of the following activities: enhance RNA uptake by the cell, promote annealing of the duplex strands, stabilize the annealed strands, or other-wise increase inhibition/down-regulation of the target gene.

Polymeric nanocapsules or microcapsules facilitate transport and release of the encapsulated or bound dsRNA into the cell. They include polymeric and monomeric materials, especially including polybutylcyanoacrylate. A summary of materials and fabrication methods has been published (see Kreuter, 1991). The polymeric materials which are formed from monomeric and/or oligomeric precursors in the polymerization/nanoparticle generation step, are per se known from the prior art, as are the molecular weights and molecular weight distribution of the polymeric material which a person skilled in the field of manufacturing nanoparticles may suitably select in accordance with the usual skill Nucleic acid molecules may be formulated as a microemulsion. A microemulsion is a system of water, oil and amphiphile which is a single optically isotropic and thermodynamically stable liquid solution. Typically microemulsions are prepared by first dispersing an oil in an aqueous surfactant solution and then adding a sufficient amount of a 4th component, generally an intermediate chain-length alcohol to form a transparent system.

Surfactants that may be used in the preparation of microemulsions include, but are not limited to, ionic surfactants, non-ionic surfactants, Brij 96, polyoxyethylene oleyl ethers, polyglycerol fatty acid esters, tetraglycerol monolaurate (ML310), tetraglycerol monooleate (MO310), hexaglycerol monooleate (PO310), hexaglycerol pentaoleate (PO500), decaglycerol monocaprate (MCA750), decaglycerol monooleate (MO750), decaglycerol sequioleate (SO750), decaglycerol decaoleate (DA0750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules.

Delivery formulations can include water soluble degradable crosslinked polymers that include one or more degradable crosslinking lipid moiety, one or more PEI moiety, and/or one or more mPEG (methyl ether derivative of PEG (methoxypoly (ethylene glycol)).

Dosages

The useful dosage to be administered and the particular mode of administration will vary depending upon such factors as the cell type, or for in vivo use, the age, weight and the particular subject and region thereof to be treated, the particular nucleic acid and delivery method used, the therapeutic or diagnostic use contemplated, and the form of the formulation, for example, suspension, emulsion, micelle or liposome, as will be readily apparent to those skilled in the art. Typically, dosage is administered at lower levels and increased until the desired effect is achieved.

The "therapeutically effective dose" for purposes herein is thus determined by such considerations as are known in the art. The dose must be effective to achieve improvement including but not limited to improved survival rate or more rapid recovery, or improvement or elimination of symptoms and other indicators as are selected as appropriate measures by those skilled in the art.

Suitable amounts of inhibitors, e.g. nucleic acid molecules, may be introduced and these amounts can be empirically determined using standard methods. Effective concentrations of individual nucleic acid molecule species in the environment of a cell may be about 1 femtomolar, about 50 femtomolar, 100 femtomolar, 1 picomolar, 1.5 picomolar, 2.5 picomolar, 5 picomolar, 10 picomolar, 25 picomolar, 50 picomolar, 100 picomolar, 500 picomolar, 1 nanomolar, 2.5 nanomolar, 5 nanomolar, 10 nanomolar, 25 nanomolar, 50 nanomolar, 100 nanomolar, 500 nanomolar, 1 micromolar, 2.5 micromolar, 5 micromolar, 10 micromolar, 100 micromolar or more.

In general, the active dose of nucleic acid compound for humans is in the range of from 1 ng/kg to about 20-100 milligrams per kilogram (mg/kg) body weight of the recipient per day, preferably about 0.01 mg to about 2-10 mg/kg body weight of the recipient per day, in a regimen of a single dose, a one dose per day or twice or three or more times per day for a period of 1-4 weeks or longer. A suitable dosage unit of nucleic acid molecules may be in the range of 0.001 to 0.25 milligrams per kilogram body weight of the recipient per day, or in the range of 0.01 to 20 micrograms per kilogram body weight per day, or in the range of 0.01 to 10 micrograms per kilogram body weight per day, or in the range of 0.10 to 5 micrograms per kilogram body weight per day, or in the range of 0.1 to 2.5 micrograms per kilogram body weight per day. Dosage may be from 0.01 ug to 1 g per kg of body weight (e.g., 0.1 ug, 0.25 ug, 0.5 ug, 0.75 ug, 1 ug, 2.5 ug, 5 ug, 10 ug, 25 ug, 50 ug, 100 ug, 250 ug, 500 ug, 1 mg, 2.5 mg, 5 mg, 10 mg, 25 mg, 50 mg, 100 mg, 250 mg, or 500 mg per kg of body weight).

Dosage levels of the order of from about 0.1 mg to about 140 mg per kilogram of body weight per day are useful in the treatment of the above-indicated conditions (about 0.5 mg to about 7 g per subject per day). The amount of active ingredient that can be combined with the carrier materials to produce a single dosage form varies depends upon the host treated and the particular mode of administration. Dosage unit forms generally contain between from about 1 mg to about 500 mg of an active ingredient.

It is understood that the specific dose level for any particular subject depends upon a variety of factors including the activity of the specific compound employed, the age, body weight, general health, sex, diet, time of administration, route of administration, and rate of excretion, drug combination and the severity of the particular disease undergoing therapy.

Pharmaceutical compositions that include the inhibitors, e.g. nucleic acid molecules, disclosed herein may be administered once, once daily (QD), twice a day (bid), three times a day (tid), four times a day (qid), at any interval and for any duration, or by continuous application for any duration, as is medically appropriate. The therapeutic agent may also be dosed in dosage units containing two, three, four, five, six or more sub-doses administered at appropriate intervals throughout the day. In that case, the nucleic acid molecules contained in each sub-dose may be correspondingly smaller in order to achieve the total daily dosage unit. The dosage unit can also be compounded for a single dose over several days, e.g., using a conventional sustained release formulation which provides sustained and consistent release of the dsRNA over a several day period. Sustained release formulations are well known in the art. The dosage unit may contain a corresponding multiple of the daily dose. The composition can be compounded in such a way that the sum of the multiple units of a nucleic acid together contain a sufficient dose. The combination of therapeutic agents may be adminstered prior to, during or after exposure to the insult (i.e. ototoxin, mechanical injury etc.)

Pharmaceutical Compositions, Kits, and Containers

Also provided are compositions, combinations, commercial packages, kits, containers and formulations that include an inhibitor, for example a nucleic acid molecule (e.g., an siNA molecule), as provided herein for down-regulating expression of HES1, HES5, HEY2, CDKN1B or NOTCH1 for administering or distributing the nucleic acid molecule to a patient. A kit may include at least one container and at least one label. Suitable containers include, for example, bottles, vials, syringes, and test tubes. The containers can be formed from a variety of materials such as glass, metal or plastic. The container can hold amino acid sequence(s), small molecule(s), nucleic acid sequence(s), cell population(s) and/or antibody(s) and/or any other component required for relevant laboratory, prognostic, diagnostic, prophylactic and therapeutic purposes. Indications and/or directions for such uses can be included on or with such container, as can reagents and other compositions or tools used for these purposes.

The container can alternatively hold a composition that is effective for treating, diagnosis, prognosing or prophylaxing a condition and can have a sterile access port (for example the container can be an intravenous solution bag or a vial having a stopper pierceable by a hypodermic injection needle). The active agents in the composition can be a nucleic acid molecule capable of specifically binding HES1, HES5, HEY2, CDKN1B or NOTCH1 mRNA and/or down-regulating the function of HES1, HES5, HEY2, CDKN1B or NOTCH1.

A kit may further include a second container that includes a pharmaceutically-acceptable buffer, such as phosphate-buffered saline, Ringer's solution and/or dextrose solution. It can further include other materials desirable from a commercial and user standpoint, including other buffers, diluents, filters, stirrers, needles, syringes, and/or package inserts with indications and/or instructions for use.

Federal law requires that the use of pharmaceutical compositions in the therapy of humans be approved by an agency of the Federal government. In the United States, enforcement is the responsibility of the Food and Drug Administration, which issues appropriate regulations for securing such approval, detailed in 21 U.S.C. §301-392. Similar approval is required by most foreign countries. Regulations vary from country to country, but individual procedures are well known to those in the art and the compositions, combinations and methods provided herein preferably comply accordingly.

The combinations disclosed herein can be used to treat diseases, conditions or disorders associated with expression of HES1, HES5, and HEY2, or CDKN1B, NOTCH1 and HEY2 such as disease, injury, condition or pathology in the ear, vestibular sensory system, and any other disease or conditions that are related to or will respond to the levels of expression of HES1, HES5 and HEY2, or CDKN1B, NOTCH1 and HEY2 in a cell or tissue, alone or in combination with other therapies. As such, compositions, combinations, commercial packages, kits and methods disclosed herein may include packaging a nucleic acid molecule disclosed herein that includes a label or package insert. The label may include indications for use of the nucleic acid molecules such as use for treatment or prevention of diseases, disorders, injuries and conditions of the ear or vestibular system, including, without being limited to, Meniere's disease, acoustic trauma, deafness, hearing loss, presbycusis and any other disease or condition disclosed herein. The label may include indications for use of the nucleic acid molecules such as use for treatment or prevention of attenuation of neuronal degeneration. Neuronal degeneration includes for example degeneration of the auditory nerve, (also known as the vestibulocochlear nerve or acoustic nerve and responsible for transmitting sound and equilibrium information from the inner ear to the brain); the hair cells of the inner ear that transmit information to the brain via the auditory nerve, which consists of the cochlear nerve, and the vestibular nerve, and emerges from the medulla oblongata and enters the inner skull via the internal acoustic meatus (or internal auditory meatus) in the temporal bone, along with the facial nerve. The label may include indications for use of the nucleic acid molecules such as use for treatment or prevention of any other disease or conditions that are related to or will respond to the levels of expression of HES1, HES5 and HEY2, or expression of CDKN1B, NOTCH1 and HEY2, in a cell or tissue, alone or in combination with other therapies. A label may include an indication for use in reducing and/or down-regulating expression of expression of HES1, HES5 and HEY2, or CDKN1B, NOTCH1 and HEY2. A "package insert" is used to refer to instructions customarily included in commercial packages of therapeutic products, that contain information about the indications, usage, dosage, administration, contraindications, other therapeutic products to be combined with the packaged product, and/or warnings concerning the use of such therapeutic products, etc.

Those skilled in the art will recognize that other treatments, drugs and therapies known in the art can be readily combined with the nucleic acid molecules herein (e.g. dsNA molecules) and are hence contemplated herein.

Methods of Treatment

In another aspect, the present invention relates to a method for the treatment of a subject in need of treatment for a disease or disorder associated with the abnormal expression of HES1, HES5, HEY2, CDKN1B or NOTCH1, comprising administering to the subject an amount of inhibitors which reduce or inhibit expression of HES1, HES5 and HEY2 genes, or of inhibitor that reduce or inhibit expression of CDKN1B, NOTCH1 and HEY2 genes.

In one embodiment, nucleic acid molecules may be used to down-regulate or inhibit the expression of HES1, HES5, HEY2, CDKN1B, or NOTCH1 and/or HES1, HES5, HEY2, CDKN1B, or NOTCH1 proteins arising from HES1, HES5, HEY2, CDKN1B, or NOTCH1 and/or haplotype polymorphisms that are associated with a disease or condition, (e.g., neurodegeneration). Analysis of HES1, HES5, HEY2, CDKN1B, or genes, and/or protein or RNA levels can be used to identify subjects with such polymorphisms or those subjects who are at risk of developing traits, conditions, or diseases described herein. These subjects are amenable to treatment, for example, treatment with nucleic acid molecules disclosed herein and any other composition useful in treating diseases related to HES1, HES5, HEY2, CDKN1B, or NOTCH1 gene expression. As such, analysis of HES1, HES5, HEY2, CDKN1B, or NOTCH1 gene and/or protein or RNA levels can be used to determine treatment type and the course of therapy in treating a subject. Monitoring of protein or RNA levels can be used to predict treatment outcome and to determine the efficacy of combinations and compositions that modulate the level and/or activity of certain genes and/or proteins associated with a trait, a condition, or a disease.

Provided herein are methods of inhibiting the expression target genes selected from the group consisting of a gene transcribed into mRNA set forth in any one of SEQ ID NOS:1, 2, 10, 7 or 11 by at least 40%, preferably by 50%, 60% or 70%, more preferably by 75%, 80% or 90% as compared to a control, comprising contacting an mRNA transcript of the target gene disclosed herein with a combination or a compositions provided herein.

In one embodiment the oligoribonucleotide inhibits one or more of the target genes disclosed herein, whereby the inhibition is selected from the group comprising inhibition of gene function, inhibition of polypeptide and inhibition of mRNA expression.

In one embodiment the compound inhibits the target polypeptide, whereby the inhibition is selected from the group comprising inhibition of function (which is examined by, for example, an enzymatic assay or a binding assay with a known interactor of the native gene/polypeptide, inter alia), inhibition of protein (which is examined by, for example, Western blotting, ELISA or immuno-precipitation, inter alia) and inhibition of mRNA expression (which is examined by, for example, Northern blotting, quantitative RT-PCR, in-situ hybridization or microarray hybridization, inter alia).

In one embodiment the compound is down-regulating a mammalian polypeptide, whereby the down-regulation is selected from the group comprising down-regulation of function (which is examined by, for example, an enzymatic assay or a binding assay with a known interactor of the native gene/polypeptide, inter alia), down-regulation of protein (which is examined by, for example, Western blotting, ELISA or immuno-precipitation, inter alia) and down-regulation of mRNA expression (which is examined by, for example, Northern blotting, quantitative RT-PCR, in-situ hybridization or microarray hybridization, inter alia).

In additional embodiments provided herein is a method of treating a patient suffering from a disease accompanied by an elevated level of a mammalian gene elected from the group consisting of a gene transcribed into mRNA set forth in any one of SEQ ID NOS:1, 2, 10, 7 or 11, the method comprising administering to the patient a combination or composition as disclosed herein in a therapeutically effective dose thereby treating the patient.

Methods, combinations and compositions which inhibit a mammalian gene or polypeptide as disclosed herein are discussed herein at length, and any of said molecules and/or compositions are beneficially employed in the treatment of a patient suffering from any of said conditions. Novel methods of treatment using known compounds and compositions fall within the scope of the present invention.

In various embodiments, the methods disclosed herein include administering a therapeutically effective amount of compounds which down-regulate expression of a hearing loss associated gene. By "exposure to a toxic agent" is meant that the toxic agent is made available to, or comes into contact with, a mammal. A toxic agent can be toxic to the nervous system. Exposure to a toxic agent can occur by direct administration, e.g., by ingestion or administration of a food, medicinal, or therapeutic agent, e.g., a chemotherapeutic agent, by accidental contamination, or by environmental exposure, e.g., aerial or aqueous exposure.

Further provided is a method of preventing degeneration of the auditory nerve, also known as the vestibulocochlear nerve or acoustic nerve, responsible for transmitting sound and equilibrium information from the inner ear to the brain. The hair cells of the inner ear transmit information to the brain via the auditory nerve, which consists of the cochlear nerve, and the vestibular nerve, and emerges from the medulla oblongata and enters the inner skull via the internal acoustic meatus (or internal auditory meatus) in the temporal bone, along with the facial nerve.

Further provided is a process of preparing a pharmaceutical composition, which comprises:
providing one or more double stranded molecule disclosed herein; and
admixing said molecule with a pharmaceutically acceptable carrier.

In a preferred embodiment, the molecule used in the preparation of a pharmaceutical composition is admixed with a carrier in a pharmaceutically effective dose. In a particular embodiment the compound of the present invention is conjugated to a steroid or to a lipid or to another suitable molecule e.g. to cholesterol.

The nucleic acid molecules disclosed herein are able to down-regulate the expression of HES1, HES5, HEY2, CDKN1B, or NOTCH1 in a sequence specific manner. The nucleic acid molecules may include a sense strand and an antisense strand which include contiguous nucleotides that are at least partially complementary (antisense) to a portion of HES1, HES5, HEY2, CDKN1B, or NOTCH1 mRNA.

In some embodiments, dsRNA specific for HES1, HES5, HEY2, CDKN1B or NOTCH1 can be used in conjunction with other therapeutic agents and/or dsRNA specific for other molecular targets, such as, without being limited to various proapoptotic genes.

A method for treating or preventing HES1, HES5, HEY2, CDKN1B or NOTCH1 associated disease or condition in a subject or organism may include contacting the subject or organism with a combination or a composition as provided herein under conditions suitable to down-regulate the expression of the gene in the subject or organism.

A method for treating or preventing an ear disorder in a subject or organism may include contacting the subject or organism with a combination or a composition as provided herein under conditions suitable to down-regulate the expression of the HES1, HES5, HEY2, CDKN1B or NOTCH1 gene in the subject or organism.

In preferred embodiments the subject being treated is a warm-blooded animal and, in particular, mammals including human.

The methods disclosed herein comprise administering to the subject a combination or a composition of inhibitory compounds which down-regulate expression of HES1, HES5 and HEY2 or CDKN1B, NOTCH1 and HEY2, in a therapeutically effective dose so as to thereby treat the subject.

Methods, combinations and compositions which down-regulate HES1, HES5, HEY2, CDKN1B or NOTCH1, in particular combination of a HES1 inhibitor or a pharmaceutically acceptable salt or prodrug thereof, a HES5 inhibitor or a pharmaceutically acceptable salt or prodrug thereof and a HEY2 inhibitor or a pharmaceutically acceptable salt or prodrug thereof, or combination of a CDKN1B inhibitor or a pharmaceutically acceptable salt or prodrug thereof, a NOTCH1 inhibitor or a pharmaceutically acceptable salt or prodrug thereof and a HEY2 inhibitor or a pharmaceutically acceptable salt or prodrug thereof, are discussed herein at length, and any of said combinations and/or compositions may be beneficially employed in the treatment of a subject suffering from any of said conditions. Sense strand and antisense strand oligonucleotide sequences useful in generating dsRNA are set forth herein. Preferred oligonucleotide sequences useful in the preparation of dsRNA that down-regulate expression of HES1 are set forth in SEQ ID NOS:26667-26690 and 26691-26706; of HES5 are set forth in SEQ ID NOS:26707-26724 and 26725-26732; of HEY2 are set forth in SEQ ID NOS:26779-26784 and 26785-26788; of CDKN1B are set forth in SEQ ID NOS:26867-26886 and 26887-26900 or NOTCH1 are set forth in SEQ ID NOS:26901-26910 and 26911-26912.

The methods disclosed herein comprise administering to the subject a composition or a combination as disclosed herein, of inhibitory compounds which down-regulate expression of the genes set forth in SEQ ID NOS: 1, 2, 10, 7 or 11; and in particular compositions or combinations of oligonucleotide compounds in a therapeutically effective dose so as to thereby treat the subject.

"Treatment" refers to both therapeutic treatment and prophylactic or preventative measures, wherein the object is to prevent a disorder or reduce the symptoms of a disorder, such as hearing disorder or impairment (or balance impairment), to prevent or reduce cell death associated with a hearing loss-associated disease as listed herein, to promote regeneration of otic (sensory) cells or to promote differentiation of supporting cells in the inner ear into otic (sensory) cells. Those in need of treatment include those already experiencing the disease or condition, those prone to having the disease or condition, and those in which the disease or condition is to be prevented. The compositions or combinations disclosed herein are administered before, during or subsequent to the onset of the disease or condition.

Without being bound by theory, the hearing impairment may be due to apoptotic inner ear hair cell damage or loss, wherein the damage or loss is caused by infection, mechanical injury, loud sound, aging, or, in particular, chemical-induced ototoxicity. Ototoxins include therapeutic drugs including antineoplastic agents, salicylates, quinines, and aminoglycoside antibiotics, contaminants in foods or medicinals, and environmental or industrial pollutants. Typically, treatment is performed to prevent or reduce ototoxicity, especially resulting from or expected to result from administration of therapeutic drugs. Preferably a therapeutically effective composition is given immediately after the exposure to prevent or reduce the ototoxic effect. More preferably, treatment is provided prophylactically, either by administration of the composition prior to or concomitantly with the ototoxic pharmaceutical or the exposure to the ototoxin.

Hearing impairments relevant to the present disclosure may be due to end-organ lesions involving inner ear hair cells, e.g., acoustic trauma, viral endolymphatic labyrinthitis, Meniere's disease. Hearing impairments include tinnitus, which is a perception of sound in the absence of an acoustic stimulus, and may be intermittent or continuous, wherein there is diagnosed a sensorineural loss. Hearing loss may be due to bacterial or viral infection, such as in herpes zoster oticus, purulent labyrinthitis arising from acute otitis media, purulent meningitis, Chronic otitis media, sudden deafness including that of viral origin, e.g., viral endolymphatic labyrinthitis caused by viruses including mumps, measles, influenza, chicken pox, mononucleosis and adenoviruses. The hearing loss can be congenital, such as that caused by rubella, anoxia during birth, bleeding into the inner ear due to trauma during delivery, ototoxic drugs administered to the mother, erythroblastosis fetalis, and hereditary conditions including Waardenburg's syndrome and Hurler's syndrome.

The hearing loss can be noise-induced, generally due to a noise greater than 85 decibels (db) that damages the inner ear. In a particular aspect, the hearing loss is caused by an ototoxic drug that effects the auditory portion of the inner ear, particularly inner ear hair cells. Incorporated herein by reference are chapters 196, 197, 198 and 199 of The Merck Manual of Diagnosis and Therapy, 14th Edition, (1982), Merck Sharp & Dome Research Laboratories, N.J. and corresponding chapters in the most recent 16th edition, including Chapters 207 and 210) relating to description and diagnosis of hearing and balance impairments.

In one embodiment, provided is a method for treating a mammal having or prone to a hearing (or balance) impairment or treating a mammal prophylactically in conditions where inhibition of the genes of the invention is beneficial. The method would prevent or reduce the occurrence or severity of a hearing (or balance) impairment that would result from inner ear cell injury, loss, or degeneration, in particular caused by an ototoxic agent. In some embodiments the method includes administering a therapeutically effective amount of a HES1 inhibitor, a HES5 inhibitor and a HEY2 inhibitor. In other embodiments the method includes administering a therapeutically effective amount of a CDKN1B inhibitor, a NOTCH1 inhibitor and a HEY2 inhibitor.

It is the object of the present disclosure to provide methods, combinations and compositions for treating a mammal, to prevent, reduce, or treat a hearing impairment, disorder or imbalance, optionally an ototoxin-induced hearing condition, by administering to a mammal in need of such treatment a composition or a combination as disclosed herein. In some embodiments the methods are for treating a hearing disorder or impairment wherein the ototoxicity results from administration of a therapeutically effective amount of an ototoxic pharmaceutical drug. Typical ototoxic drugs are chemotherapeutic agents, e.g. antineoplastic agents, and antibiotics. Other possible candidates include loop-diuretics, quinines or a quinine-like compound, and salicylate or salicylate-like compounds.

In some embodiments, the combinations and compositions provided herein are co-administered with an ototoxin. For example, an improved method is provided for treatment of infection of a mammal by administration of an aminoglycoside antibiotic, the improvement comprising administering a therapeutically effective amount of a composition or a combination of inhibitors (particularly dsRNAs) which down-regulate expression of HES1, HES5 and HEY2, or which down-regulate expression of CDKN1B, NOTCH1 and HEY2 to the patient in need of such treatment to reduce or prevent ototoxin-induced hearing impairment associated with the antibiotic. The compounds which down-regulate expression of HES1, HES5, HEY2, CDKN1B or NOTCH1, e.g. dsRNAs are preferably administered locally within the inner ear.

In yet another embodiment an improved method for treatment of cancer in a mammal by administration of a chemotherapeutic compound is provided, wherein the improvement comprises administering a therapeutically effective amount of a composition or combination as disclosed herein to the patient in need of such treatment to reduce or prevent ototoxin-induced hearing impairment associated with the chemotherapeutic drug. The compositions or combinations which reduce or prevent the ototoxin-induced hearing impairment, e.g. compositions and combinations comprising dsRNA molecules as disclosed herein, inter alia are preferably administered directly to the cochlea as naked dsRNAs in a vehicle such as PBS or other physiological solutions, but may alternatively be administered with a delivery vehicle as described above.

In another embodiment the methods of treatment are applied to treatment of hearing impairment resulting from the administration of a chemotherapeutic agent in order to treat its ototoxic side-effect.

In another embodiment the methods, compositions and combinations are applied to hearing impairments resulting from the administration of quinine and its synthetic substitutes, typically used in the treatment of malaria, to treat its ototoxic side-effect.

In some embodiments of combinations provided herein, combination therapy is achieved by administering two or three inhibitors (i.e. dsRNAs) each of which is formulated and administered separately, or by administering the inhibitors in a single formulation. Other combinations are also encompassed by combination therapy. For example, two inhibitors can be formulated together and administered in conjunction with a separate formulation containing a third inhibitor. While the two or more inhibitors in the combination therapy can be administered simultaneously, they need not be. For example, administration of a first inhibitor (or combination of inhibitors) can precede administration of a second inhibitor (or combination of inhibitors) by minutes, hours, days, or weeks. Thus, the two or more inhibitors can be administered within minutes of each other or within one or several hours of each other or within one or several days of each other or within several weeks of each other. In some cases even longer intervals are possible. The two or more inhibitors used in combination therapy may or may not be present within the patient's body at the same time. Combination therapy includes two or more administrations of one or more of the inhibitors used in the combination. For example, if dsRNA1 and dsRNA2 (i.e. wherein dsRNA1 targets gene 1 and dsRNA2 targets gene 2) are used in a combination, one could administer them sequentially in any combination one or more times, e.g., in the order dsRNA1-dsRNA2, dsRNA2-dsRNA1, dsRNA1-dsRNA2-dsRNA1, dsRNA2-dsRNA1-dsRNA2, dsRNA1-dsRNA1-dsRNA2, dsRNA1-dsRNA2-dsRNA2 etc.

The combinations as disclosed herein can be administered in a form of a single pharmaceutical formulation, optionally together with a pharmaceutically acceptable diluent or carrier. The individual components of such a combination referred to as inhibitors, can be administered either simultaneously, concurrently, separately or sequentially, from the same or separate pharmaceutical formulations.

In some embodiments, each inhibitor is administered by the same route, either from the same or from different pharmaceutical compositions. In other embodiments, using the same route of administration for the first inhibitor, the second inhibitor and the third inhibitor either is impossible or is not preferred. Persons skilled in the art are aware of the best modes of administration for each inhibitor, either alone or in a combination.

As used herein, the term "substantially simultaneously" with regard to administration of at least two inhibitors means that a second inhibitor is administered within a time period of no greater than about 5 minutes after administration of the first inhibitor, preferably within a time period of about 1 minute, more preferably within a time period of about 30 seconds, and most preferably, is administered simultaneously with the first inhibitor from the same or separate pharmaceutical formulations. Similarly, with regard to administration of three inhibitors, a third inhibitor may be administered within a time period of no greater than about 5 minutes after administration of the second inhibitor, preferably within a time period of about 1 minute, more preferably within a time period of about 30 seconds, and most preferably is administered simultaneously with the second inhibitor from the same or separate pharmaceutical formulations.

Hearing Regeneration

Sensory progenitor cells can develop as either hair cells or supporting cells. Ablation studies indicate that removal of a hair cell changes the fate of a surrounding cell from a supporting to a hair cell. This response suggests that hair cells generate inhibitory signals that prevent neighboring cells from developing as hair cells. This type of interaction is consistent with the effects of Notch-mediated lateral inhibition. Consistent with this hypothesis, two Notch ligands, Jag2 and delta 1 (Dll1) are rapidly upregulated in a subset of Atoh1-positive cells. The expression of these ligands leads to activation of Notch 1 and the increased transcription of two Notch pathway target genes, HES1 and HES5 in cells that will develop as supporting cells. Deletion of any of the genes in this pathway leads to an overproduction of hair cells, suggesting that Notch signalling has a role in diverting progenitor cells from the hair cell fate. The mechanism of this diversion has been examined using cells in Kolliker's organ. First, co-transfection of Kolliker's organ cells with Atoh1 and HES1 was sufficient to inhibit hair cell formation, suggesting that Atoh1 transcription is a target of HES1 in the ear. Second, transient activation of ATOH1 in patches of Kolliker's organ cells leads to activation of the Notch signalling pathway within those cells and to the inhibition of ATOH1 and hair cell fate in a subset of those cells.

Zine et al. (J Neurosci. 2001 21(13):4712-20) demonstrate that HES1 and HES5 activities are important for repressing the commitment of progenitor cells to IHCs and OHCs fates, respectively, likely by antagonizing Math1. This negative regulation is critical for the correct number of hair cells to be produced and for the establishment of the normal cochlear mosaic of a single row of IHCs and three rows of OHCs. In the vestibular system, HES1 and HES5 also act as negative regulators of hair cell differentiation within the utricle and saccule epithelia. It is possible that simultaneous down-regulation of both of HES1 and HES5 in the cochlea might be used to stimulate the replacement of lost auditory hair cells. Such studies may have a significant therapeutic value, because loss of auditory hair cells through disease, trauma, and aging is a common cause of hearing loss and/or deafness.

Details of certain indications in which the compounds disclosed herein are useful as therapeutics are described herein.

The aspects and embodiments provided herein have been described in an illustrative manner, and it is to be understood that the terminology used is intended to be in the nature of words of description rather than of limitation.

Many modifications and variations are possible in light of the above teachings. It is, therefore, to be understood that within the scope of the appended claims, the invention can be practiced otherwise than as specifically described.

Throughout this application, various publications, including United States Patents, are referenced by author and year and patents by number. The disclosures of these publications and patents and patent applications in their entireties are hereby incorporated by reference into this application in order to more fully describe the state of the art to which this invention pertains.

The present disclosure is illustrated in detail below with reference to examples, but is not to be construed as being limited thereto.

Citation of any document herein is not intended as an admission that such document is pertinent prior art, or considered material to the patentability of any claim of the present disclosure. Any statement as to content or a date of any document is based on the information available to applicant at the time of filing and does not constitute an admission as to the correctness of such a statement.

EXAMPLES

Without further elaboration, it is believed that one skilled in the art can, using the preceding description, utilize the present invention to its fullest extent. The following preferred specific embodiments are, therefore, to be construed as merely illustrative, and not limitative of the claimed invention in any way.

Standard molecular biology protocols known in the art not specifically described herein are generally followed essentially as in Sambrook et al., *Molecular cloning: A laboratory manual*, Cold Springs Harbor Laboratory, New-York (1989, 1992), and in Ausubel et al., *Current Protocols in Molecular Biology*, John Wiley and Sons, Baltimore, Md. (1988), and as in Ausubel et al., Current Protocols in Molecular Biology, John Wiley and Sons, Baltimore, Md. (1989) and as in Perbal, A Practical Guide to Molecular Cloning, John Wiley & Sons, New York (1988), and as in Watson et al., Recombinant DNA, Scientific American Books, New York and in Birren et al (eds) Genome Analysis: A Laboratory Manual Series, Vols. 1-4 Cold Spring Harbor Laboratory Press, New York (1998) and methodology as set forth in U.S. Pat. Nos. 4,666,828; 4,683,202; 4,801,531; 5,192,659 and 5,272,057 and incorporated herein by reference. Polymerase chain reaction (PCR) was carried out as in standard PCR Protocols: A Guide To Methods And Applications, Academic Press, San Diego, Calif. (1990). In situ PCR in combination with Flow Cytometry (FACS) can be used for detection of cells containing specific DNA and mRNA sequences (Testoni et al., Blood 1996, 87:3822.) Methods of performing RT-PCR are well known in the art.

Example 1

In Vitro Testing of dsRNA Molecules

About $1.5-2\times10^5$ tested cells (HeLa cells and/or 293T cells for siRNA targeting human genes and NRK52 (normal rat kidney proximal tubule cells) cells and/or NMuMG cells (mouse mammary epithelial cell line) for siRNA targeting the rat/mouse gene) were seeded per well in 6 wells plate (70-80% confluent).

24 hours later, cells were transfected with dsRNA molecules using the Lipofectamine™ 2000 reagent (Invitrogen) at final concentrations of 5 nM or 20 nM. The cells were incubated at 37° C. in a $CO_2$ incubator for 72 h.

As positive control for transfection, PTEN-Cy3 labeled dsRNA molecules were used. GFP dsRNA molecules were used as negative control for siRNA activity. At 72 h after transfection, cells were harvested and RNA was extracted from cells. Transfection efficiency was tested by fluorescent microscopy. The percent of inhibition of gene expression using specific preferred siRNA structures was determined using qPCR analysis of a target gene in cells expressing the endogenous gene.

Body Fluid/Cell Stability Assay

The modified compounds disclosed herein are tested for duplex stability in human, rat or mouse plasma or human, rat or mouse serum (to test in model system), or CSF (cerebrospinal fluid; human, mouse or rat) or human cell extract, as follows:

For example: dsRNA molecules at final concentration of 7 uM are incubated at 37° C. in 100% human serum (Sigma Cat #H4522). (siRNA stock 100 uM diluted in human serum 1:14.29 or human tissue extract from various tissue types.). Five ul (5 ul) are added to 15 ul 1.5×TBE-loading buffer at different time points (for example 0, 30 min, 1 h, 3 h, 6 h, 8 h, 10 h, 16 h and 24 h). Samples are immediately frozen in liquid nitrogen and are kept at −20° C.

Each sample is loaded onto a non-denaturing 20% acrylamide gel, prepared according to methods known in the art. The oligos are visualized with ethidium bromide under UV light.

Exonuclease Stability Assay

To study the stabilization effect of 3' non-nucleotide moieties on a nucleic acid molecule the sense strand, the antisense strand and the annealed dsRNA duplex are incubated in cytosolic extracts prepared from different cell types.

Extract: HCT116 cytosolic extract (12 mg/ml).

Extract buffer: 25 mM Hepes pH-7.3 at 37° C.; 8 mM $MgCl_2$; 150 mM NaCl with 1 mM DTT was added fresh immediately before use.

Method: 3.5 ml of test dsRNA (100 mM), were mixed with 46.5 ml contain 120 mg of HCT116 cytosolic extract. The 46.5 ml consists of 12 ml of HCT116 extract, and 34.5 ml of the extract buffer supplemented with DTT and protease inhibitors cocktail/100 (Calbiochem, setIII-539134). The final concentration of the siRNA in the incubation tube is 7 mM. The sample is incubated at 37° C., and at the indicated time point 5 ml are moved to fresh tube, mixed with 15 ml of 1×TBE-50% Glycerol loading buffer, and snap frozen in Liquid $N_2$. The final concentration of the siRNA in the loading buffer is 1.75 mM (21 ng siRNA/ml). For analyses by native PAGE and EtBr staining 50 ng are loaded per lane. For Northern analyses ing of tested siRNA are loaded per lane.

Innate Immune Response to dsRNA Molecules:

Fresh human blood (at RT) is mixed at 1:1 ratio with sterile 0.9% NaCl at RT, and gently loaded (1:2 ratio) on Ficoll (Lymphoprep, Axis-Shield cat #1114547). Samples are centrifuged at RT (22° C., 800 g) in a swinging centrifuge for 30 minutes, washed with RPMI1640 medium and centrifuged (RT, 250 g) for 10 minutes. Cells are counted and seeded at final concentration of $1.5 \times 10^6$ cell/ml in growth medium (RPMI1640+10% FBS+2 mM L-glutamine+1% Pen-Strep) and incubated for 1 hour at 37° C. before dsRNA treatment. Cells are exposed to the test dsRNAs at different concentrations using the Lipofectamine™ 2000 reagent (Invitrogen) according to manufacturer's instructions and incubated at 37° C. in a 5% $CO_2$ incubator for 24 hours.

As a positive control for IFN response, cells are treated with either poly(I:C), a synthetic analog of double strand RNA (dsRNA) which is a TLR3 ligand (InvivoGen Cat #tlrl-pic) at final concentrations of 0.25-5.0 μg/mL or to Thiazolaquinolone (CLO75), a TLR 7/8 ligand (InvivoGen Cat #tlrl-c75) at final concentrations of 0.075-2 μg/mL. Cell treated with Lipofectamine™ 2000 reagent are used as negative (reference) control for IFN response.

At about 24 hours following incubation, cells are collected and supernatant is transferred to new tubes. Samples are frozen immediately in liquid nitrogen and secretion of IL-6 and TNF-α cytokines was tested using IL-6, DuoSet ELISA kit (R&D System DY2060), and TNF-α, DuoSet ELISA kit (R&D System DY210), according to manufacturer's instructions. RNA is extracted from the cell pellets and mRNA levels of human genes IFIT1 (interferon-induced protein with tetratricopeptide repeats 1) and MX1 (myxovirus (influenza virus) resistance 1, interferon-inducible protein p78) were measured by qPCR. Measured mRNA quantities are normalized to the mRNA quantity of the reference gene peptidylprolyl isomerase A (cyclophilin A; CycloA). Induction of IFN-signaling is evaluated by comparing the quantity of mRNA from IFIT1 and MX1 genes from treated cells, relative to their quantities non-treated cells. The qPCR results are those that passed QC standards, i.e. the value of the standard curve slope was in the interval [−4, −3], $R^2>0.99$, no primer dimers. Results that do not pass the QC requirements are disqualified from analysis.

In general, the dsRNAs having specific sequences that were selected for in vitro testing were specific for human and a second species such as rat or rabbit genes. The dsRNA were tested for activity to Human (Hu), mouse (Ms), rat (Rt), chinchilla (Chn) and or guinea-pig (GP) target gene. For example, activity in chinchilla was tested by cloning the chinchilla target gene (i.e. CDKN1B) and expressing in a 293 or HeLa cell line. Similar results are obtained using siRNAs having these RNA sequences and modified as described herein.

PCT/US12/49616 discloses chemically modified dsRNA nucleic acid molecules, and is incorporated herein by reference in its entirety.

Example 2

Generation of Sequences for Active dsRNA Molecules to the Target Genes and Production of the siRNAs Using proprietary algorithms and the known sequence of the mRNA of the target genes disclosed herein, the sequences of many potential dsRNA, i.e. siRNAs were generated.

Specifically, SEQ ID NOS:23-381 provide human 19 mer oligonucleotides; SEQ ID NOS:382-693 provide best 19-mer human-cross species oligonucleotides; SEQ ID NOS:694-1367 provide human 18 mer oligonucleotides; and SEQ ID NO:16-1495 provide best 18-mer human-cross species oligonucleotides useful in generating dsRNA to down-regulate HES1 expression; Table I includes certain preferred 19 mer oligonucleotides based on Structure A1, set forth in SEQ ID NOS: 26,667-26,690 and based on Structure A2, set forth in SEQ ID NOS:26,691-26,706 useful in generating dsRNA to down-regulate HES1 expression.

SEQ ID NOS:1496-1759 provide human 19 mer oligonucleotides; SEQ ID NOS:1760-2029 provide best 19-mer human-cross species oligonucleotides; SEQ ID NOS:2030-2575 provide human 18 mer oligonucleotides; and SEQ ID NOS:2576-2703 provide best 18-mer human-cross species oligonucleotides useful in generating dsRNA to down-regulate HES5 expression; Table II includes certain preferred 19 mer oligonucleotides based on Structure A1, set forth in SEQ ID NOS: 26,707-26,724 and based on Structure A2, set forth in SEQ ID NOS:26,725-26,732 useful in generating dsRNA to down-regulate HES5 expression.

SEQ ID NOS:13004-14077 provide human 19 mer oligonucleotides; SEQ ID NOS:14078-14801 provide best 19-mer human-cross species oligonucleotides; SEQ ID NOS:14802-16389 provide best human 18 mer oligonucleotides; and SEQ ID NOS:16390-16621 provide best 18-mer human-cross species oligonucleotides useful in generating dsRNA to down-regulate HEY2 expression; Table III includes certain preferred 19 mer oligonucleotides based on Structure A1, set forth in SEQ ID NOS: 26,779-26,784 and based on Structure A2, set forth in SEQ ID NOS:26,785-26,788 useful in generating dsRNA to down-regulate HEY2 expression.

SEQ ID NOS:7444-8185 provide human 19 mer oligonucleotides; SEQ ID NOS:8186-9007 provide best human-cross species oligonucleotides; SEQ ID NOS:9008-10233 provide human 18 mer oligonucleotides; and SEQ ID NOS: 10234-10533 provide best 18-mer human-cross species oligonucleotides useful in generating dsRNA to down-regulate CDKN1B expression; Table IV includes certain preferred 19 mer oligonucleotides based on Structure A1, set forth in SEQ ID NOS:26,867-26,886 and based on Structure A2, set forth in SEQ ID NOS:26,887-26,900 useful in generating dsRNA to down-regulate CDKN1B expression.

SEQ ID NOS:16622-18469 provide human 19 mer oligonucleotides; SEQ ID NOS:18470-18643 provide best human-cross species oligonucleotides; SEQ ID NOS:18644-26211 provide human 18 mer oligonucleotides; and SEQ ID NOS:26212-26666 provide best 18-mer human-cross species oligonucleotides useful in generating dsRNA to down-regulate NOTCH1 expression; Table V includes certain preferred 19 mer oligonucleotides based on Structure A1, set forth in SEQ ID NOS:26,901-26,910 and based on Structure A2, set forth in SEQ ID NOS: 26,911-26,912 useful in generating dsRNA to down-regulate NOTCH1 expression.

The oligonucleotide sequences prioritized based on their score in the proprietary algorithm as the best predicted sequences for targeting the human gene expression.

"18+1" refers to a molecule that is 19 nucleotides in length and includes a mismatch to the mRNA target at position 1 of the antisense strand, according to Structure A2. In preferred embodiments the sense strand is fully complementary to the antisense strand. In some embodiments the sense strand is mismatched to the antisense strand in 1, 2, or 3 positions.

Example 3

On-Target and Off-Target Testing of Double Stranded RNA Molecules

The psiCHECK™ system enables evaluation of the guide strand (GS) (antisense) and the passenger strand (PS) (sense strand) to elicit targeted (on-target) and off-targeted effects, by monitoring the changes in expression levels of their target sequences. Four psiCHECK™-2-based (Promega) constructs were prepared for the evaluation of target activity and potential off-target activity of each test molecule GS and PS strands. In each of the constructs one copy or three copies of either the full target or the seed-target sequence, of test molecule PS or GS, was cloned into the multiple cloning site located downstream of the Renilla luciferase translational stop codon in the 3'-UTR region.

Example 4

The Effect of Combination Treatment on Carboplatin-Induced Hair Cell Death in the Cochlea of Chinchilla Eight Chinchillas are pre-treated by direct administration of a composition or a combination of HES1 dsRNA, HES5 dsRNA and HEY2 dsRNA, in saline or by a composition or a combination of CDKN1B dsRNA, NOTCH1 dsRNA and HEY2 dsRNA in saline (to the left ear of each animal. Saline is administered to the right ear of each animal as placebo. Two days following the administration of the composition or the combination, the animals are treated with carboplatin (75 mg/kg iP). After sacrifice of the chinchillas (two weeks post carboplatin treatment) the % of dead cells of inner hair cells (IRC) and outer hair cells (ONC) is calculated in the left ear (composition/combination treated) and in the right ear (saline treated). Since the effect of the siRNA is similar across dose, the data is pooled from the 3 doses. As was previously shown, carboplatin preferentially damages the inner hair cells in the chinchilla at the 75 mg/kg dose while the outer hair cells remain intact. The compositions/combinations provided herein reduce ototoxin-induced (e.g. carboplatin-induced) inner hair cells loss in the cochlea.

Example 5

The Effect of Combination Treatment on Acoustic-Induced Hair Cell Death in the Cochlea of Chinchilla The activity of the compositions/combinations of the present invention in an acoustic trauma model is studied in chinchilla. A group of 7 animals undergo acoustic trauma by exposing them to an octave band of noise centered at 4 kHz for 2.5 h at 105 dB. The left ear of the noise-exposed chinchillas is pre-treated (48 h before the acoustic trauma) with a composition/combination of dsRNAs as disclosed herein, in saline; the right ear is pre-treated with vehicle (saline). The compound action potential (CAP) is a convenient and reliable electrophysiological method for measuring the neural activity transmitted from the cochlea. The CAP is recorded by placing an electrode near the base of the cochlea in order to detect the local field potential that is generated when a sound stimulus, such as click or tone burst, is abruptly turned on. The functional status of each ear is assessed at about 2.5 weeks after the acoustic trauma. Specifically, the mean threshold of the compound action potential recorded from the round window is determined 2.5 weeks after the acoustic trauma in order to determine if the thresholds in the composition/combination treated ear were lower (better) than the untreated (saline) ear. In addition, the amount of inner and outer hair cell loss is determined in the composition/combination treated and the control ear. The results indicate that the compositions/combinations provided herein, reduce acoustic trauma-induced ONC loss in the cochlea.

Example 6

The Effect of Combination Treatment on Cisplatin-Induced Hair Cell Death in the Cochlea of Rats Male Wistar Rats are tested for basal auditory brainstem response (ABR) thresholds for signals of clicks, 8, 16 and 32 kHz prior to cisplatin treatment. Following the basal auditory brainstem response testing, cisplatin is administered as an intraperitoneal infusion of 12 mg/kg over 30 minutes. Treated ears receive the dsRNA compositions/combinations disclosed herein in PBS (applied directly to the round window membrane). Control ears are treated either with non-related GFP dsRNA or PBS. The compositions/combinations are administered between 3-5 days prior to cisplatin administration in order to permit protective effect on the cochlea.

The auditory brainstem response (ABR) testing is repeated 3 days after cisplatin administration. The auditory brainstem response thresholds are compared between pre-treatment and post treatment and the shift in thresholds is measured. Higher shift in thresholds following cisplatin treatment is indicative for more severe hair cells loss in the cochlea. After the repeat of auditory brainstem response testing, animals are sacrificed and cochleae are removed and processed for scanning electron microscopy (SEM) to quantify outer hair cell (ONC) loss in the hook region (high frequency region). The % outer hair cell loss is calculated by dividing the number of missing or severely damaged cells by the total number of outer hair cells in the field of the photograph. The results indicate that compositions/combinations disclosed herein provide a protective effect to the cochlea when administered prior to ototoxin (e.g. cisplatin) administration.

Example 7

Additional Hearing Loss Models

A) Hearing Regeneration (Plasticity) Model in Guinea-Pig

Deafness is induced by systemically treating albino guinea pigs with a single is injection of kanamycin (450-500 mg/kg) followed by a single iv (jugular) injection of ethacrynic acid (EA). This pharmacological deafening eliminates bilaterally all hair cells approximately after 1-2 days and leaves the supporting cells differentiated. Therapeutic composition/combination as disclosed herein are applied to the middle ear by transtympanic injection (TT) or into the external auditory canal or eardrum by ear drops (ErD).

The efficacy of the compositions/combinations is examined as follows:
1) Cochleae/s are morphologically analyzed as wholemounts stained for myosin VIIa (hair cell marker) and phalloidin.
2) BrdU incorporation is measured as an indicator of proliferation rate of hair cells.

B) Noise Induced Acute Hearing Loss Model in Guinea Pig

Noise can cause hearing damage with temporary or permanent sensorineural hearing loss (SNHL) and tinnitus. SNHL and tinnitus can occur singular or in combination. In humans, noise induced hearing loss (NIHL) is demonstrated by a threshold shift in the pure tone audiogram, in recruitment, in pathological results of supra-threshold hearing tests and in amplitude decline of oto-acoustic emissions. Hearing damage is induced by exposure to continuous noise or impulsive noise. In addition the possibility of impulse noise traumata or explosion trauma should be taken into consideration. Exposure to impulse noise can result in a more severe lesion of the inner ear than exposure to continuous noise. Important criteria for the development of noise damage are sound pressure level (SPL), level increase velocity, exposure time, as well as individual susceptibility ("the vulnerable inner ear"). Noise exposure usually leads to an elevation of threshold which may be later resolved in part, such that the temporary component is called "temporary threshold shift" (TTS). If there isn't complete restitution in the recovery phase after TTS, this may result in permanent inner ear damage (permanent threshold shift=PTS). Very high sound intensity may lead to immediate cellular death and mechanical rupture of structures in the inner ear and PTS.

In this model, a bilateral lesion is induced with noise exposure; Guinea pigs are exposed to 117 dB SPL broadband noises for 6 hours.

In a pilot study according to this model, the compositions/combinations as disclosed herein are employed in this model with beneficial result.

Example 8

The Effect of Combination Treatment on Noise-Induced Death of Otic Sensory Cells of the Inner Ear Model system: Exposure of guinea pigs to one-octaveband noise centered at 6 kHz, at 130 dB SPL for 2 hours (Futon et al, NeuroReport 19:277-281, 2008)

Experimental Groups

Adult Hartley albino guinea pigs (age 3 months), with normal Preyer's reflex, are exposed to noise and randomized to the following groups: noise control group without treatment (n=6), noise control animals with vehicle (n=6), animals treated with the composition/combination provided herein at a dose of 1 µg (n=6); animals treated with the compositions/combinations provided herein at a dose of 5 µg (n=6); animals treated with the compositions/combinations provided herein at a dose of 10 µg (n=6); animals treated with the compositions/combinations provided herein at a dose of 50 µg (n=6); 4 groups of noise control animals with control dsRNA compound which down-regulates expression of EGFP gene (each n=6), at a dose of 1 µg, 5 µg, 10 µg and 50 µg respectively.

Treatment is performed 1 h before noise exposure and once daily for 3 days thereafter.

The following exemplary vehicles are used in this experiment: PBS, artificial perilymph solution.

The compositions/combinations as provided herein are formulated for administration in the vehicle of the experiment.

Vehicle, the compositions/combinations as provided herein or dsRNA control compound, is injected intraperitoneally or by bolus injection. All animals are sacrificed after functional evaluation with a lethal dose of anesthetic: three animals for each group at day 1 for immunolabeling and the remaining animals at day 21, of which three are further processed for scanning electron microscopy (SEM).

Noise Exposure

Acoustic trauma is induced by a continuous pure tone of 6 kHz generated by a waveform generator (for example: Generator LAG-120B, Leader Electronics Corp, Yokohama, Japan), and amplified by an audio amplifier (for example: A-207R, Pioneer Electronics, Long Beach, Calif., USA). All animals, under anesthetic, are exposed for 40 min to a 6 kHz, 120 db SPL (Sound Pressure Level) sound presented in an open field (for example: dome tweeter TW340×0, Audax, Chateau de Loir, France).

Electrophysiological Measurements of Auditory Function

Auditory brainstem responses (ARB) are measured before noise exposure and 1 h, 3 days, 7 days and 21 days after noise exposure. Animals are mildly anaesthetized and placed in a soundproof room. Three electrodes are subcutaneously inserted into the right mastoid (active), vertex (reference) and left mastoid (ground). A computer-controlled data acquisition system, for example TDT System 3 (Tucker-Davis Technologies, Alachu, Fla., USA) data acquisition system with real-time digital signal processing is used to record the ABR and to generate the auditory stimulus. Tone bursts of pure tones ranging from 2 to 24 kHz (rise/fall time, 1 ms; total duration, 10 ms; repetition rate, 20/s) is presented monoaurally in an open field. Responses are filtered (0.3-3 kHz), digitized and averaged across 500 discrete samples at each frequency-level combination.

Morphological Studies: Scanning Electron Microscopy

SEM analysis is performed, e.g. as described in Sergi B, et al. Protective properties of idebenone in noise-induced hearing loss in the guinea pig. *NeuroReport* 2006; 17:857-861. Briefly, the cochlea (n=3) of three animals for each group is perfused with 2.5% glutaraldehyde in 0.1 M phosphate buffer and post-fixed overnight and then incubated for 2 h in 2% osmium tetroxide cacodylate buffer. After microdissection, the cochlea is dehydrated with increasing concentrations of ethanol from 30 to 100% and dried in the critical point and finally coated with gold. Each specimen is viewed and photographed by means of, e.g. a Zeiss Supra 50 Field Emission SEM apparatus (Carl Zeiss Inc., Gottingen, Germany). Quantitative EM observations of the surface morphology of the organ of Corti are performed by determining the number of hair cells in 20 segments (1 mm length of basilar membrane each). A hair cell is counted as missing if the stereociliary bundle is absent or the stereocilia of the bunch are completely fused. Results of hair cell counts are expressed as the percentage of remaining hair cells in each row of inner hair cells and outer hair cells over the entire length of cochlea.

Terminal Deoxynucleotidyl Transferase Mediated dUTP Nick End Labeling Assay

The cochlea (n=3) of three animals for each group are stained by using TUNEL (terminal deoxynucleotidyl transferase-mediated dUTP nick end labeling) assay (for example, Molecular Probes, Inc., Carslbad, Calif., USA) as described in B Sergi et al. Protective properties of idebenone in noise-induced hearing loss in the guinea pig. *NeuroReport* (2006) 17:857-861. Briefly, the cochlea are fixed with 10% formaldehyde in 0.1 M phosphate-buffered saline (PBS), pH 7.3. After micro-dissection, surface preparations of the organ of Corti are incubated in ice-cold 70% (v/v) ethanol overnight and then in freshly prepared DNA labeling solution containing 10 µl of reaction buffer, 0.75 µl of TdT enzyme, 8.0 µl of BrdUTP and 31.25 µl of dH$_2$O for 16 h at room temperature. The tissues are then stained with Alexa Fluor 488 dye-labelled anti BrdU antibody—contained in the TUNEL assay kit (e.g., Molecular Probes Inc., Carlsbad, Calif., USA) (5 µl of antibody plus 95 µl of the Corti are double stained with propidium iodide (5 µg/ml in 10 mM PBS) for 20 min at room temperature. After rinsing in PBS, the organs of Corti are mounted on slides containing an anti-fade medium (for example, Prolong Gold, Molecular Probes, Inc.). Specimens are observed using confocal laser scanning microscopy (e.g., Leica TCS-SP2, Leica Inc., Wetzlar, Germany).

Results

The results obtained in this model indicate that the compositions/combinations provided herein: (a) attenuated noise-induced threshold shift; and (b) decreased noise-induced outer hair cell loss; provided protection against noise-induced hearing loss (NIHL).

Example 9

Therapeutic Activity of Combination Treatments in Hair Cell Regeneration in Rat Model of Ototoxic Hearing Loss Model system. 40 ul of cocktail Kanamycin (200 mg/ml) and ethacrynic acid (20 mg/ml) in PBS (pH 8) were administered by transtympanic injection. 6 groups of rats (N=5, 4 or 3) were used.

In groups 1-4, animals (Wistar and Norway Brown young adult male rats (180-220 g)) were bilaterally deafened using a combined treatment with transtympanic administration of kanamycin (KM) and ethacrynic acid (EA) cocktail, as described above. Animals in group 5 had one ear deafened as above while receiving PBS in the contralateral ear. Animals in group 6 remained undeafened. dsRNA to EGFP was used as control siRNA. Test or control siRNAs were delivered to groups 1-4 as assigned below. Groups 5 and 6 did not receive combination/control siRNA treatment.

The following groups were performed (total n=25):

Group 1 (5 rats): KM+EA. Left ear: control, Right ear: combination of HES1 dsRNA+HEY2 dsRNA+HES5 dsRNA;

Group 2 (5 rats): KM+EA. Left ear: control, Right ear: combination of HES1 dsRNA+HEY2 dsRNA+EGFP dsRNA);

Group 3 (5 rats): KM+EA. Left ear: control, Right ear: combination of NOTCH1 dsRNA+CDKN1B dsRNA+HEY2 dsRNA;

Group 4 (4 rats): KM+EA. Left ear: control, Right ear: EGFP dsRNA (control siRNA);

Group 5 (3 rats): KM+EA. Left ear: control, Right ear: vehicle;

Group 6 (3 rats): Normal control. Left ear: un-operated. Right ear: sham-operated (surgical procedure)

Details of dsRNA combinations administration: control siRNA or dsRNA combinations were administered by combined GelFoam and pump administration, as follows.

On day 4 after KM+EA administration, control siRNA or dsRNA combinations were administered to the anesthetized animals via surgical procedure of opening the bulla and applying a 3 µl volume of control siRNA or combinations of dsRNAs (see Table B for bolus dsRNA doses) on a small piece of GelFoam placed on the round window membrane. Next, the catheter of a 2006 Alzet miniosmotic pump was placed on a GelFoam in the adequate orientation and secured to the bulla. The catheter was then connected to the pump filled with 200 µl volume of control siRNA or dsRNA combinations (see Table B for pump dsRNA doses), followed by pump implantation between the 2 scapulae. Control siRNA or dsRNA combinations were applied continuously over a period of 6 weeks via 2006 Alzet miniosmotic pump.

TABLE B dsRNA doses

| Group No. | dsRNA/dsRNA combination | GelFoam dose, µg of each (in total volume of 3 µl/foam piece/ear) | Dose in a 6 weeks pump, µg of each (in total volume of 200 µl/ear) |
|---|---|---|---|
| 1 | HES1 + HEY2 + HES5 | 30 µg + 30 µg + 30 µg | 30 µg + 30 µg + 30 µg |
| 2 | HES1 + HEY2 + EGFP | 30 µg + 30 µg + 30 µg | 30 µg + 30 µg + 30 µg |
| 3 | NOTCH1 + CDKN1B + HEY2 | 30 µg + 30 µg + 30 µg | 30 µg + 30 µg + 30 µg |
| 4 | EGFP (control siRNA) | 90 µg | 90 µg |

Details of dsRNA compounds: Table C hereinbelow provides details of chemically modified dsRNA compounds that were used in this model system.

TABLE C

| dsRNA type/ Name | Sense 5 -> 3 | Antisense 5 -> 3 |
|---|---|---|
| NOTCH1/ NOTCH1_2_S2085 | zidB; rG; rC; rU; rA; rC; rA; rA; rC; rU; rG; rC; rG; rU; rG; rU2p; rG2p; rU2p; rG2p; rA2p; zc3p | mU; rC; rA; rC; rA; rC; rA2p; rC; rG; rC; rA; rG; rU; rU; rG; rU; mA; rG; rC; zc3p; zc3p |

TABLE C-continued

| dsRNA type/ Name | Sense 5 -> 3 | Antisense 5 -> 3 |
|---|---|---|
| CDKN1B/ CDKN1B_4_S2102 | zc6Np; rG; mC; rA; rA; rU; mU; rA; rG; rG; rU; rU; rU; rU; rU; mC; rC; rU; mU; rA; zc3p | 5'p; mU; rA; rA; rG; rG; rA; mA; rA; rA; rA; rC; rC; mU; rA; rA; rU; mU; rG; rC; zc3p; zc3p$ |
| HEY2/ HEY2_2_S1970 | zidB; rG; rG; rG; mU; rA; rA; rA; rG; rG; rC; mU; rA; mC; rU; rU; mU; rG; rA; rA; zc3p | mU; rU; mC; rA; rA; rA; rG2p; mU; rA; rG; mC; rC; mU; rU; mU; rA; mC; rC; mC; zc3p; zc3p |
| HES1/ HES1_36_S2086 | zidB; rC; rA; rG; rC; rG; rA; rG; rU; rG; rC; rA; rU; rG; rA; rA2p; rC2p; rG2p; rA2p; rU2p; zc3p | rA; rU; mC; rG; rU; rU; rC; rA; mU; rG; mC; rA; rC; rU; mC; rG; rC; rU; rG; zc3p; zc3p |
| EGFP/ EGFP_5_S763 | rG; mG; rC; mU; rA; mC; rG; mU; rC; mC; rA; mG; rG; mA; rG; mC; rG; mC; rA; mC; rC$ | mG; rG; mU; rG; mC; rG; mC; rU; mC; rC; mU; rG; mG; rA; mC; rG; mU; rA; mG; rC; mC$ |
| HES5/ HES5_8_S500 | rG; mG; rG; mU; rU; mC; rU; mA; rU; mG; rA; mU; rA; mU; rU; mU; rG; mU; rA | mU; rA; mC; rA; mA; rA; mU; rA; mU; rC; mA; rU; mA; rG; mA; rA; mC; rC; mC |

Table D hereinbelow provides a legend of the modified ribonucleotides/unconventional moieties utilized in the dsRNA compounds in Table C.

TABLE D

| Legend | |
|---|---|
| Code | Modification |
| Nuc | |
| c6Np | Amino modifier C6 (Glen Research) |
| iB | inverted deoxyabasic |
| mA | 2'-O-methyladenosine-3'-phosphate |
| mA$ | 2'-O-methyladenosine (no phosphate) |
| mC | 2'-O-methylcytidine-3'-phosphate |
| mC$ | 2'-O-methylcytidine (no 3'-phosphate) |
| mG | 2'-O-methylguanosine-3'-phosphate |
| mG$ | 2'-O-methylguanosine (no phosphate) |
| mU | 2'-O-methyluridine-3'-phosphate |
| mU$ | 2'-O-methyluridine (no phosphate) |
| rA | riboadenosine-3'-phosphate |
| rA$ | riboadenosine (no phosphate) |
| rA2p | riboadenosine-2'-phosphate |
| rC | ribocytidine-3'-phosphate |
| rC$ | ribocytidine (no phosphate) |
| rC2p | ribocytidine-2'-phosphate |
| rG | riboguanosine-3'-phosphate |
| rG2p | riboguanosine-2'-phosphate |
| rU | ribouridine-3'-phosphate |
| rU$ | ribouridine (no phosphate) |
| rU2p | ribouridine-2'-phosphate |
| p | 5'-phosphate |
| z | Prefix for Capping moiety |
| zc3p | C3Pi covalently attached |
| zc3p$ | C3OH covalently attached |
| $ | No terminal phosphate |

Schedule of ABR/DPOAE measurements: For all animals outlined in Table B above, damage baseline ABR/DPOAE was measured on days 3 or 4 after KM+EA administration, but prior to surgery/dsRNA combinations/dsRNA control administration on day 4. For ABR and DPOAE recording: the rat was anesthetized with a Ketamine (40 mg/kg)-Xylazine (5 mg/kg) cocktail.

In addition, all the animals were tested for ABR/DPOAE on weeks 3, 5, 7 and 9. In addition, all animals are tested for ABR/DPOAE at week 11.

Euthanasia of the animals and histology studies: all experimental animals were euthanized on week 11 after dsRNA combinations/dsRNA control administration (after ABR/DPOAE tests on week 11). Inner ear tissues were harvested and subjected to histology studies, qPCR study for target genes and Atoh1 mRNA levels; RACE analysis of the cleavage products, etc.

Figure 1B:
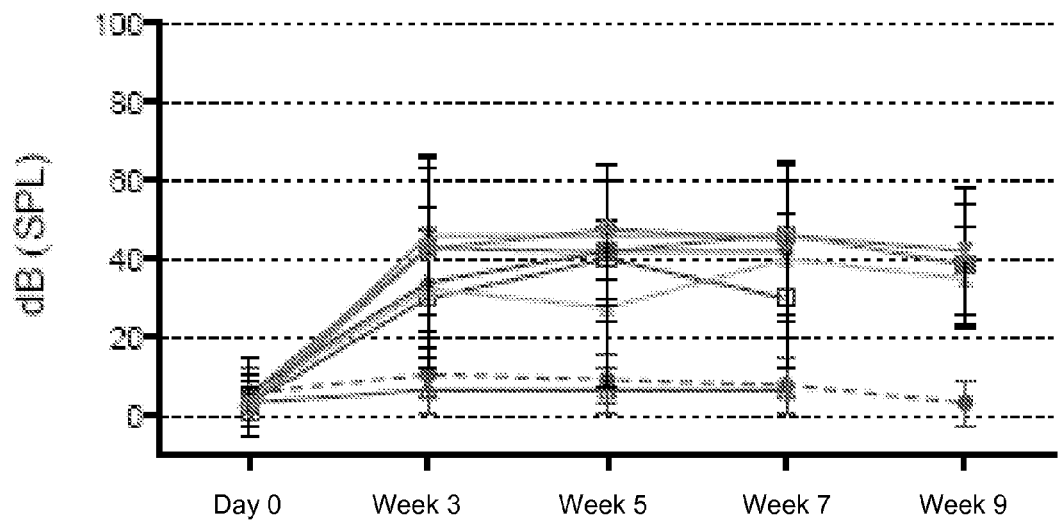
Figure 1C:
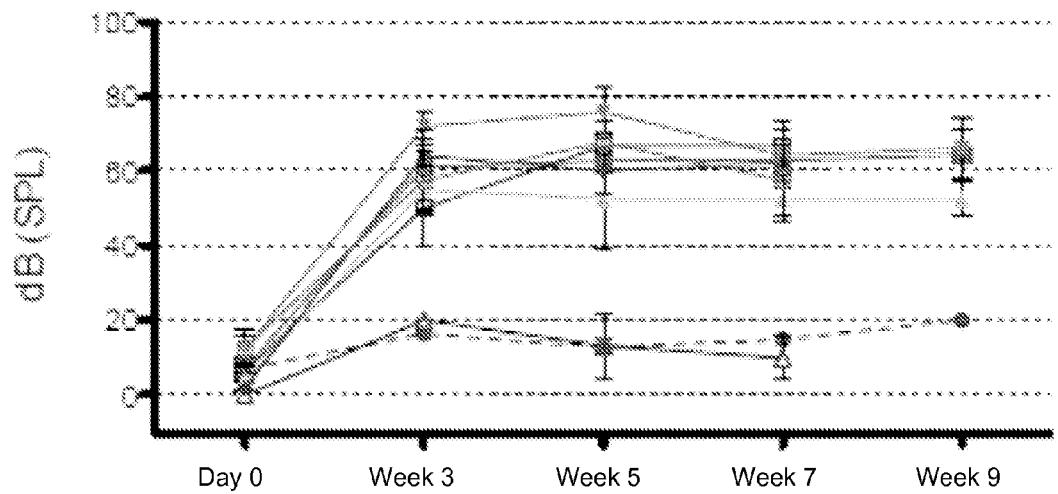
Figure 1D:
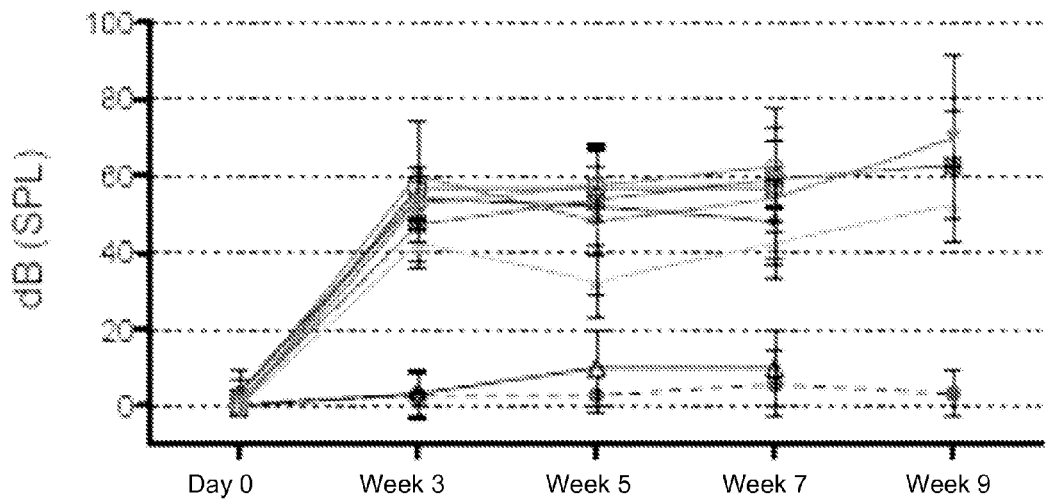
Figures 1E, 1F:
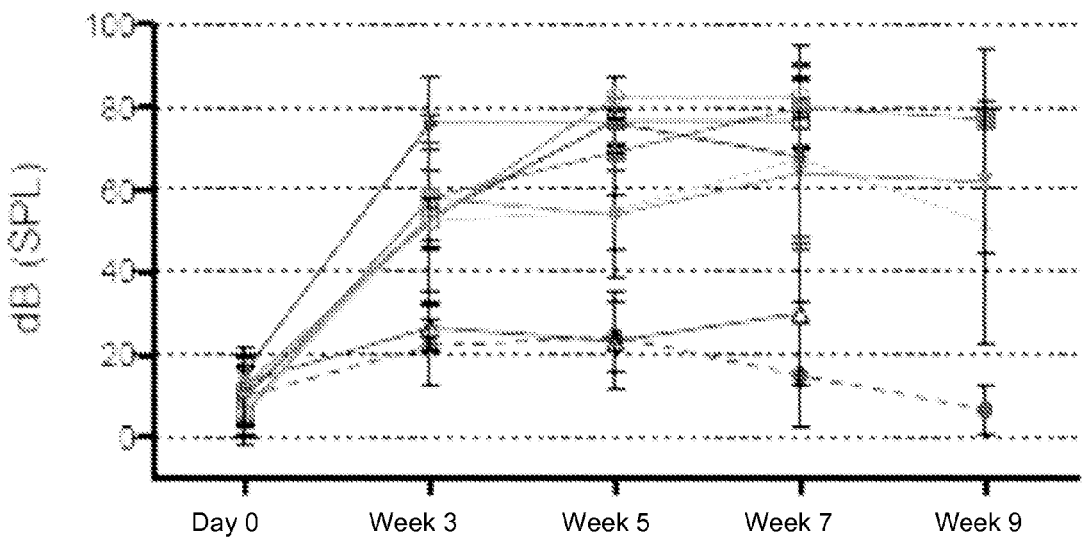
FIG. 1F provides the legend for FIGS. 1A-1E.

Results: FIGS. 1A-1E show the ABR response obtained in this study at Day 0, after 3 weeks, after 5 weeks, after 7 weeks and after 9 weeks. FIG. 1A shows the ABR response obtained in this study at Day 0, after 3 weeks, after 5 weeks, after 7 weeks and after 9 weeks for 1 KHz stimulus. FIG. 1B shows the ABR response obtained in this study at Day 0, after 3 weeks, after 5 weeks, after 7 weeks and after 9 weeks for 4 KHz stimulus. FIG. 1C shows the ABR response obtained in this study at Day 0, after 3 weeks, after 5 weeks, after 7 weeks and after 9 weeks for 8 KHz stimulus. FIG. 1D shows the ABR response obtained in this study at Day 0, after 3 weeks, after 5 weeks, after 7 weeks and after 9 weeks for 16 KHz stimulus. FIG. 1E shows the ABR response obtained in this study at Day 0, after 3 weeks, after 5 weeks, after 7 weeks and after 9 weeks for 32 KHz stimulus. FIG. 1F provides the legend for FIGS. 1A-1E.

Table E hereinbelow provides explanation of the legend for the test groups in FIGS. 1A-1E.

TABLE E

| Explanation of the legend for the test groups in the Figures | |
|---|---|
| Legend | Explanation |
| "Contralateral" | Normal control. Left ear: un-operated. Right ear: sham-operated (surgical procedure) |
| "PBS + vehicle" | Left ear: control, Right ear: PBS + Vehicle, which is artificial perilymph |
| KM + EA | KM + EA. Left ear: control, Right ear: vehicle (artificial perilymph) |

TABLE E-continued

Explanation of the legend for the test groups in the Figures

| Legend | Explanation |
|---|---|
| KM + EA + vehicle | KM + EA + vehicle (artificial perilymph). Left ear: control, Right ear: vehicle |
| KM + EA + combination of HES1 dsRNA + HES5 dsRNA + HEY2 dsRNA | KM + EA. Left ear: control, Right ear: combination of HES1 dsRNA + HES5 dsRNA + HEY2 dsRNA |
| KM + EA + combination of HES1 dsRNA + HEY2 dsRNA + EGFP dsRNA | KM + EA. Left ear: control, Right ear: combination of HES1 dsRNA + HEY2 dsRNA + EGFP dsRNA |
| KM + EA + combination of NOTCH1 dsRNA + CDKN1B dsRNA + HEY2 dsRNA | KM + EA. Left ear: control, Right ear: combination of NOTCH1 dsRNA + CDKN1B dsRNA + HEY2 dsRNA |
| KM + EA + EGFP dsRNA | KM + EA. Left ear: control, Right ear: EGFP dsRNA - (control siRNA) |

FIGS. 1A-1E show that combination of HES1 dsRNA+HES5 dsRNA+HEY2 dsRNA and combination of NOTCH1 dsRNA+CDKN1B dsRNA+HEY2 dsRNA were effective in significantly improving ABR response in this model of ototoxin-induced hearing loss.

Example 10

Treatment of Disorders with Impaired Vestibular Function

An animal model useful for testing the combinations, compositions and methods disclosed herein for improving vestibular function may be found in Schlecker C, et al., Selective atonal gene delivery improves balance function in a mouse model of vestibular disease. Gene Ther. 2011 September; 18(9):884-90, incorporated herein by reference in its entirety.

Although the above examples have illustrated particular ways of carrying out embodiments of the invention, in practice persons skilled in the art will appreciate alternative ways of carrying out embodiments of the invention, which are not shown explicitly herein. It should be understood that the present disclosure is to be considered as an exemplification of the principles of this invention and is not intended to limit the invention to the embodiments illustrated.

Those skilled in the art will recognize, or be able to ascertain using no more than routine experimentation, equivalents of the specific embodiments of the invention described herein. Such equivalents are intended to be encompassed by the following claims.

SEQUENCE LISTING (26912 sequences)

SEQ ID NO: 1 - RNA, 1475 nt, Homo sapiens
gggaucacacaggauccggagcuggugcugauaacagcggaaucccccgucuaccucucuccuugguccuggaacagcgcuacugaucaccaaguagccacaaaauauaauaaacccucagcacuugcucaguaguuuugugaaagucucaaguaaaagagacacaaacaaaaaauucuuuuucgugaagaacuccaaaaauaaaauucucuagagauaaaaaaaaaaaaaaaaggaaaaugccagcugauauaauggagaaaaauuccucguccccgguggcugcuaccccagccagugucaacacgacaccggauaaaccaaagacagcaucugagcacagaaagucaucaaagccuauuauggagaaaagacgaagagcaagaauaaaugaaagucugagccagcugaaaacacugauuuuggaugcucugaagaaagauagcucgcggcauuccaagcuggagaaggcggacauucuggaaaugacagugaagcaccuccggaaccugcagcgggcgcagaugacggcugcgcugagcacagacccaagugugcuggggaaguaccgagccggcuucagcgagugcaugaacgaggugacccgcuuccuguccacgugcgagggcguuaauaccgaggugcgcacucggcugcucggccaccuggccaacugcaugacccagaucaaugccaugaccuaccccgggcagccgcaccccgccuugcaggcgccgccaccgcccccaccgggacccggcggcccccagcacgcgccguucgcgccgccgccgccacucgugcccauccccgggggcgcggcgcccccucccggcggcgcccccugcaagcugggcagccaggcuggagaggcggcuaagguguuuggaggcuuccaggugguaccggcucccgauggccaguuugcuuuccucauucccaacggggccuucgcgcacagcggcccugucauccccgucuacaccagcaacagcggcaccuccgugggccccaacgcagugucaccuuccagcggccccucgcuuacggcggacuccauguggaggccguggcggaacugagggggcucaggccaccccuccuccuaaacuccccaacccaccucucuucccuccggacucuaaacaggaacuugaauacugggagagaagaggacuuuuuugauuaagugguuacuuuguguuuuuuuaauuucuaagaaguuacuuuuuguagagagagcuguauuaagugacugaccaugcacuauauuuguauauauuuuauauguucauauuggauugcgccuuuguauuauaaaagcucagaugacauuucguuuuuuacacgagauuucuuuuuuaugugaugccaaagauguuugaaaaugcucuuaaaauaucuuccuuuggggaaguuuauuugagaaaauauaauaaaagaaaaaaguaaaggcuuuuaaaaaaaaaaaaaaa

SEQ ID NO: 2 - RNA, 1319 nt, homo_sapiens
cgcgcuuggccuugcccgcgcccgcucgccucgucucgcccggccuccccgcgucgccucgucgccuguuccgcgccaggcauggcccccagcacuguggccguggagcugcucagccccaaagagaaaaaccgacugcggaagccggugguggagaagaugcgccgcgaccgcaucaacagcagcaucgagcagcugaagcugcugcuggagcaggaguucgcgcggcaccagcccaacuccaagcuggagaaggccgacauccuggagauggcugucagcuaccugaagcacagcaaagccuucgucgccgccgccggccccaagagccugcaccaggacuacagcgaaggcuacucguggugccugcaggaggccgugcaguuccugacgcuccacgccgccagcgacacgcagaugaagcugcuguaccacuuccagcggcccccggccgcgcccgccgcgcccgccaaggagcccaaggcgccgggcgccgcgcccccgcccgcgcucuccgccaaggccaccgccgccgccgccgccgcgcaccagcccgccugcggccucuggcggcccuggugacccggcgggaccugcgggcgcgcggcccgacgaccagagggcgagccugcuccucucgccuguagggaagcgccuucccgccgucguccgccccgggcuuggacgcgcccuucuccggaaggcucuggccccaagcuggccggcccgcaggagccccauucucagagaaugugugugcagagucccugccguuuuaggacaaucagggcccaucuucugccaagugucugaccccaugggguuguucuguguuugcauuuaagcaagugacuucugggaaguccccggccgcccgggguucuaugauauuuguagugccggggcucgcacacugcugcccccagccuguagaggacuuucuucagggcccguagcugcugggcguaccccuggcaggcgggcugugccgcgggcacauuugccuuuugugaaggccgaacucgagcuguauccucauaggaaacagugaucaccccggacgggcguccaggacccugagggccauggccaaaaggcuccugagugugccugguggucuggcuggggcucacggugggcugucuggggagggugggugccuccacuaugauccuuaaaggauuccucuguguggguggaugcgugugggcacgacuuuguacucagaaauugaacucucagucacguggaagccacgggacugcuccgaagccgccauaauaaaaucugauuguucagcccccaaaaaaaaaaaaaaa

SEQ ID NO: 3 - RNA, 993 nt, homo_sapiens
auuccacguucuuaacuguuccauuuuccguaucugcuucgggcuuccaccucauuuuuuucgcuuugcccauucuguuucagccagucgccaagaaucaugaaagucgccaguggcagcaccgccaccgccgccgcgggccccagcugcgcgcugaaggccggcaagacagcgagcggugcgggcgagguggugcgcugucugucugagcagagcguggccaucucgcgcugcgccgggggcgccggggcgcgccugccugcccugcuggacgagcagcagguaaacgugcugcucuacgacaugaacggcuguuacucacgccucaaggagcuggugcccacccugccccagaaccgcaaggugagcaagguggagauucuccagcacgucaucgacuacaucagggaccuucaguuggagcugaacucggaauccgaaguuggaacccccgggggccgagggcugccgguccgggcuccgcucagcacccucaacggcgagaucagcgcccugacggccgaggcggcaugcguuccugcggacgaucgcaucuugugucgcugaagcgccucccccagggaccggcggaccccagccauccagggggcaagaggaauuacgugcucugugggucucccccaacgcgccucgccggaucugagggagaacaagaccgaucggcggccacugcgcccuuaacugcauccagccuggggcugaggcugaggcacuggcgaggagagggcgcuccucucugcacaccuacuagucaccagagacuuuagggggugggauuccacucguguguuucuauuuuuugaaaagcagacauuuuaaaaaauggucacguuuggugcuucucagauuucugaggaaauugcuuuguauuguauauuacaaugaucaccgacugaaaauauuguuuuacaauaguucuguggggcuguuuuuuuguuauuaaacaaauaauuuagauggugaaaaaaaaaa

SEQ ID NO: 4 - RNA, 1234 nt, homo_sapiens
auuccacguucuuaacuguuccauuuuccguaucugcuucgggcuuccaccucauuuuuuucgcuuugcccauucuguuucagccagucgccaagaaucaugaaagucgccaguggcagcaccgccaccgccgccgcgggccccagcugcgcgcugaaggccggcaagacagcgagcggugcgggcgagguggugcgcugucugucugagcagagcguggccaucucgcgcugcgccgggggcgccggggcgcgccugccugcccugcuggacgagcagcagguaaacgugcugcucuacgacaugaacggcuguuacucacgccucaaggagcuggugcccacccugccccagaaccgcaaggugagcaagguggagauucuccagcacgucaucgacuacaucagggaccuucaguuggagcugaacucggaauccgaaguuggaacccccgggggccgagggcugccgguccgggcuccgcucagcacccucaacggcgagaucagcgcccugacggccgaggugagauccagauccgaccacuagaucauccuuauaccgacggggaaacggaggccagagagggcgugggcgcuugcaccacuuccgucccauccuugcggguaccuggcuaugcgggggugccuaaggagccuggaaaaagcgcucccccgucgugcuuccuggggaagggggcguucgcugcgcucggagcggcgucccuuccaacccgccggucucauuucuucucguuuucacaggcggcaugcguuccugcggacgaucgcaucuugugucgcugaagcgccucccccagggaccggcggaccccagccauccagggggcaagaggaauuacgugcucugugggucucccccaacgcgccucgccggaucugagggagaacaagaccgaucggcggccacugcgcccuuaacugcauccagccuggggcugaggcugaggcacuggcgaggagagggcgcuccucucugcacaccuacuagucaccagagacuuuagggggugggauuccacucguguguuucuauuuuuugaaaagcagacauuuuaaaaaauggucacguuuggugcuucucagauuucugaggaaauugcuuuguauuguauauuacaaugaucaccgacugaaaauauuguuuuacaauaguucuguggggcuguuuuuuuguuauuaaacaaauaauuuagauggugaaaaaaaaaaaa

SEQ ID NO: 5 - RNA, 1402 nt, homo_sapiens
ggggacgaagggaagcuccagcguguggccccggcgagugcggauaaaagccgccccgccgggcucgggcuucauucugagccgagcccggugccaagcgcagcuagcucagcaggcggcagcggcggccugagcuucagggcagccagcucccucccggucucgccuucccucgcggucagcaugaaagccuucagucccgugagguccguuaggaaaaacagccugucggaccacagccugggcaucucccggagcaaaaccccuguggacgacccgaugagccugcuauacaacaugaacgacugcuacuccaagcucaaggagcuggugcccagcaucccccagaacaagaaggugagcaagauggaaauccugcagcacgucaucgacuacaucuuggaccugcagaucgcccuggacucgcaucccacuauugucagccugcaucaccagagacccgggcagaaccaggcguccaggacgccgcugaccacccucaacacggauaucagcauccuguccuugcaggcuucugaauucccuucugaguuaaugucaaaugacagcaaagcacuguguggcugaauaagcgguguucaugauuucuuuuauucuuugcacaacaacaacaacaacaaauucacggaaucuuuuaagugcugaacuuauuuuucaaccauuucacaaggaggacaaguugaauggaccuuuuuaaaaagaaaaaaaaaauggaaggaaaacuaagaaugaucaucuucccaggguguucucuuacuuggacugugauauucguuauuuaugaaaaagacuuuuaaaugcccuuucugcaguuggaagguuuucuuuauauacuauucccaccauggggagcgaaaacguuaaaaucacaaggaauugcccaaucuaagcagacuuugccuuuuuucaaagguggagcgugaauaccagaaggauccaguauucagucacuuaaaugaagucuuuuggucagaaauuaccuuuuugacacaagccuacugaaugcuguguauauauuuauauauaaauauaucuauuugagugaaaccuugugaacucuuuaauuagaguuuucuuguauaguggcagagaugucuauuucugcauucaaaaguguaaugauguacuuauucaugcuaaacuuuuuauaaaaguuuaguuguaaacuuaacccuuuuauacaaaauaaaucaaguguguuuauugaauggugauugccugcuuuauuucagaggaccagugcuuugauuuuuauuaugcuauguuauaacugaacccaaauaaauacaaguucaaauuuauguagacuguauaagauuauaauaaaacaugucugaagucaaaaaaaaaaaaaaaaaaaaaaaaaaaaaaaaaaaaaaaa

SEQ ID NO: 6 - RNA, 1288 nt, homo_sapiens
gcuaaaggcggacuggcagggggcagggaagcucaaagaucuggggugcugccaggaaaaagcaaauucuggaaguuaaugguuuugagugauuuuuaaauccuugcuggcggagaggcccgccucuccccgguaucagcgcuuccucauucuuugaauccgcggcuccgcggucuucggcgucagaccagccggaggaagccuguuugcaauuuaagcgggcugugaacgcccagggccggcgggggcagggccgaggcgggccauuuugaauaaagaggcgugccuuccaggcaggcucuauaagugaccgccgcggcgagcgugcgcgcguugcaggucacuguagcgggacuucuuuugguuuucuuucucuuuggggcaccucuggacucacuccccagcaugaaggcgcugagcccggugcgcggcugcuacgaggcggugugcugccugucggaacgcagucuggccaucgcccggggccgagggaagggcccggcagcugaggagccgcugagcuugcuggacgacaugaaccacugcuacucccgccugcgggaacugguacccggagucccgagaggcacucagcuuagccagguggaaauccuacagcgcgucaucgacuacauucucgaccugcagguaguccuggccgagccagccccuggacccccugauggcccccaccuucccauccagacagccgagcucacuccggaacuugucaucuccaacgacaaaaggagcuuuugccacugacucggccguguccugacaccuccagaacgcaggugcuggcgcccguucugccugggaccccgggaaccucuccugccggaagccggacggcagggaugggccccaacuucgcccugcccacuugacuucaccaaaucccuuccuggagacuaaaccuggugcucaggagcgaaggacugugaacuuguggccugaagagccagagcuagcucuggccaccagcugggcgacgucacccugcucccaccccacccccaaguucuaaggucucuucagagcguggagguguggaaggaguggcugcucuccaaacuaugccaaggcggcggcagagcuggucuucuggucuccuuggagaaagguucuguugcccugauuuaugaacucuauaauagaguauauagguuuuguaccuuuuuuacaggaaggugacuuucuguaacaaugcgauguauauuaaacuuuuuauaaaaguuaacauuuugcauaauaaacgauuuuuaaacacuuguguauaugauga

SEQ ID NO: 7 - RNA, 2413 nt, homo_sapiens
cuucuucgucagccucccuuccaccgccauauugggccacuaaaaaaagggggcucgucuuuucgggguguuuuucucccccuccccuguccccgcuugcucacggcucugcgacuccgacgccggcaagguuuggagagcggcuggguucgcgggacccgcgggcuugcacccgcccagacucggacgggcuuugccacccucuccgcuugccugguccccucuccucuccgcccucccgcucgccaguccauuugaucagcggagacucggcggccgggccggggcuuccccgcagccccugcgcgcuccuagagcucgggccguggcucgucggggucugugucuuuuggcuccgagggcagucgcugggcuuccgagagggguucgggcugcguaggggcgcuuuguuuuguucgguuuuguuuuuuugagagugcgagagaggcggucgugcagacccgggagaaagaugucaaacgugcgagugucuaacgggagcccuagccuggagcggauggacgccaggcaggcggagcaccccaagcccucggccugcaggaaccucuucggcccgguggaccacgaagaguuaacccgggacuuggagaagcacugcagagacauggaagaggcgagccagcgcaaguggaauuucgauuuucagaaucacaaaccccuagagggcaaguacgaguggcaagagguggagaagggcagcuugcccgaguucuacuacagacccccgcggccccccaaaggugccugcaaggugccggcgcaggagagccaggaugucagcgggagccgcccggcggcgccuuuaauuggggcuccggcuaacucugaggacacgcauuugguggacccaaagacugauccgucggacagccagacgggguuagcggagcaaugcgcaggaauaaggaagcgaccugcaaccgacgauucuucuacucaaaacaaaagagccaacagaacagaagaaaauguuucagacgguuccccaaaugccgguucuguggagcagacgcccaagaagccuggccucagaagacgucaaacguaaacagcucgaauuaagaauauguuuccuuguuuaucagauacaucacugcuugaugaagcaaggaagauauacaugaaaauuuuaaaaauacauaucgcugacuucauggaauggacauccuguauaagcacugaaaaacaacaacacaauaacacuaaaauuuuaggcacucuuaaaugaucugccucuaaaagcguuggauguagcauuaugcaauuagguuuuuccuuauuugcuucauuguacuaccuguguauauaguuuuuaccuuuuauguagcacauaaacuuuggggaagggagggcaggguggggcugaggaacugacguggagcgggguaugaagagcuugcuuugauuuacagcaaguagauaaauauuugacuugcaugaagagaagcaauuuuggggaaggguuugaauuguuuucuuuaaagauguaaugucccuuucagagacagcugauacuucauuuaaaaaaaucacaaaaauuugaacacuggcuaaagauaauugcuauuuauuuuuacaagaaguuuauucucauuugggagaucuggugaucucccaagcuaucuaaaguuuguuagauagcugcauguggcuuuuuuaaaaaagcaacagaaaccuauccucacugcccuccccagucucucuuaaaguuggaauuuaccaguuaauuacucagcagaauggugaucacuccagguaguuuggggcaaaaauccgaggugcuugggaguuuugaauguuaagaauugaccaucugcuuuuauuaaauuuguugacaaaauuuucucauuuucuuuucacuucgggcuguguaaacacagucaaaauaauucuaaaucccucgauauuuuuaaagaucuguaaguaacuucacauuaaaaaaugaaauauuuuuuaauuuaaagcuuacucuguccauuuauccacaggaaaguguuauuuuucaaggaagguucauguagagaaaagcacacuuguaggauaagugaaauggauacuacaucuuuaaacaguauuucauugccuguguauggaaaaaccauuugaaguguaccuguguacauaacucuguaaaaacacugaaaaauuauacuaacuuauuuauguuaaaagauuuuuuuuaaucuagacaauauacaagccaaaguggcauguuuugugcauuuguaaaugcuguguuggguagaauagguuuuccccucuuuuguuaaauaauauggcuaugcuuaaaagguugcauacugagccaaguauaauuuuuuguaaugugugaaaaagaugccaauuauuguuacacauuaaguaaucaauaaagaaaacuuccauagcuauu

SEQ ID NO: 8 - RNA, 2319 nt, homo_sapiens
uuccccacucccccgcccuccccagggcccugggaaggggcucagcgugggaaaggaugguugaguuuuaaccagaggcaaagcgugagcgggaucagugugugcggaacgcaagcagccgagagcggagaggcgccgcuguaguuaacuccucccugcccgccgcgccgacccuccccaggaacccccagggagccagcaugaagcgagcucaccccgaguacagcuccucggacagcgagcuggacgagaccaucgagguggagaaggagagugcggacgagaauggaaacuugaguucggcucuagguuccauguccccaacuacaucuucccagauuuuggccagaaaaagacggagaggaauaauugagaagcgccgacgagaccggaucaauaacaguuugucugagcugagaaggcugguacccagugcuuuugagaagcagggaucugcuaagcuagaaaaagccgagauccugcagaugaccguggaucaccugaaaaugcugcauacggcaggagggaaagguuacuuugacgcgcacgcccuugcuauggacuaucggaguuugggauuucgggaaugccuggcagaaguugcgcguuaucugagcaucauugaaggacuagaugccucugacccgcuucgaguucgacugguuucgcaucucaacaacuacgcuucccagcgggaagccgcgagcggcgcccacgcgggccucggacacauucccugggggaccgucuucggacaucacccgcacaucgcgcacccgcuguugcugccccagaacggccacgggaacgcgggcaccacggccucacccacggaaccgcaccaccagggcaggcugggcucggcacauccggaggcgccugcuuugcgagcgcccccuagcggcagccucggaccggugcucccuguggucaccuccgccuccaaacugucgccgccucugcucuccucaguggccucccugucggccuuccccuucucuuucggcuccuuccacuuacugucucccaaugcacugagcccuucagcacccacgcaggcugcaaaccuuggcaagcccuauagaccuugggggacggagaucggagcuuuuuaaagaacugauguagaaugagggaggggaaaguuuaaaaucccagcugggcuggacuguugccaacaucaccuuaaagucgucaguaaaaguaaaaaggaaaaagguacacuuucagauaauuuuuuuuuuaaagacuaaagguuuguugguuuacuuuuaucuuuuuuaauguuuuuuucaucaugucauguauuagcaguuuuuaaaaacuaguuguuaaauuuuguucaagacauuaaauugaaauagugaguauaagccaacacuuugugauagguuuguacugugccuaauuuacuuuguaaaccagaaugauuccguuuuugccucaaaauuuggggaaucuuaacauuuaguauuuuuggucuguuuuucuccuuguauaguuauggucuguuuuuagaauuaauuuuccaaaccacuaugcuuaauguuaacaugauucuguuuguuaauauuuugacagauuaagguguuguauaaauaauauucuuuuggggggaggggaacuauauugaauuuuauauuucugagcaaagcguugacaaaucagaugaucagcuuuauccaagaaagaagacuaguaaauugucugccuccuauagcagaaaggugaauguacaaacuguugguggcccugaauccaucugaccagcugcugguaucugccaggacuggcaguucugauuuaguuaggagagagccgcugauagguuaggucucauuuggaguguugguggaaaggaaacugaagguaauugaauagaauacgccugcauuuaccagccccagcaacacaaagaauuuuuaaucacacggaucucaaauucacaaauguuaacauggauaagugaucauggugugcgaguggucaauugaguaguacaguggaaacuguuaaaugcauaaccuaauuuuccugggacugccauauuuucuuuuaacuggaaauuuuuaugugaguuuuccuuuuggugcauggaacugugguugccaagguauuuaaaagggcuuuccugccuccuucucuuugauuuauuuaauuugauuugggcuauaaaauaucauuuuucagguuuauucuuuuagcagguguaguuaaacgaccuccacugaacuggguuugaccucuguuguacugauguguugugacuaaauaaaaaagaaagaacaaaguaaaaaaaaaaaaaaaaaaaaaaaaaaa

SEQ ID NO: 9 - RNA, 2331 nt, homo_sapiens
uuccccacucccccgcccuccccagggcccugggaaggggcucagcgugggaaaggaugguugaguuuuaaccagaggcaaagcgugagcgggaucagugugugcggaacgcaagcagccgagagcggagaggcgccgcuguaguuaacuccucccugcccgccgcgccgacccuccccaggaacccccagggagccagcaugaagcgagcucaccccgaguacagcuccucggacagcgagcuggacgagaccaucgagguggagaaggagagugcggacgagaauggaaacuugaguucggcucuagguuccauguccccaacuacaucuucccagauuuuggccagaaaaagacggagaggaauaauugagaagcgccgacgagaccggaucaauaacaguuugucugagcugagaaggcugguacccagugcuuuugagaagcagguaauggagcaaggaucugcuaagcuagaaaaagccgagauccugcagaugaccguggaucaccugaaaaugcugcauacggcaggagggaaagguuacuuugacgcgcacgcccuugcuauggacuaucggaguuugggauuucgggaaugccuggcagaaguugcgcguuaucugagcaucauugaaggacuagaugccucugacccgcuucgaguucgacugguuucgcaucucaacaacuacgcuucccagcgggaagccgcgagcggcgcccacgcgggccucggacacauucccugggggaccgucuucggacaucacccgcacaucgcgcacccgcuguugcugccccagaacggccacgggaacgcgggcaccacggccucacccacggaaccgcaccaccagggcaggcugggcucggcacauccggaggcgccugcuuugcgagcgcccccuagcggcagccucggaccggugcucccuguggucaccuccgccuccaaacugucgccgccucugcucuccucaguggccucccugucggccuuccccuucucuuucggcuccuuccacuuacugucucccaaugcacugagcccuucagcacccacgcaggcugcaaaccuuggcaagcccuauagaccuugggggacggagaucggagcuuuuuaaagaacugauguagaaugagggaggggaaaguuuaaaaucccagcugggcuggacuguugccaacaucaccuuaaagucgucaguaaaaguaaaaaggaaaaagguacacuuucagauaauuuuuuuuuuaaagacuaaagguuuguugguuuacuuuuaucuuuuuuaauguuuuuuucaucaugucauguauuagcaguuuuuaaaaacuaguuguuaaauuuuguucaagacauuaaauugaaauagugaguauaagccaacacuuugugauagguuuguacugugccuaauuuacuuuguaaaccagaaugauuccguuuuugccucaaaauuuggggaaucuuaacauuuaguauuuuuggucuguuuuucuccuuguauaguuauggucuguuuuuagaauuaauuuuccaaaccacuaugcuuaauguuaacaugauucuguuuguuaauauuuugacagauuaagguguuguauaaauaauauucuuuuggggggaggggaacuauauugaauuuuauauuucugagcaaagcguugacaaaucagaugaucagcuuuauccaagaaagaagacuaguaaauugucugccuccuauagcagaaaggugaauguacaaacuguugguggcccugaauccaucugaccagcugcugguaucugccaggacuggcaguucugauuuaguuaggagagagccgcugauagguuaggucucauuuggaguguugguggaaaggaaacugaagguaauugaauagaauacgccugcauuuaccagccccagcaacacaaagaauuuuuaaucacacggaucucaaauucacaaauguuaacauggauaagugaucauggugugcgaguggucaauugaguaguacaguggaaacuguuaaaugcauaaccuaauuuuccugggacugccauauuuucuuuuaacuggaaauuuuuaugugaguuuuccuuuuggugcauggaacugugguugccaagguauuuaaaagggcuuuccugccuccuucucuuugauuuauuuaauuugauuugggcuauaaaauaucauuuuucagguuuauucuuuuagcagguguaguuaaacgaccuccacugaacuggguuugaccucuguuguacugauguguugugacuaaauaaaaaagaaagaacaaaguaaaaaaaaaaaaaaaaaaaaaaaaaaa

SEQ ID NO: 10 - RNA, 2672 nt, homo_sapiens
gcguggccggcgccggcucuugcggccgagcagaguugcggcgugggaaagagccgcuaggagcagaccgcgccgccgccggagccgcgccugcccaggcccggggagggaggaggcgggcgucagggugcugcgccccgcucggcguccgagcuuccggccgggcugugccccgcgcggucuucgccgggaugaagcgccccugcgaggagacgaccuccgagagcgacauggacgagaccaucgacguggggagcgagaacaauuacucggggcaaaguacuagcucugugauuagauugaauucuccaacaacaacaucucagauuauggcaagaaagaaaaggagagggauuauagagaaaaggcgucgggaucggauaaauaacaguuuaucugaguugagaagacuugugccaacugcuuuugaaaaacaaggaucugcaaaguuagaaaaagcugaaauauugcaaaugacaguggaucauuugaagaugcuucaggcaacaggggguaaaggcuacuuugacgcacacgcucuugccauggacuucaugagcauaggauuccgagagugccuaacagaaguugcgcgguaccugagcuccguggaaggccuggacuccucggauccgcugcgggugcggcuugugucucaucucagcacuugcgccacccagcgggaggcggcggccaugacauccuccauggcccaccaccaucauccgcuccacccgcaucacugggccgccgccuuccaccaccugcccgcagcccugcuccagcccaacggccuccaugccucagagucaaccccuugucgccucuccacaacuucagaagugccuccugcccacggcucugcucuccucacggccacguuugcccaugcggauucagcccuccgaaugccauccacgggcagcgucgcccccugcgugccaccucucuccaccucucucuugucccucucugccaccguccacgccgcagccgcagcagccaccgcggcugcacacagcuucccucuguccuucgcgggggcauuccccaugcuucccccaaacgcagcagcagcaguggccgcggccacagccaucagcccgcccuugucaguaucagccacguccaguccucagcagaccagcaguggaacaaacaauaaaccuuaccgacccugggggacagaaguuggagcuuuuuaaauuuuucuugaacuucuugcaauaguaacugaauguccuccauuucagagucagcuuaaaaccucugcacccugaagguagccauacagaugccgacagauccacaaaggaacaauaaagcuauuugagacacaaaccucacgaguggaaaugugguauucucuuuuuuuucucucccuuuuuuguuugguucaaggcagcucgguaacugacaucagcaacuuuugaaaacuucacacuuguuaccauuuagaaguuuccuggaaaauauauggaccguaccauccagcagugcaucaguaugucugaauuggggaaguaaaaugcccugacugaauucucuugagacuagaugggacauacauauauagagagagagugagagagucguguuucguaagugccugagcuuaggaaguuuucuucuggauauauaacauugcacaagggaagacgaguguggaggauagguuaagaaaggaaagggacagaagucuugcaauaggcugcagacauuuuaauaccaugccagagaagaguauucugcugaaaccaacagguuuuacuggucaaaaugacugcugaaaauaauuuucaaguugaaagaucuaguuuuaucuuaguuugccuucuuuguacagacaugccaagaggugacauuuagcagugcauugguauaagcaauuauuucaucaguucucagauuaacaagcauuucugcucugccugcaggcccccaggcacuuuuuuuuuuggauggcucaaaauauggugcugcuuuauauaaaccuuacauuuauauagugcaccuaugagcaguugccuaccauguguccaccagaggcuauuuaauucaugccaacuugaaaacucuccaguuuguaggaguuugguuuaauuuauucaguuucauuaggacuauuuuuauauauuuauccucuucauuuucuccuaaugaugcaacaucuauucuugucacccuuugggagaaguuacauuucuggaggugaugaagcaaggagggagcacuaggaagagaaaagcuacaauuuuuaaagcucuuugucaaguuagugauugcauuugaucccaaaacaagaugaauguaugcaaugggauguacauaaguuauuuuugcccaugccuaaacuagugcuauguaaugggguugugguuuuguuuuuuucgauuucguuuaaugacaaaauaaucucuuaauaugcugaaaucaagcacgugagaguuuuuguuuaaaagauaagagacacagcauguauuaugcacuucauuucucuacuguguggagaaagcaauaaacauuaugagaauguuaaacguuaugcaaaauuauacuuuuaaauauuuguuuugaaauuacuguaccuagucuuuuuugcauuacuuuguaaccuuuuucuaugcaagagucuuuacauaccacuaauuaaaugaaguccuuuuugacua

SEQ ID NO: 11 - RNA, 9309 nt, Homo sapiens
augccgccgcuccuggcgccccugcucugccuggcgcugcugcccgcgcucgccgcacgaggcccgcgaugcucccagcccggugagaccugccugaauggcgggaagugugaagcggccaauggcacggaggccugcgucuguggcggggccuucgugggcccgcgaugccaggaccccaacccgugccucagcacccccugcaagaacgccgggacaugccacgugguggaccgcagaggcguggcagacuaugccugcagcugugcccugggcuucucugggccccucugccugacaccccuggacaaugccugccucaccaaccccugccgcaacgggggcaccugcgaccugcucacgcugacggaguacaagugccgcugcccgcccggcuggucagggaaaucgugccagcaggcugacccgugcgccuccaaccccugcgccaacgguggccagugccugcccuucgaggccuccuacaucugccacugcccacccagcuuccauggccccaccugccggcaggaugucaacgaguguggccagaagcccgggcuuugccgccacggaggcaccugccacaacgaggucggcuccuaccgcugcgucugccgcgccacccacacuggccccaacugcgagcggcccuacgugcccugcagccccucgcccugccagaacgggggcaccugccgccccacgggcgacgucacccacgagugugccugccugccaggcuucaccggccagaacugugaggaaaauaucgacgauuguccaggaaacaacugcaagaacgggggugccuguguggacggcgugaacaccuacaacugccgcugcccgccagaguggacaggucaguacuguaccgaggauguggacgagugccagcugaugccaaaugccugccagaacggcgggaccugccacaacacccacgguggcuacaacugcgugugugucaacggcuggacuggugaggacugcagcgagaacauugaugacugugccagcgccgccugcuuccacggcgccaccugccaugaccguguggccuccuucuacugcgaguguccccauggccgcacaggucugcugugccaccucaacgacgcaugcaucagcaaccccuguaacgagggcuccaacugcgacaccaacccugucaauggcaaggccaucugcaccugccccucgggguacacgggcccggccugcagccaggacguggaugagugcucgcugggugccaaccccugcgagcaugcgggcaagugcaucaacacgcugggcuccuucgagugccagugucugcagggcuacacgggcccccgaugcgagaucgacgucaacgagugcgucucgaacccgugccagaacgacgccaccugccuggaccagauuggggaguuccagugcaucugcaugcccggcuacgagggugugcacugcgaggucaacacagacgagugugccagcagccccugccugcacaauggccgcugccuggacaagaucaaugaguuccagugcgagugccccacgggcuucacugggcaucugugccaguacgauguggacgagugugccagcacccccugcaagaauggugccaagugccuggacggacccaacacuuacaccugugugugcacggaaggguacacggggacgcacugcgagguggacaucgaugagugcgaccccgaccccugccacuacggcuccugcaaggacggcgucgccaccuucaccugccucugccgcccaggcuacacgggccaccacugcgagaccaacaucaacgagugcuccagccagcccugccgccacgggggcaccugccaggaccgcgacaacgccuaccucugcuucugccugaaggggaccacaggacccaacugcgagaucaaccuggaugacugugccagcagccccugcgacucgggcaccugucuggacaagaucgauggcuacgagugugccugugagccgggcuacacagggagcauguguaacaucaacaucgaugagugugcgggcaaccccugccacaacgggggcaccugcgaggacggcaucaauggcuucaccugccgcugccccgagggcuaccacgaccccaccugccugucugaggucaaugagugcaacagcaaccccugcguccacggggccugccgggacagccucaacggguacaagugcgacugugacccuggguggagugggaccaacugugacaucaacaacaaugagugugaauccaacccuugugucaacggcggcaccugcaaagacaugaccaguggcuacgugugcaccugccgggagggcuucagcggucccaacugccagaccaacaucaacgagugugcguccaacccaugucugaaccagggcacguguauugacgacguugccggguacaagugcaacugccugcugcccuacacaggugccacgugugagguggugcuggccccgugugcccccagccccugcagaaacggcggggagugcaggcaauccgaggacuaugagagcuucuccugugucugccccacgggcuggcaagggcagaccugugaggucgacaucaacgagugcguucugagcccgugccggcacggcgcauccugccagaacacccacggcggcuaccgcugccacugccaggccggcuacagugggcgcaacugcgagaccgacaucgacgacugccggcccaacccgugucacaacgggggcuccugcacagacggcaucaacacggccuucugcgacugccugcccggcuuccggggcacuuucugugaggaggacaucaacgagugugccagugaccccugccgcaacggggccaacugcacggacugcguggacagcuacacgugcaccugccccgcaggcuucagcgggauccacugugagaacaacacgccugacugcacagagagcuccugcuucaacgguggcaccugcguggacggcaucaacucguucaccugccuguguccacccggcuucacgggcagcuacugccagcacgaugucaaugagugcgacucacagcccugccugcauggcggcaccugucaggacggcugcggcuccuacaggugcaccugcccccagggcuacacuggccccaacugccagaaccuugugcacuggugugacuccucgcccugcaagaacggcggcaaaugcuggcagacccacacccaguaccgcugcgagugccccagcggcuggaccggccuuuacugcgacgugcccagcguguccugugagguggcugcgcagcgacaagguguugacguugcccgccugugccagcauggagggcucuguguggacgcgggcaacacgcaccacugccgcugccaggcgggcuacacaggcagcuacugugaggaccugguggacgagugcucacccagccccugccagaacggggccaccugcacggacuaccugggcggcuacuccugcaagugcguggccggcuaccacggggugaacugcucugaggagaucgacgagugccucucccaccccugccagaacgggggcaccugccucgaccuccccaacaccuacaagugcuccugcccacggggcacucagggugugcacugugagaucaacguggacgacugcaauccccccguugaccccgugucccggagccccaagugcuuuaacaacggcaccugcguggaccaggugggcggcuacagcugcaccugcccgccgggcuucgugggugagcgcugugagggggaugucaacgagugccuguccaaucccugcgacgcccguggcacccagaacugcgugcagcgcgucaaugacuuccacugcgagugccgugcuggucacaccgggcgccgcugcgaguccgucaucaauggcugcaaaggcaagcccugcaagaaugggggcaccugcgccguggccuccaacaccgcccgcggguucaucugcaagugcccugcgggcuucgagggcgccacgugugagaaugacgcucguaccugcggcagccugcgcugccucaacggcggcacaugcaucuccggcccgcgcagccccaccugccugugccugggccccuucacgggccccgaaugccaguucccggccagcagccccugccugggcggcaaccccugcuacaaccaggggaccugugagcccacauccgagagccccuucuaccguugccugugccccgccaaauucaacgggcucuugugccacauccuggacuacagcuucggggguggggccgggcgcgacauccccccgccgcugaucgaggaggcgugcgagcugcccgagugccaggaggacgcgggcaacaaggucugcagccugcagugcaacaaccacgcgugcggcugggacggcggugacugcucccucaacuucaaugaccccuggaagaacugcacgcagucucugcagugcuggaaguacuucagugacggccacugugacagccagugcaacucagccggcugccucuucgacggcuuugacugccagcgugcggaaggccagugcaacccccuguacgaccaguacugcaaggaccacuucagcgacgggcacugcgaccagggcugcaacagcgcggagugcgagugggacgggcuggacugugcggagcauguacccgagaggcuggcggccggcacgcugguggugguggugcugaugccgccggagcagcugcgcaacagcuccuuccacuuccugcgggagcucagccgcgugcugcacaccaacguggucuucaagcgugacgcacacggccagcagaugaucuuccccuacuacggccgcgaggaggagcugcgcaagcaccccaucaagcgugccgccgagggcugggccgcaccugacgcccugcugggccaggugaaggccucgcugcucccugguggcagcgagggugggcggcggcggagggagcuggaccccauggacguccgcggcuccaucgucuaccuggagauugacaaccggcagugugugcaggccuccucgcagugcuuccagagugccaccgacguggccgcauuccugggagcgcucgccucgcugggcagccucaacauccccuacaagaucgaggccgugcagagugagaccguggagccgcccccgccggcgcagcugcacuucauguacguggcggcggccgccuuugugcuucuguucuucgugggcugcggggugcugcugucccgcaagcgccggcggcagcauggccagcucugguucccugagggcuucaaagugucugaggccagcaagaagaagcggcgggagccccucggcgaggacuccgugggccucaagccccugaagaacgcuucagacggugcccucauggacgacaaccagaaugaguggggggacgaggaccuggagaccaagaaguuccgguucgaggagcccgugguucugccugaccuggacgaccagacagaccaccggcaguggacucagcagcaccuggaugccgcugaccugcgcaugucugccauggcccccacaccgccccagggugagguugacgccgacugcauggacgucaauguccgcgggccugauggcuucaccccgcucaugaucgccuccugcagcgggggcggccuggagacgggcaacagcgaggaagaggaggacgcgccggccgucaucuccgacuucaucuaccagggcgccagccugcacaaccagacagaccgcacgggcgagaccgccuugcaccuggccgcccgcuacucacgcucugaugccgccaagcgccugcuggaggccagcgcagaugccaacauccaggacaacaugggccgcaccccgcugcaugcggcugugucugccgacgcacaaggugucuuccagauccugauccggaaccgagccacagaccuggaugcccgcaugcaugauggcacgacgccacugauccuggcugcccgccuggccguggagggcaugcuggaggaccucaucaacucacacgccgacgucaacgccguagaugaccugggcaaguccgcccugcacugggccgccgccgugaacaauguggaugccgcaguugugcuccugaagaacggggcuaacaaagauaugcagaacaacagggaggagacaccccuguuucuggccgcccgggagggcagcuacgagaccgccaaggugcugcuggaccacuuugccaaccgggacaucacggaucauauggaccgccugccgcgcgacaucgcacaggagcgcaugcaucacgacaucgugaggcugcuggacgaguacaaccuggugcgcagcccgcagcugcacggagccccgcuggggggcacgcccacccugucgcccccgcucugcucgcccaacggcuaccugggcagccucaagcccggcgugcagggcaagaagguccgcaagcccagcagcaaaggccuggccuguggaagcaaggaggccaaggaccucaaggcacggaggaagaagucccaggacggcaagggcugccugcuggacagcuccggcaugcucucgcccguggacucccuggagucaccccauggcuaccugucagacguggccucgccgccacugcugcccuccccguuccagcagucuccguccgugccccucaaccaccugccugggaugcccgacacccaccugggcaucgggcaccugaacguggcggccaagcccgagauggcggcgcugggugggggcggccggcuggccuuugagacuggcccaccucgucucucccaccugccuguggccucuggcaccagcaccguccugggcuccagcagcggaggggcccugaauuucacugugggcggguccaccaguuugaauggucaaugcgaguggcugucccggcugcagagcggcauggugccgaaccaauacaacccucugcgggggaguguggcaccaggcccccugagcacacaggcccccucccugcagcauggcaugguaggcccgcugcacaguagccuugcugccagcgcccugucccagaugaugagcuaccagggccugcccagcacccggcuggccacccagccucaccuggugcagacccagcaggugcagccacaaaacuuacagaugcagcagcagaaccugcagccagcaaacauccagcagcagcaaagccugcagccgccaccaccaccaccacagccgcaccuuggcgugagcucagcagccagcggccaccugggccggagcuuccugaguggagagccgagccaggcagacgugcagccacugggccccagcagccuggcggugcacacuauucugccccaggagagccccgcccugcccacgucgcugccauccucgcuggucccacccgugaccgcagcccaguuccugacgccccccucgcagcacagcuacuccucgccuguggacaacacccccagccaccagcuacaggugccugagcaccccuuccucaccccguccccugaguccccugaccagugguccagcucguccccgcauuccaacgucuccgacugguccgagggcgucuccagcccucccaccagcaugcagucccagaucgcccgcauuccggaggccuucaaguaaacggcgcgccccacgagaccccggcuuccuuucccaagccuucgggcgucugugugcgcucuguggaugccagggccgaccagaggagccuuuuuaaaacacauguuuuuauacaaaauaagaacgaggauuuuaauuuuuuuuaguauuuauuuauguacuuuuauuuuacacagaaacacugccuuuuuauuuauauguacuguuuuaucuggccccagguagaaacuuuuaucuauucugagaaaacaagcaaguucugagagccaggguuuuccuacguaggaugaaaagauucuucuguguuuauaaaauauaaacaaagauucaugauuuauaaaugccauuuauuuauugauuccuuuuuucaaaauccaaaaagaaaugauguuggagaagggaaguugaacgagcauaguccaaaaagcuccuggggcguccaggccgcgcccuuuccccgacgcccacccaaccccaagccagcccggccgcuccaccagcaucaccugccuguuaggagaagcugcauccagaggcaaacggaggcaaagcuggcucaccuuccgcacgcggauuaauuugcaucugaaauaggaaacaagugaaagcauauggguuagauguugccauguguuuuagaugguuucuugcaagcaugcuugugaaaauguguucucggaguguguaugccaagagugcacccaugguaccaaucaugaaucuuuguuucagguucaguauuauguaguuguucguugguuauacaaguucuuggucccuccagaaccaccccggcccccugcccguucuugaaauguaggcaucaugcaugucaaacaugagauguguggacuguggcacuugccugggucacacacggaggcauccuacccuuuucuggggaaagacacugccugggcugaccccgguggcggccccagcaccucagccugcacagugucccccagguuccgaagaagaugcuccagcaacacagccugggccccagcucgcgggacccgaccccccgugggcucccguguuuuguaggagacuugccagagccgggcacauugagcugugcaacgccgugggcugcguccuuugguccuguccccgcagcccuggcagggggcaugcggucgggcaggggcuggagggaggcgggggcugcccuugggccaccccuccuaguuugggaggagcagauuuuugcaauaccaaguauagccuauggcagaaaaaaugucuguaaauauguuuuuaaagguggauuuuguuuaaaaaaucuuaaugaaugagucuguugugugucaugccagugagggacgucagacuuggcucagcucggggagccuuagccgcccaugcacuggggacgcuccgcugccgugccgccugcacuccucagggcagccucccccggcucuacgggggccgcguggugccauccccagggggcaugaccagaugcgucccaagauguugauuuuuacuguguuuuauaaaauagaguguaguuuacagaaaaagacuuuaaaagugaucuacaugaggaacuguagaugauguauuuuuuucaucuuuuuuguuaacugauuugcaauaaaaaugauacugauggugaaaaaaaaaaaaaaa

SEQ ID NO: 12 - protein, 280 aa, homo_sapiens
MPADIMEKNSSSPVAATPASVNTTPDKPKTASEHRKSSKPIMEKRRRARINESLSQLKTLILDALKKDSSRHSKLEKADILEMTVKHLRNLQRAQMTAALSTDPSVLGKYRAGFSECMNEVTRFLSTCEGVNTEVRTRLLGHLANCMTQINAMTYPGQPHPALQAPPPPPPGPGGPQHAPFAPPPPLVPIPGGAAPPPGGAPCKLGSQAGEAAKVFGGFQVVPAPDGQFAFLIPNGAFAHSGPVIPVYTSNSGTSVGPNAVSPSSGPSLTADSMWRPWRN

SEQ ID NO: 13 - protein, 166 aa, homo_sapiens
MAPSTVAVELLSPKEKNRLRKPVVEKMRRDRINSSIEQLKLLLEQEFARHQPNSKLEKADILEMAVSYLKHSKAFVAAAGPKSLHQDYSEGYSWCLQEAVQFLTLHAASDTQMKLLYHFQRPPAAPAAPAKEPKAPGAAPPPALSAKATAAAAAAHQPACGLWRPW

SEQ ID NO: 14 - protein, 155 aa, homo_sapiens
MKVASGSTATAAAGPSCALKAGKTASGAGEVVRCLSEQSVAISRCAGGAGARLPALLDEQQVNVLLYDMNGCYSRLKELVPTLPQNRKVSKVEILQHVIDYIRDLQLELNSESEVGTPGGRGLPVRAPLSTLNGEISALTAEAACVPADDRILCR

SEQ ID NO: 15 - protein, 149 aa, homo_sapiens
MKVASGSTATAAAGPSCALKAGKTASGAGEVVRCLSEQSVAISRCAGGAGARLPALLDEQQVNVLLYDMNGCYSRLKELVPTLPQNRKVSKVEILQHVIDYIRDLQLELNSESEVGTPGGRGLPVRAPLSTLNGEISALTAEVRSRSDH

SEQ ID NO: 16 - protein, 134 aa, homo_sapiens
MKAFSPVRSVRKNSLSDHSLGISRSKTPVDDPMSLLYNMNDCYSKLKELVPSIPQNKKVSKMEILQHVIDYILDLQIALDSHPTIVSLHHQRPGQNQASRTPLTTLNTDISILSLQASEFPSELMSNDSKALCG

SEQ ID NO: 17 - protein, 119 aa, homo_sapiens
MKALSPVRGCYEAVCCLSERSLAIARGRGKGPAAEEPLSLLDDMNHCYSRLRELVPGVPRGTQLSQVEILQRVIDYILDLQVVLAEPAPGPPDGPHLPIQTAELTPELVISNDKRSFCH

SEQ ID NO: 18 - protein, 198 aa, homo_sapiens
MSNVRVSNGSPSLERMDARQAEHPKPSACRNLFGPVDHEELTRDLEKHCRDMEEASQRKWNFDFQNHKPLEGKYEWQEVEKGSLPEFYYRPPRPPKGACKVPAQESQDVSGSRPAAPLIGAPANSEDTHLVDPKTDPSDSQTGLAEQCAGIRKRPATDDSSTQNKRANRTEENVSDGSPNAGSVEQTPKKPGLRRRQT

SEQ ID NO: 19 - protein, 304 aa, homo_sapiens
MKRAHPEYSSSDSELDETIEVEKESADENGNLSSALGSMSPTTSSQILARKRRRGIIEKRRRDRINNSLSELRRLVPSAFEKQGSAKLEKAEILQMTVDHLKMLHTAGGKGYFDAHALAMDYRSLGFRECLAEVARYLSIIEGLDASDPLRVRLVSHLNNYASQREAASGAHAGLGHIPWGTVFGHHPHIAHPLLLPQNGHGNAGTTASPTEPHHQGRLGSAHPEAPALRAPPSGSLGPVLPVVTSASKLSPPLLSSVASLSAFPFSFGSFHLLSPNALSPSAPTQAANLGKPYRPWGTEIGAF

SEQ ID NO: 20 - protein, 308 aa, homo_sapiens
MKRAHPEYSSSDSELDETIEVEKESADENGNLSSALGSMSPTTSSQILARKRRRGIIEKRRRDRINNSLSELRRLVPSAFEKQVMEQGSAKLEKAEILQMTVDHLKMLHTAGGKGYFDAHALAMDYRSLGFRECLAEVARYLSIIEGLDASDPLRVRLVSHLNNYASQREAASGAHAGLGHIPWGTVFGHHPHIAHPLLLPQNGHGNAGTTASPTEPHHQGRLGSAHPEAPALRAPPSGSLGPVLPVVTSASKLSPPLLSSVASLSAFPFSFGSFHLLSPNALSPSAPTQAANLGKPYRPWGTEIGAF

SEQ ID NO: 21 - protein, 337 aa, homo_sapiens
MKRPCEETTSESDMDETIDVGSENNYSGQSTSSVIRLNSPTTTSQIMARKKRRGIIEKRRRDRINNSLSELRRLVPTAFEKQGSAKLEKAEILQMTVDHLKMLQATGGKGYFDAHALAMDFMSIGFRECLTEVARYLSSVEGLDSSDPLRVRLVSHLSTCATQREAAAMTSSMAHHHHPLHPHHWAAAFHHLPAALLQPNGLHASESTPCRLSTTSEVPPAHGSALLTATFAHADSALRMPSTGSVAPCVPPLSTSLLSLSATVHAAAAAATAAAHSFPLSFAGAFPMLPPNAAAAVAAATAISPPLSVSATSSPQQTSSGTNNKPYRPWGTEVGAF

SEQ ID NO: 22 - protein, 2555 aa, Homo sapiens
MPPLLAPLLCLALLPALAARGPRCSQPGETCLNGGKCEAANGTEACVCGGAFVGPRCQDPNPCLSTPCKNAGTCHVVDRRGVADYACSCALGFSGPLCLTPLDNACLTNPCRNGGTCDLLTLTEYKCRCPPGWSGKSCQQADPCASNPCANGGQCLPFEASYICHCPPSFHGPTCRQDVNECGQKPGLCRHGGTCHNEVGSYRCVCRATHTGPNCERPYVPCSPSPCQNGGTCRPTGDVTHECACLPGFTGQNCEENIDDCPGNNCKNGGACVDGVNTYNCRCPPEWTGQYCTEDVDECQLMPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCICMPGYEGVHCEVNTDECASSPCLHNGRCLDKINEFQCECPTGFTGHLCQYDVDECASTPCKNGAKCLDGPNTYTCVCTEGYTGTHCEVDIDECDPDPCHYGSCKDGVATFTCLCRPGYTGHHCETNINECSSQPCRHGGTCQDRDNAYLCFCLKGTTGPNCEINLDDCASSPCDSGTCLDKIDGYECACEPGYTGSMCNINIDECAGNPCHNGGTCEDGINGFTCRCPEGYHDPTCLSEVNECNSNPCVHGACRDSLNGYKCDCDPGWSGTNCDINNNECESNPCVNGGTCKDMTSGYVCTCREGFSGPNCQTNINECASNPCLNQGTCIDDVAGYKCNCLLPYTGATCEVVLAPCAPSPCRNGGECRQSEDYESFSCVCPTGWQGQTCEVDINECVLSPCRHGASCQNTHGGYRCHCQAGYSGRNCETDIDDCRPNPCHNGGSCTDGINTAFCDCLPGFRGTFCEEDINECASDPCRNGANCTDCVDSYTCTCPAGFSGIHCENNTPDCTESSCFNGGTCVDGINSFTCLCPPGFTGSYCQHDVNECDSQPCLHGGTCQDGCGSYRCTCPQGYTGPNCQNLVHWCDSSPCKNGGKCWQTHTQYRCECPSGWTGLYCDVPSVSCEVAAQRQGVDVARLCQHGGLCVDAGNTHHCRCQAGYTGSYCEDLVDECSPSPCQNGATCTDYLGGYSCKCVAGYHGVNCSEEIDECLSHPCQNGGTCLDLPNTYKCSCPRGTQGVHCEINVDDCNPPVDPVSRSPKCFNNGTCVDQVGGYSCTCPPGFVGERCEGDVNECLSNPCDARGTQNCVQRVNDFHCECRAGHTGRRCESVINGCKGKPCKNGGTCAVASNTARGFICKCPAGFEGATCENDARTCGSLRCLNGGTCISGPRSPTCLCLGPFTGPECQFPASSPCLGGNPCYNQGTCEPTSESPFYRCLCPAKFNGLLCHILDYSFGGGAGRDIPPPLIEEACELPECQEDAGNKVCSLQCNNHACGWDGGDCSLNFNDPWKNCTQSLQCWKYFSDGHCDSQCNSAGCLFDGFDCQRAEGQCNPLYDQYCKDHFSDGHCDQGCNSAECEWDGLDCAEHVPERLAAGTLVVVVLMPPEQLRNSSFHFLRELSRVLHTNVVFKRDAHGQQMIFPYYGREEELRKHPIKRAAEGWAAPDALLGQVKASLLPGGSEGGRRRRELDPMDVRGSIVYLEIDNRQCVQASSQCFQSATDVAAFLGALASLGSLNIPYKIEAVQSETVEPPPPAQLHFMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLDDQTDHRQWTQQHLDAADLRMSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVDAAVVLLKNGANKDMQNNREETPLFLAAREGSYETAKVLLDHFANRDITDHMDRLPRDIAQERMHHDIVRLLDEYNLVRSPQLHGAPLGGTPTLSPPLCSPNGYLGSLKPGVQGKKVRKPSSKGLACGSKEAKDLKARRKKSQDGKGCLLDSSGMLSPVDSLESPHGYLSDVASPPLLPSPFQQSPSVPLNHLPGMPDTHLGIGHLNVAAKPEMAALGGGGRLAFETGPPRLSHLPVASGTSTVLGSSSGGALNFTVGGSTSLNGQCEWLSRLQSGMVPNQYNPLRGSVAPGPLSTQAPSLQHGMVGPLHSSLAASALSQMMSYQGLPSTRLATQPHLVQTQQVQPQNLQMQQQNLQPANIQQQQSLQPPPPPPQPHLGVSSAASGHLGRSFLSGEPSQADVQPLGPSSLAVHTILPQESPALPTSLPSSLVPPVTAAQFLTPPSQHSYSSPVDNTPSHQLQVPEHPFLTPSPESPDQWSSSSPHSNVSDWSEGVSSPPTSMQSQIARIPEAFK

SEQ ID NO: 23 - RNA, 19 nt, artificial
  Chemically synthesized
gcgccuuuguauuauaaaa

SEQ ID NO: 24 - RNA, 19 nt, artificial
  Chemically synthesized
gugaagaacuccaaaaaua

SEQ ID NO: 25 - RNA, 19 nt, artificial
  Chemically synthesized
cuugaauacugggagagaa

SEQ ID NO: 26 - RNA, 19 nt, artificial
  Chemically synthesized
ggcauuccaagcuggagaa

SEQ ID NO: 27 - RNA, 19 nt, artificial
  Chemically synthesized
caaguaaaagagacacaaa

SEQ ID NO: 28 - RNA, 19 nt, artificial
  Chemically synthesized
ggacauucuggaaaugaca

SEQ ID NO: 29 - RNA, 19 nt, artificial
  Chemically synthesized
agcugauauaauggagaaa

SEQ ID NO: 30 - RNA, 19 nt, artificial
  Chemically synthesized
uggagaaggcggacauucu

SEQ ID NO: 31 - RNA, 19 nt, artificial
  Chemically synthesized
gcuggagaaggcggacauu

SEQ ID NO: 32 - RNA, 19 nt, artificial
  Chemically synthesized
gacugaccaugcacuauau

SEQ ID NO: 33 - RNA, 19 nt, artificial
  Chemically synthesized
ggcuucagcgagugcauga

SEQ ID NO: 34 - RNA, 19 nt, artificial
  Chemically synthesized
ggaaguaccgagccggcuu

SEQ ID NO: 35 - RNA, 19 nt, artificial
  Chemically synthesized
ugccaaagauguuugaaaa

SEQ ID NO: 36 - RNA, 19 nt, artificial
  Chemically synthesized
ggagagaagaggacuuuuu

SEQ ID NO: 37 - RNA, 19 nt, artificial
  Chemically synthesized
ggugcugauaacagcggaa

SEQ ID NO: 38 - RNA, 19 nt, artificial
  Chemically synthesized
gaacuugaauacugggaga

SEQ ID NO: 39 - RNA, 19 nt, artificial
  Chemically synthesized
gcacuugcucaguaguuuu

SEQ ID NO: 40 - RNA, 19 nt, artificial
  Chemically synthesized
ggagaaggcggacauucug

SEQ ID NO: 41 - RNA, 19 nt, artificial
  Chemically synthesized
agcacuugcucaguaguuu

SEQ ID NO: 42 - RNA, 19 nt, artificial
  Chemically synthesized
agcuggagaaggcggacau

SEQ ID NO: 43 - RNA, 19 nt, artificial
  Chemically synthesized
gccuauuauggagaaaaga

SEQ ID NO: 44 - RNA, 19 nt, artificial
  Chemically synthesized
cguuuuuuacacgagauuu

SEQ ID NO: 45 - RNA, 19 nt, artificial
  Chemically synthesized
aguaaaagagacacaaaca

SEQ ID NO: 46 - RNA, 19 nt, artificial
  Chemically synthesized
gccaguuugcuuuccucau

SEQ ID NO: 47 - RNA, 19 nt, artificial
  Chemically synthesized
agccuauuauggagaaaag

SEQ ID NO: 48 - RNA, 19 nt, artificial
  Chemically synthesized
gcuucagcgagugcaugaa

SEQ ID NO: 49 - RNA, 19 nt, artificial
  Chemically synthesized
cagcaucugagcacagaaa

SEQ ID NO: 50 - RNA, 19 nt, artificial
  Chemically synthesized
cgugaagaacuccaaaaau

SEQ ID NO: 51 - RNA, 19 nt, artificial
  Chemically synthesized
ggauaaaccaaagacagca

SEQ ID NO: 52 - RNA, 19 nt, artificial
  Chemically synthesized
cucuaaacaggaacuugaa

SEQ ID NO: 53 - RNA, 19 nt, artificial
  Chemically synthesized
ggaaaaugccagcugauau

SEQ ID NO: 54 - RNA, 19 nt, artificial
  Chemically synthesized
ggagaggcggcuaaggugu

SEQ ID NO: 55 - RNA, 19 nt, artificial
  Chemically synthesized
agcacagaaagucaucaaa

SEQ ID NO: 56 - RNA, 19 nt, artificial
  Chemically synthesized
aagccuauuauggagaaaa

SEQ ID NO: 57 - RNA, 19 nt, artificial
  Chemically synthesized
agagagagcuguauuaagu

SEQ ID NO: 58 - RNA, 19 nt, artificial
  Chemically synthesized
gucucaaguaaaagagaca

SEQ ID NO: 59 - RNA, 19 nt, artificial
  Chemically synthesized
ccggcuucagcgagugcau

SEQ ID NO: 60 - RNA, 19 nt, artificial
  Chemically synthesized
caccaaguagccacaaaau

SEQ ID NO: 61 - RNA, 19 nt, artificial
  Chemically synthesized
ccggagcuggugcugauaa

SEQ ID NO: 62 - RNA, 19 nt, artificial
  Chemically synthesized
agucugagccagcugaaaa

SEQ ID NO: 63 - RNA, 19 nt, artificial
  Chemically synthesized
aagucaucaaagccuauua

SEQ ID NO: 64 - RNA, 19 nt, artificial
  Chemically synthesized
guaaaagagacacaaacaa

SEQ ID NO: 65 - RNA, 19 nt, artificial
  Chemically synthesized
ccagcugauauaauggaga

SEQ ID NO: 66 - RNA, 19 nt, artificial
  Chemically synthesized
ucaccaaguagccacaaaa

SEQ ID NO: 67 - RNA, 19 nt, artificial
  Chemically synthesized
ggagcuggugcugauaaca

SEQ ID NO: 68 - RNA, 19 nt, artificial
  Chemically synthesized
ccaagcuggagaaggcgga

SEQ ID NO: 69 - RNA, 19 nt, artificial
  Chemically synthesized
ggccaguuugcuuuccuca

SEQ ID NO: 70 - RNA, 19 nt, artificial
  Chemically synthesized
gcgagugcaugaacgaggu

SEQ ID NO: 71 - RNA, 19 nt, artificial
  Chemically synthesized
gggagagaagaggacuuuu

SEQ ID NO: 72 - RNA, 19 nt, artificial
  Chemically synthesized
gccaaagauguuugaaaau

SEQ ID NO: 73 - RNA, 19 nt, artificial
  Chemically synthesized
agcugaaaacacugauuuu

SEQ ID NO: 74 - RNA, 19 nt, artificial
  Chemically synthesized
gagagaagaggacuuuuuu

SEQ ID NO: 75 - RNA, 19 nt, artificial
  Chemically synthesized
cgagccggcuucagcgagu

SEQ ID NO: 76 - RNA, 19 nt, artificial
  Chemically synthesized
ccucagcacuugcucagua

SEQ ID NO: 77 - RNA, 19 nt, artificial
  Chemically synthesized
ccagccagugucaacacga

SEQ ID NO: 78 - RNA, 19 nt, artificial
  Chemically synthesized
auugcgccuuuguauuaua

SEQ ID NO: 79 - RNA, 19 nt, artificial
  Chemically synthesized
ggaucacacaggauccgga

SEQ ID NO: 80 - RNA, 19 nt, artificial
  Chemically synthesized
guuacuuuuuguagagaga

SEQ ID NO: 81 - RNA, 19 nt, artificial
  Chemically synthesized
acugcaugacccagaucaa

SEQ ID NO: 82 - RNA, 19 nt, artificial
  Chemically synthesized
ccgucuaccucucuccuug

SEQ ID NO: 83 - RNA, 19 nt, artificial
  Chemically synthesized
ccaugcacuauauuuguau

SEQ ID NO: 84 - RNA, 19 nt, artificial
  Chemically synthesized
gugguuacuuuguguuuuu

SEQ ID NO: 85 - RNA, 19 nt, artificial
  Chemically synthesized
ccagcugaaaacacugauu

SEQ ID NO: 86 - RNA, 19 nt, artificial
  Chemically synthesized
gcaucugagcacagaaagu

SEQ ID NO: 87 - RNA, 19 nt, artificial
  Chemically synthesized
ugcucaguaguuuugugaa

SEQ ID NO: 88 - RNA, 19 nt, artificial
  Chemically synthesized
acagcaucugagcacagaa

SEQ ID NO: 89 - RNA, 19 nt, artificial
  Chemically synthesized
cgcuacugaucaccaagua

SEQ ID NO: 90 - RNA, 19 nt, artificial
  Chemically synthesized
ggugguaccggcucccgau

SEQ ID NO: 91 - RNA, 19 nt, artificial
  Chemically synthesized
cugaccaugcacuauauuu

SEQ ID NO: 92 - RNA, 19 nt, artificial
  Chemically synthesized
agcuguauuaagugacuga

SEQ ID NO: 93 - RNA, 19 nt, artificial
  Chemically synthesized
cggacauucuggaaaugac

SEQ ID NO: 94 - RNA, 19 nt, artificial
  Chemically synthesized
agucaucaaagccuauuau

SEQ ID NO: 95 - RNA, 19 nt, artificial
  Chemically synthesized
cccaacgcagugucaccuu

SEQ ID NO: 96 - RNA, 19 nt, artificial
  Chemically synthesized
accaaguagccacaaaaua

SEQ ID NO: 97 - RNA, 19 nt, artificial
  Chemically synthesized
cuaagguguuuggaggcuu

SEQ ID NO: 98 - RNA, 19 nt, artificial
  Chemically synthesized
guauuaagugacugaccau

SEQ ID NO: 99 - RNA, 19 nt, artificial
  Chemically synthesized
cuauuauggagaaaagacg

SEQ ID NO: 100 - RNA, 19 nt, artificial
  Chemically synthesized
agaaggcggacauucugga

SEQ ID NO: 101 - RNA, 19 nt, artificial
  Chemically synthesized
uggauugcgccuuuguauu

SEQ ID NO: 102 - RNA, 19 nt, artificial
  Chemically synthesized
ccaacugcaugacccagau

SEQ ID NO: 103 - RNA, 19 nt, artificial
  Chemically synthesized
uauuauggagaaaagacga

SEQ ID NO: 104 - RNA, 19 nt, artificial
  Chemically synthesized
cuucccuccggacucuaaa

SEQ ID NO: 105 - RNA, 19 nt, artificial
  Chemically synthesized
ucuccuugguccuggaaca

SEQ ID NO: 106 - RNA, 19 nt, artificial
  Chemically synthesized
accggauaaaccaaagaca

SEQ ID NO: 107 - RNA, 19 nt, artificial
  Chemically synthesized
gagaagaggacuuuuuuga

SEQ ID NO: 108 - RNA, 19 nt, artificial
  Chemically synthesized
ccuauuauggagaaaagac

SEQ ID NO: 109 - RNA, 19 nt, artificial
  Chemically synthesized
ggcucccgauggccaguuu

SEQ ID NO: 110 - RNA, 19 nt, artificial
  Chemically synthesized
auuauggagaaaagacgaa

SEQ ID NO: 111 - RNA, 19 nt, artificial
  Chemically synthesized
ugaauacugggagagaaga

SEQ ID NO: 112 - RNA, 19 nt, artificial
  Chemically synthesized
gauguuugaaaaugcucuu

SEQ ID NO: 113 - RNA, 19 nt, artificial
  Chemically synthesized
cugggagagaagaggacuu

SEQ ID NO: 114 - RNA, 19 nt, artificial
  Chemically synthesized
cccgucuacaccagcaaca

SEQ ID NO: 115 - RNA, 19 nt, artificial
  Chemically synthesized
gcgcugagcacagacccaa

SEQ ID NO: 116 - RNA, 19 nt, artificial
  Chemically synthesized
cggcauuccaagcuggaga

SEQ ID NO: 117 - RNA, 19 nt, artificial
  Chemically synthesized
agccagugucaacacgaca

SEQ ID NO: 118 - RNA, 19 nt, artificial
  Chemically synthesized
ggacuuuuuugauuaagug

SEQ ID NO: 119 - RNA, 19 nt, artificial
  Chemically synthesized
uauggagaaaagacgaaga

SEQ ID NO: 120 - RNA, 19 nt, artificial
  Chemically synthesized
ggaugcucugaagaaagau

SEQ ID NO: 121 - RNA, 19 nt, artificial
  Chemically synthesized
gugucaacacgacaccgga

SEQ ID NO: 122 - RNA, 19 nt, artificial
  Chemically synthesized
gagugcaugaacgagguga

SEQ ID NO: 123 - RNA, 19 nt, artificial
  Chemically synthesized
ggcggacauucuggaaaug

SEQ ID NO: 124 - RNA, 19 nt, artificial
  Chemically synthesized
ccacgugcgagggcguuaa

SEQ ID NO: 125 - RNA, 19 nt, artificial
  Chemically synthesized
aaagccuauuauggagaaa

SEQ ID NO: 126 - RNA, 19 nt, artificial
  Chemically synthesized
cucaaguaaaagagacaca

SEQ ID NO: 127 - RNA, 19 nt, artificial
  Chemically synthesized
aucaccaaguagccacaaa

SEQ ID NO: 128 - RNA, 19 nt, artificial
  Chemically synthesized
gaccaugcacuauauuugu

SEQ ID NO: 129 - RNA, 19 nt, artificial
  Chemically synthesized
cuggagaaggcggacauuc

SEQ ID NO: 130 - RNA, 19 nt, artificial
  Chemically synthesized
cagcugaaaacacugauuu

SEQ ID NO: 131 - RNA, 19 nt, artificial
  Chemically synthesized
ccugcaagcugggcagcca

SEQ ID NO: 132 - RNA, 19 nt, artificial
  Chemically synthesized
ucuucccuccggacucuaa

SEQ ID NO: 133 - RNA, 19 nt, artificial
  Chemically synthesized
cuuuuuuaugugaugccaa

SEQ ID NO: 134 - RNA, 19 nt, artificial
  Chemically synthesized
agagcuguauuaagugacu

SEQ ID NO: 135 - RNA, 19 nt, artificial
  Chemically synthesized
uucuggaaaugacagugaa

SEQ ID NO: 136 - RNA, 19 nt, artificial
  Chemically synthesized
cagcacuugcucaguaguu

SEQ ID NO: 137 - RNA, 19 nt, artificial
  Chemically synthesized
ugaucaccaaguagccaca

SEQ ID NO: 138 - RNA, 19 nt, artificial
  Chemically synthesized
cacugauuuuggaugcucu

SEQ ID NO: 139 - RNA, 19 nt, artificial
  Chemically synthesized
gccaacugcaugacccaga

SEQ ID NO: 140 - RNA, 19 nt, artificial
  Chemically synthesized
uuuggaugcucugaagaaa

SEQ ID NO: 141 - RNA, 19 nt, artificial
  Chemically synthesized
agugguuacuuuguguuuu

SEQ ID NO: 142 - RNA, 19 nt, artificial
  Chemically synthesized
guuuuuuacacgagauuuc

SEQ ID NO: 143 - RNA, 19 nt, artificial
  Chemically synthesized
gcggacauucuggaaauga

SEQ ID NO: 144 - RNA, 19 nt, artificial
  Chemically synthesized
caaagacagcaucugagca

SEQ ID NO: 145 - RNA, 19 nt, artificial
  Chemically synthesized
cucucuccuugguccugga

SEQ ID NO: 146 - RNA, 19 nt, artificial
  Chemically synthesized
acuugaauacugggagaga

SEQ ID NO: 147 - RNA, 19 nt, artificial
  Chemically synthesized
gaaagucugagccagcuga

SEQ ID NO: 148 - RNA, 19 nt, artificial
  Chemically synthesized
uugcuuuccucauucccaa

SEQ ID NO: 149 - RNA, 19 nt, artificial
  Chemically synthesized
cagccagugucaacacgac

SEQ ID NO: 150 - RNA, 19 nt, artificial
  Chemically synthesized
cggagcuggugcugauaac

SEQ ID NO: 151 - RNA, 19 nt, artificial
  Chemically synthesized
cugcaugacccagaucaau

SEQ ID NO: 152 - RNA, 19 nt, artificial
  Chemically synthesized
ccaacgcagugucaccuuc

SEQ ID NO: 153 - RNA, 19 nt, artificial
  Chemically synthesized
aagacagcaucugagcaca

SEQ ID NO: 154 - RNA, 19 nt, artificial
  Chemically synthesized
aacgcagugucaccuucca

SEQ ID NO: 155 - RNA, 19 nt, artificial
  Chemically synthesized
ugcgccuuuguauuauaaa

SEQ ID NO: 156 - RNA, 19 nt, artificial
  Chemically synthesized
ccuggaacagcgcuacuga

SEQ ID NO: 157 - RNA, 19 nt, artificial
  Chemically synthesized
auuggauugcgccuuugua

SEQ ID NO: 158 - RNA, 19 nt, artificial
  Chemically synthesized
agauguuugaaaaugcucu

SEQ ID NO: 159 - RNA, 19 nt, artificial
  Chemically synthesized
uccggacucuaaacaggaa

SEQ ID NO: 160 - RNA, 19 nt, artificial
  Chemically synthesized
cucuucccuccggacucua

SEQ ID NO: 161 - RNA, 19 nt, artificial
  Chemically synthesized
cgcuuacggcggacuccau

SEQ ID NO: 162 - RNA, 19 nt, artificial
  Chemically synthesized
ggcuggagaggcggcuaag

SEQ ID NO: 163 - RNA, 19 nt, artificial
  Chemically synthesized
gcgcuacugaucaccaagu

SEQ ID NO: 164 - RNA, 19 nt, artificial
  Chemically synthesized
augccaaagauguuugaaa

SEQ ID NO: 165 - RNA, 19 nt, artificial
  Chemically synthesized
gagaaggcggacauucugg

SEQ ID NO: 166 - RNA, 19 nt, artificial
  Chemically synthesized
ggcggcuaagguguuugga

SEQ ID NO: 167 - RNA, 19 nt, artificial
  Chemically synthesized
cggacucuaaacaggaacu

SEQ ID NO: 168 - RNA, 19 nt, artificial
  Chemically synthesized
aaaagacgaagagcaagaa

SEQ ID NO: 169 - RNA, 19 nt, artificial
  Chemically synthesized
agguguuuggaggcuucca

SEQ ID NO: 170 - RNA, 19 nt, artificial
  Chemically synthesized
gaagaggacuuuuuugauu

SEQ ID NO: 171 - RNA, 19 nt, artificial
  Chemically synthesized
gauuaagugguuacuuugu

SEQ ID NO: 172 - RNA, 19 nt, artificial
  Chemically synthesized
auccggagcuggugcugau

SEQ ID NO: 173 - RNA, 19 nt, artificial
  Chemically synthesized
gugcugauaacagcggaau

SEQ ID NO: 174 - RNA, 19 nt, artificial
  Chemically synthesized
gucugagccagcugaaaac

SEQ ID NO: 175 - RNA, 19 nt, artificial
  Chemically synthesized
ccggauaaaccaaagacag

SEQ ID NO: 176 - RNA, 19 nt, artificial
  Chemically synthesized
cccgucuaccucucuccuu

SEQ ID NO: 177 - RNA, 19 nt, artificial
  Chemically synthesized
gggcagccaggcuggagag

SEQ ID NO: 178 - RNA, 19 nt, artificial
  Chemically synthesized
acgacaccggauaaaccaa

SEQ ID NO: 179 - RNA, 19 nt, artificial
  Chemically synthesized
gccggcuucagcgagugca

SEQ ID NO: 180 - RNA, 19 nt, artificial
  Chemically synthesized
ucgugaagaacuccaaaaa

SEQ ID NO: 181 - RNA, 19 nt, artificial
  Chemically synthesized
cggcuaagguguuuggagg

SEQ ID NO: 182 - RNA, 19 nt, artificial
  Chemically synthesized
agccagcugaaaacacuga

SEQ ID NO: 183 - RNA, 19 nt, artificial
  Chemically synthesized
ugagccagcugaaaacacu

SEQ ID NO: 184 - RNA, 19 nt, artificial
  Chemically synthesized
ugggcagccaggcuggaga

SEQ ID NO: 185 - RNA, 19 nt, artificial
  Chemically synthesized
uguauuaagugacugacca

SEQ ID NO: 186 - RNA, 19 nt, artificial
  Chemically synthesized
gacagcaucugagcacaga

SEQ ID NO: 187 - RNA, 19 nt, artificial
  Chemically synthesized
cgccuuuguauuauaaaag

SEQ ID NO: 188 - RNA, 19 nt, artificial
  Chemically synthesized
cuggaacagcgcuacugau

SEQ ID NO: 189 - RNA, 19 nt, artificial
  Chemically synthesized
cccucagcacuugcucagu

SEQ ID NO: 190 - RNA, 19 nt, artificial
  Chemically synthesized
aucugagcacagaaaguca

SEQ ID NO: 191 - RNA, 19 nt, artificial
  Chemically synthesized
gcgagggcguuaauaccga

SEQ ID NO: 192 - RNA, 19 nt, artificial
  Chemically synthesized
aaggcggacauucuggaaa

SEQ ID NO: 193 - RNA, 19 nt, artificial
  Chemically synthesized
cgcugagcacagacccaag

SEQ ID NO: 194 - RNA, 19 nt, artificial
  Chemically synthesized
agugacugaccaugcacua

SEQ ID NO: 195 - RNA, 19 nt, artificial
  Chemically synthesized
cuccggacucuaaacagga

SEQ ID NO: 196 - RNA, 19 nt, artificial
  Chemically synthesized
ucaaguaaaagagacacaa

SEQ ID NO: 197 - RNA, 19 nt, artificial
  Chemically synthesized
uggugcugauaacagcgga

SEQ ID NO: 198 - RNA, 19 nt, artificial
  Chemically synthesized
gggaaguaccgagccggcu

SEQ ID NO: 199 - RNA, 19 nt, artificial
  Chemically synthesized
gaauacugggagagaagag

SEQ ID NO: 200 - RNA, 19 nt, artificial
  Chemically synthesized
gucaucaaagccuauuaug

SEQ ID NO: 201 - RNA, 19 nt, artificial
  Chemically synthesized
gguguuuggaggcuuccag

SEQ ID NO: 202 - RNA, 19 nt, artificial
  Chemically synthesized
uuuuauaauacaaaggcgc

SEQ ID NO: 203 - RNA, 19 nt, artificial
  Chemically synthesized
uauuuuuggaguucuucac

SEQ ID NO: 204 - RNA, 19 nt, artificial
  Chemically synthesized
uucucucccaguauucaag

SEQ ID NO: 205 - RNA, 19 nt, artificial
  Chemically synthesized
uucuccagcuuggaaugcc

SEQ ID NO: 206 - RNA, 19 nt, artificial
  Chemically synthesized
uuugugucucuuuuacuug

SEQ ID NO: 207 - RNA, 19 nt, artificial
  Chemically synthesized
ugucauuuccagaaugucc

SEQ ID NO: 208 - RNA, 19 nt, artificial
  Chemically synthesized
uuucuccauuauaucagcu

SEQ ID NO: 209 - RNA, 19 nt, artificial
  Chemically synthesized
agaauguccgccuucucca

SEQ ID NO: 210 - RNA, 19 nt, artificial
  Chemically synthesized
aauguccgccuucuccagc

SEQ ID NO: 211 - RNA, 19 nt, artificial
  Chemically synthesized
auauagugcauggucaguc

SEQ ID NO: 212 - RNA, 19 nt, artificial
  Chemically synthesized
ucaugcacucgcugaagcc

SEQ ID NO: 213 - RNA, 19 nt, artificial
  Chemically synthesized
aagccggcucgguacuucc

SEQ ID NO: 214 - RNA, 19 nt, artificial
  Chemically synthesized
uuuucaaacaucuuuggca

SEQ ID NO: 215 - RNA, 19 nt, artificial
  Chemically synthesized
aaaaaguccucuucucucc

SEQ ID NO: 216 - RNA, 19 nt, artificial
  Chemically synthesized
uuccgcuguuaucagcacc

SEQ ID NO: 217 - RNA, 19 nt, artificial
  Chemically synthesized
ucucccaguauucaaguuc

SEQ ID NO: 218 - RNA, 19 nt, artificial
  Chemically synthesized
aaaacuacugagcaagugc

SEQ ID NO: 219 - RNA, 19 nt, artificial
  Chemically synthesized
cagaauguccgccuucucc

SEQ ID NO: 220 - RNA, 19 nt, artificial
  Chemically synthesized
aaacuacugagcaagugcu

SEQ ID NO: 221 - RNA, 19 nt, artificial
  Chemically synthesized
auguccgccuucuccagcu

SEQ ID NO: 222 - RNA, 19 nt, artificial
  Chemically synthesized
ucuuuucuccauaauaggc

SEQ ID NO: 223 - RNA, 19 nt, artificial
  Chemically synthesized
aaaucucguguaaaaaacg

SEQ ID NO: 224 - RNA, 19 nt, artificial
  Chemically synthesized
uguuugugucucuuuuacu

SEQ ID NO: 225 - RNA, 19 nt, artificial
  Chemically synthesized
augaggaaagcaaacuggc

SEQ ID NO: 226 - RNA, 19 nt, artificial
  Chemically synthesized
cuuuucuccauaauaggcu

SEQ ID NO: 227 - RNA, 19 nt, artificial
  Chemically synthesized
uucaugcacucgcugaagc

SEQ ID NO: 228 - RNA, 19 nt, artificial
  Chemically synthesized
uuucugugcucagaugcug

SEQ ID NO: 229 - RNA, 19 nt, artificial
  Chemically synthesized
auuuuuggaguucuucacg

SEQ ID NO: 230 - RNA, 19 nt, artificial
  Chemically synthesized
ugcugucuuugguuuaucc

SEQ ID NO: 231 - RNA, 19 nt, artificial
  Chemically synthesized
uucaaguuccuguuuagag

SEQ ID NO: 232 - RNA, 19 nt, artificial
  Chemically synthesized
auaucagcuggcauuuucc

SEQ ID NO: 233 - RNA, 19 nt, artificial
  Chemically synthesized
acaccuuagccgccucucc

SEQ ID NO: 234 - RNA, 19 nt, artificial
  Chemically synthesized
uuugaugacuuucugugcu

SEQ ID NO: 235 - RNA, 19 nt, artificial
  Chemically synthesized
uuuucuccauaauaggcuu

SEQ ID NO: 236 - RNA, 19 nt, artificial
  Chemically synthesized
acuuaauacagcucucucu

SEQ ID NO: 237 - RNA, 19 nt, artificial
  Chemically synthesized
ugucucuuuuacuugagac

SEQ ID NO: 238 - RNA, 19 nt, artificial
  Chemically synthesized
augcacucgcugaagccgg

SEQ ID NO: 239 - RNA, 19 nt, artificial
  Chemically synthesized
auuuuguggcuacuuggug

SEQ ID NO: 240 - RNA, 19 nt, artificial
  Chemically synthesized
uuaucagcaccagcuccgg

SEQ ID NO: 241 - RNA, 19 nt, artificial
  Chemically synthesized
uuuucagcuggcucagacu

SEQ ID NO: 242 - RNA, 19 nt, artificial
  Chemically synthesized
uaauaggcuuugaugacuu

SEQ ID NO: 243 - RNA, 19 nt, artificial
  Chemically synthesized
uuguuugugucucuuuuac

SEQ ID NO: 244 - RNA, 19 nt, artificial
  Chemically synthesized
ucuccauuauaucagcugg

SEQ ID NO: 245 - RNA, 19 nt, artificial
  Chemically synthesized
uuuuguggcuacuugguga

SEQ ID NO: 246 - RNA, 19 nt, artificial
  Chemically synthesized
uguuaucagcaccagcucc

SEQ ID NO: 247 - RNA, 19 nt, artificial
  Chemically synthesized
uccgccuucuccagcuugg

SEQ ID NO: 248 - RNA, 19 nt, artificial
  Chemically synthesized
ugaggaaagcaaacuggcc

SEQ ID NO: 249 - RNA, 19 nt, artificial
  Chemically synthesized
accucguucaugcacucgc

SEQ ID NO: 250 - RNA, 19 nt, artificial
  Chemically synthesized
aaaaguccucuucucuccc

SEQ ID NO: 251 - RNA, 19 nt, artificial
  Chemically synthesized
auuuucaaacaucuuuggc

SEQ ID NO: 252 - RNA, 19 nt, artificial
  Chemically synthesized
aaaaucaguguuuucagcu

SEQ ID NO: 253 - RNA, 19 nt, artificial
  Chemically synthesized
aaaaaaguccucuucucuc

SEQ ID NO: 254 - RNA, 19 nt, artificial
  Chemically synthesized
acucgcugaagccggcucg

SEQ ID NO: 255 - RNA, 19 nt, artificial
  Chemically synthesized
uacugagcaagugcugagg

SEQ ID NO: 256 - RNA, 19 nt, artificial
  Chemically synthesized
ucguguugacacuggcugg

SEQ ID NO: 257 - RNA, 19 nt, artificial
  Chemically synthesized
uauaauacaaaggcgcaau

SEQ ID NO: 258 - RNA, 19 nt, artificial
  Chemically synthesized
uccggauccugugugaucc

SEQ ID NO: 259 - RNA, 19 nt, artificial
  Chemically synthesized
ucucucuacaaaaaguaac

SEQ ID NO: 260 - RNA, 19 nt, artificial
  Chemically synthesized
uugaucugggucaugcagu

SEQ ID NO: 261 - RNA, 19 nt, artificial
  Chemically synthesized
caaggagagagguagacgg

SEQ ID NO: 262 - RNA, 19 nt, artificial
  Chemically synthesized
auacaaauauagugcaugg

SEQ ID NO: 263 - RNA, 19 nt, artificial
  Chemically synthesized
aaaaacacaaaguaaccac

SEQ ID NO: 264 - RNA, 19 nt, artificial
  Chemically synthesized
aaucaguguuuucagcugg

SEQ ID NO: 265 - RNA, 19 nt, artificial
  Chemically synthesized
acuuucugugcucagaugc

SEQ ID NO: 266 - RNA, 19 nt, artificial
  Chemically synthesized
uucacaaaacuacugagca

SEQ ID NO: 267 - RNA, 19 nt, artificial
  Chemically synthesized
uucugugcucagaugcugu

SEQ ID NO: 268 - RNA, 19 nt, artificial
  Chemically synthesized
uacuuggugaucaguagcg

SEQ ID NO: 269 - RNA, 19 nt, artificial
  Chemically synthesized
aucgggagccgguaccacc

SEQ ID NO: 270 - RNA, 19 nt, artificial
  Chemically synthesized
aaauauagugcauggucag

SEQ ID NO: 271 - RNA, 19 nt, artificial
  Chemically synthesized
ucagucacuuaauacagcu

SEQ ID NO: 272 - RNA, 19 nt, artificial
  Chemically synthesized
gucauuuccagaauguccg

SEQ ID NO: 273 - RNA, 19 nt, artificial
  Chemically synthesized
auaauaggcuuugaugacu

SEQ ID NO: 274 - RNA, 19 nt, artificial
  Chemically synthesized
aaggugacacugcguuggg

SEQ ID NO: 275 - RNA, 19 nt, artificial
  Chemically synthesized
uauuuuguggcuacuuggu

SEQ ID NO: 276 - RNA, 19 nt, artificial
  Chemically synthesized
aagccuccaaacaccuuag

SEQ ID NO: 277 - RNA, 19 nt, artificial
  Chemically synthesized
auggucagucacuuaauac

SEQ ID NO: 278 - RNA, 19 nt, artificial
  Chemically synthesized
cgucuuuucuccauaauag

SEQ ID NO: 279 - RNA, 19 nt, artificial
  Chemically synthesized
uccagaauguccgccuucu

SEQ ID NO: 280 - RNA, 19 nt, artificial
  Chemically synthesized
aauacaaaggcgcaaucca

SEQ ID NO: 281 - RNA, 19 nt, artificial
  Chemically synthesized
aucugggucaugcaguugg

SEQ ID NO: 282 - RNA, 19 nt, artificial
  Chemically synthesized
ucgucuuuucuccauaaua

SEQ ID NO: 283 - RNA, 19 nt, artificial
  Chemically synthesized
uuuagaguccggagggaag

SEQ ID NO: 284 - RNA, 19 nt, artificial
  Chemically synthesized
uguuccaggaccaaggaga

SEQ ID NO: 285 - RNA, 19 nt, artificial
  Chemically synthesized
ugucuuugguuuauccggu

SEQ ID NO: 286 - RNA, 19 nt, artificial
  Chemically synthesized
ucaaaaaaguccucuucuc

SEQ ID NO: 287 - RNA, 19 nt, artificial
  Chemically synthesized
gucuuuucuccauaauagg

SEQ ID NO: 288 - RNA, 19 nt, artificial
  Chemically synthesized
aaacuggccaucgggagcc

SEQ ID NO: 289 - RNA, 19 nt, artificial
  Chemically synthesized
uucgucuuuucuccauaau

SEQ ID NO: 290 - RNA, 19 nt, artificial
  Chemically synthesized
ucuucucucccaguauuca

SEQ ID NO: 291 - RNA, 19 nt, artificial
  Chemically synthesized
aagagcauuuucaaacauc

SEQ ID NO: 292 - RNA, 19 nt, artificial
  Chemically synthesized
aaguccucuucucucccag

SEQ ID NO: 293 - RNA, 19 nt, artificial
  Chemically synthesized
uguugcugguguagacggg

SEQ ID NO: 294 - RNA, 19 nt, artificial
  Chemically synthesized
uugggucugugcucagcgc

SEQ ID NO: 295 - RNA, 19 nt, artificial
  Chemically synthesized
ucuccagcuuggaaugccg

SEQ ID NO: 296 - RNA, 19 nt, artificial
  Chemically synthesized
ugucguguugacacuggcu

SEQ ID NO: 297 - RNA, 19 nt, artificial
  Chemically synthesized
cacuuaaucaaaaaagucc

SEQ ID NO: 298 - RNA, 19 nt, artificial
  Chemically synthesized
ucuucgucuuuucuccaua

SEQ ID NO: 299 - RNA, 19 nt, artificial
  Chemically synthesized
aucuuucuucagagcaucc

SEQ ID NO: 300 - RNA, 19 nt, artificial
  Chemically synthesized
uccggugucguguugacac

SEQ ID NO: 301 - RNA, 19 nt, artificial
  Chemically synthesized
ucaccucguucaugcacuc

SEQ ID NO: 302 - RNA, 19 nt, artificial
  Chemically synthesized
cauuuccagaauguccgcc

SEQ ID NO: 303 - RNA, 19 nt, artificial
  Chemically synthesized
uuaacgcccucgcacgugg

SEQ ID NO: 304 - RNA, 19 nt, artificial
  Chemically synthesized
uuucuccauaauaggcuuu

SEQ ID NO: 305 - RNA, 19 nt, artificial
  Chemically synthesized
ugugucucuuuuacuugag

SEQ ID NO: 306 - RNA, 19 nt, artificial
  Chemically synthesized
uuuguggcuacuuggugau

SEQ ID NO: 307 - RNA, 19 nt, artificial
  Chemically synthesized
acaaauauagugcaugguc

SEQ ID NO: 308 - RNA, 19 nt, artificial
  Chemically synthesized
gaauguccgccuucuccag

SEQ ID NO: 309 - RNA, 19 nt, artificial
  Chemically synthesized
aaaucaguguuuucagcug

SEQ ID NO: 310 - RNA, 19 nt, artificial
  Chemically synthesized
uggcugcccagcuugcagg

SEQ ID NO: 311 - RNA, 19 nt, artificial
  Chemically synthesized
uuagaguccggagggaaga

SEQ ID NO: 312 - RNA, 19 nt, artificial
  Chemically synthesized
uuggcaucacauaaaaaag

SEQ ID NO: 313 - RNA, 19 nt, artificial
  Chemically synthesized
agucacuuaauacagcucu

SEQ ID NO: 314 - RNA, 19 nt, artificial
  Chemically synthesized
uucacugucauuuccagaa

SEQ ID NO: 315 - RNA, 19 nt, artificial
  Chemically synthesized
aacuacugagcaagugcug

SEQ ID NO: 316 - RNA, 19 nt, artificial
  Chemically synthesized
uguggcuacuuggugauca

SEQ ID NO: 317 - RNA, 19 nt, artificial
  Chemically synthesized
agagcauccaaaaucagug

SEQ ID NO: 318 - RNA, 19 nt, artificial
  Chemically synthesized
ucugggucaugcaguuggc

SEQ ID NO: 319 - RNA, 19 nt, artificial
  Chemically synthesized
uuucuucagagcauccaaa

SEQ ID NO: 320 - RNA, 19 nt, artificial
  Chemically synthesized
aaaacacaaaguaaccacu

SEQ ID NO: 321 - RNA, 19 nt, artificial
  Chemically synthesized
gaaaucucguguaaaaaac

SEQ ID NO: 322 - RNA, 19 nt, artificial
  Chemically synthesized
ucauuuccagaauguccgc

SEQ ID NO: 323 - RNA, 19 nt, artificial
  Chemically synthesized
ugcucagaugcugucuuug

SEQ ID NO: 324 - RNA, 19 nt, artificial
  Chemically synthesized
uccaggaccaaggagagag

SEQ ID NO: 325 - RNA, 19 nt, artificial
  Chemically synthesized
ucucucccaguauucaagu

SEQ ID NO: 326 - RNA, 19 nt, artificial
  Chemically synthesized
ucagcuggcucagacuuuc

SEQ ID NO: 327 - RNA, 19 nt, artificial
  Chemically synthesized
uugggaaugaggaaagcaa

SEQ ID NO: 328 - RNA, 19 nt, artificial
  Chemically synthesized
gucguguugacacuggcug

SEQ ID NO: 329 - RNA, 19 nt, artificial
  Chemically synthesized
guuaucagcaccagcuccg

SEQ ID NO: 330 - RNA, 19 nt, artificial
  Chemically synthesized
auugaucugggucaugcag

SEQ ID NO: 331 - RNA, 19 nt, artificial
  Chemically synthesized
gaaggugacacugcguugg

SEQ ID NO: 332 - RNA, 19 nt, artificial
  Chemically synthesized
ugugcucagaugcugucuu

SEQ ID NO: 333 - RNA, 19 nt, artificial
  Chemically synthesized
uggaaggugacacugcguu

SEQ ID NO: 334 - RNA, 19 nt, artificial
  Chemically synthesized
uuuauaauacaaaggcgca

SEQ ID NO: 335 - RNA, 19 nt, artificial
  Chemically synthesized
ucaguagcgcuguuccagg

SEQ ID NO: 336 - RNA, 19 nt, artificial
  Chemically synthesized
uacaaaggcgcaauccaau

SEQ ID NO: 337 - RNA, 19 nt, artificial
  Chemically synthesized
agagcauuuucaaacaucu

SEQ ID NO: 338 - RNA, 19 nt, artificial
  Chemically synthesized
uuccuguuuagaguccgga

SEQ ID NO: 339 - RNA, 19 nt, artificial
  Chemically synthesized
uagaguccggagggaagag

SEQ ID NO: 340 - RNA, 19 nt, artificial
  Chemically synthesized
auggaguccgccguaagcg

SEQ ID NO: 341 - RNA, 19 nt, artificial
  Chemically synthesized
cuuagccgccucuccagcc

SEQ ID NO: 342 - RNA, 19 nt, artificial
  Chemically synthesized
acuuggugaucaguagcgc

SEQ ID NO: 343 - RNA, 19 nt, artificial
  Chemically synthesized
uuucaaacaucuuuggcau

SEQ ID NO: 344 - RNA, 19 nt, artificial
  Chemically synthesized
ccagaauguccgccuucuc

SEQ ID NO: 345 - RNA, 19 nt, artificial
  Chemically synthesized
uccaaacaccuuagccgcc

SEQ ID NO: 346 - RNA, 19 nt, artificial
  Chemically synthesized
aguuccuguuuagaguccg

SEQ ID NO: 347 - RNA, 19 nt, artificial
  Chemically synthesized
uucuugcucuucgucuuuu

SEQ ID NO: 348 - RNA, 19 nt, artificial
  Chemically synthesized
uggaagccuccaaacaccu

SEQ ID NO: 349 - RNA, 19 nt, artificial
  Chemically synthesized
aaucaaaaaaguccucuuc

SEQ ID NO: 350 - RNA, 19 nt, artificial
  Chemically synthesized
acaaaguaaccacuuaauc

SEQ ID NO: 351 - RNA, 19 nt, artificial
  Chemically synthesized
aucagcaccagcuccggau

SEQ ID NO: 352 - RNA, 19 nt, artificial
  Chemically synthesized
auuccgcuguuaucagcac

SEQ ID NO: 353 - RNA, 19 nt, artificial
  Chemically synthesized
guuuucagcuggcucagac

SEQ ID NO: 354 - RNA, 19 nt, artificial
  Chemically synthesized
cugucuuugguuuauccgg

SEQ ID NO: 355 - RNA, 19 nt, artificial
  Chemically synthesized
aaggagagagguagacggg

SEQ ID NO: 356 - RNA, 19 nt, artificial
  Chemically synthesized
cucuccagccuggcugccc

SEQ ID NO: 357 - RNA, 19 nt, artificial
  Chemically synthesized
uugguuuauccggugucgu

SEQ ID NO: 358 - RNA, 19 nt, artificial
  Chemically synthesized
ugcacucgcugaagccggc

SEQ ID NO: 359 - RNA, 19 nt, artificial
  Chemically synthesized
uuuuuggaguucuucacga

SEQ ID NO: 360 - RNA, 19 nt, artificial
  Chemically synthesized
ccuccaaacaccuuagccg

SEQ ID NO: 361 - RNA, 19 nt, artificial
  Chemically synthesized
ucaguguuuucagcuggcu

SEQ ID NO: 362 - RNA, 19 nt, artificial
  Chemically synthesized
aguguuuucagcuggcuca

SEQ ID NO: 363 - RNA, 19 nt, artificial
  Chemically synthesized
ucuccagccuggcugccca

SEQ ID NO: 364 - RNA, 19 nt, artificial
  Chemically synthesized
uggucagucacuuaauaca

SEQ ID NO: 365 - RNA, 19 nt, artificial
  Chemically synthesized
ucugugcucagaugcuguc

SEQ ID NO: 366 - RNA, 19 nt, artificial
  Chemically synthesized
cuuuuauaauacaaaggcg

SEQ ID NO: 367 - RNA, 19 nt, artificial
  Chemically synthesized
aucaguagcgcuguuccag

SEQ ID NO: 368 - RNA, 19 nt, artificial
  Chemically synthesized
acugagcaagugcugaggg

SEQ ID NO: 369 - RNA, 19 nt, artificial
  Chemically synthesized
ugacuuucugugcucagau

SEQ ID NO: 370 - RNA, 19 nt, artificial
  Chemically synthesized
ucgguauuaacgcccucgc

SEQ ID NO: 371 - RNA, 19 nt, artificial
  Chemically synthesized
uuuccagaauguccgccuu

SEQ ID NO: 372 - RNA, 19 nt, artificial
  Chemically synthesized
cuugggucugugcucagcg

SEQ ID NO: 373 - RNA, 19 nt, artificial
  Chemically synthesized
uagugcauggucagucacu

SEQ ID NO: 374 - RNA, 19 nt, artificial
  Chemically synthesized
uccuguuuagaguccggag

SEQ ID NO: 375 - RNA, 19 nt, artificial
  Chemically synthesized
uugugucucuuuuacuuga

SEQ ID NO: 376 - RNA, 19 nt, artificial
  Chemically synthesized
uccgcuguuaucagcacca

SEQ ID NO: 377 - RNA, 19 nt, artificial
  Chemically synthesized
agccggcucgguacuuccc

SEQ ID NO: 378 - RNA, 19 nt, artificial
  Chemically synthesized
cucuucucucccaguauuc

SEQ ID NO: 379 - RNA, 19 nt, artificial
  Chemically synthesized
cauaauaggcuuugaugac

SEQ ID NO: 380 - RNA, 19 nt, Artificial Sequence
  Chemically synthesized
cuggaagccuccaaacacc

SEQ ID NO: 381 - RNA, 19 nt, artificial
  Chemically synthesized
gcacagaaagucaucaaag

SEQ ID NO: 382 - RNA, 19 nt, artificial
  Chemically synthesized
agcaccuccggaaccugca

SEQ ID NO: 383 - RNA, 19 nt, artificial
  Chemically synthesized
uuggauugcgccuuuguau

SEQ ID NO: 384 - RNA, 19 nt, artificial
  Chemically synthesized
ggccaccuggccaacugca

SEQ ID NO: 385 - RNA, 19 nt, artificial
  Chemically synthesized
gccuuuguauuauaaaagc

SEQ ID NO: 386 - RNA, 19 nt, artificial
  Chemically synthesized
cacagaaagucaucaaagc

SEQ ID NO: 387 - RNA, 19 nt, artificial
  Chemically synthesized
gucuaccucucuccuuggu

SEQ ID NO: 388 - RNA, 19 nt, artificial
  Chemically synthesized
gagagagcuguauuaagug

SEQ ID NO: 389 - RNA, 19 nt, artificial
  Chemically synthesized
ucagcgagugcaugaacga

SEQ ID NO: 390 - RNA, 19 nt, artificial
  Chemically synthesized
cugcagcgggcgcagauga

SEQ ID NO: 391 - RNA, 19 nt, artificial
  Chemically synthesized
gccagcugauauaauggag

SEQ ID NO: 392 - RNA, 19 nt, artificial
  Chemically synthesized
gccaccuggccaacugcau

SEQ ID NO: 393 - RNA, 19 nt, artificial
  Chemically synthesized
cagaaagucaucaaagccu

SEQ ID NO: 394 - RNA, 19 nt, artificial
  Chemically synthesized
augugaugccaaagauguu

SEQ ID NO: 395 - RNA, 19 nt, artificial
  Chemically synthesized
cccagccagugucaacacg

SEQ ID NO: 396 - RNA, 19 nt, artificial
  Chemically synthesized
gcucuuaaaauaucuuccu

SEQ ID NO: 397 - RNA, 19 nt, artificial
  Chemically synthesized
gccagugucaacacgacac

SEQ ID NO: 398 - RNA, 19 nt, artificial
  Chemically synthesized
agugcaugaacgaggugac

SEQ ID NO: 399 - RNA, 19 nt, artificial
  Chemically synthesized
ugaaaacacugauuuugga

SEQ ID NO: 400 - RNA, 19 nt, artificial
  Chemically synthesized
caccuggccaacugcauga

SEQ ID NO: 401 - RNA, 19 nt, artificial
  Chemically synthesized
gaggugacccgcuuccugu

SEQ ID NO: 402 - RNA, 19 nt, artificial
  Chemically synthesized
cccgcuuccuguccacgug

SEQ ID NO: 403 - RNA, 19 nt, artificial
  Chemically synthesized
gaugccaaagauguuugaa

SEQ ID NO: 404 - RNA, 19 nt, artificial
  Chemically synthesized
cagccaggcuggagaggcg

SEQ ID NO: 405 - RNA, 19 nt, artificial
  Chemically synthesized
gagagcuguauuaagugac

SEQ ID NO: 406 - RNA, 19 nt, artificial
  Chemically synthesized
ugucaacacgacaccggau

SEQ ID NO: 407 - RNA, 19 nt, artificial
  Chemically synthesized
cgucuaccucucuccuugg

SEQ ID NO: 408 - RNA, 19 nt, artificial
  Chemically synthesized
aacugcaugacccagauca

SEQ ID NO: 409 - RNA, 19 nt, artificial
  Chemically synthesized
uggccaacugcaugaccca

SEQ ID NO: 410 - RNA, 19 nt, artificial
  Chemically synthesized
cagaugacauuucguuuuu

SEQ ID NO: 411 - RNA, 19 nt, artificial
  Chemically synthesized
agcuggugcugauaacagc

SEQ ID NO: 412 - RNA, 19 nt, artificial
  Chemically synthesized
ggaaccugcagcgggcgca

SEQ ID NO: 413 - RNA, 19 nt, artificial
  Chemically synthesized
ugaacgaggugacccgcuu

SEQ ID NO: 414 - RNA, 19 nt, artificial
  Chemically synthesized
ugagcacagaaagucauca

SEQ ID NO: 415 - RNA, 19 nt, artificial
  Chemically synthesized
aaaaugccagcugauauaa

SEQ ID NO: 416 - RNA, 19 nt, artificial
  Chemically synthesized
ucauauuggauugcgccuu

SEQ ID NO: 417 - RNA, 19 nt, artificial
  Chemically synthesized
gcugaaaacacugauuuug

SEQ ID NO: 418 - RNA, 19 nt, artificial
  Chemically synthesized
gugacccgcuuccugucca

SEQ ID NO: 419 - RNA, 19 nt, artificial
  Chemically synthesized
uguucauauuggauugcgc

SEQ ID NO: 420 - RNA, 19 nt, artificial
  Chemically synthesized
ugugaugccaaagauguuu

SEQ ID NO: 421 - RNA, 19 nt, artificial
  Chemically synthesized
gcaugaacgaggugacccg

SEQ ID NO: 422 - RNA, 19 nt, artificial
  Chemically synthesized
ugccagcugauauaaugga

SEQ ID NO: 423 - RNA, 19 nt, artificial
  Chemically synthesized
cggcuucagcgagugcaug

SEQ ID NO: 424 - RNA, 19 nt, artificial
  Chemically synthesized
cagcgagugcaugaacgag

SEQ ID NO: 425 - RNA, 19 nt, artificial
  Chemically synthesized
aguuacuuuuuguagagag

SEQ ID NO: 426 - RNA, 19 nt, artificial
  Chemically synthesized
agugaagcaccuccggaac

SEQ ID NO: 427 - RNA, 19 nt, artificial
  Chemically synthesized
gagcuguauuaagugacug

SEQ ID NO: 428 - RNA, 19 nt, artificial
  Chemically synthesized
gaaaacacugauuuuggau

SEQ ID NO: 429 - RNA, 19 nt, artificial
  Chemically synthesized
ugaugccaaagauguuuga

SEQ ID NO: 430 - RNA, 19 nt, artificial
  Chemically synthesized
uauuggauugcgccuuugu

SEQ ID NO: 431 - RNA, 19 nt, artificial
  Chemically synthesized
agcgagugcaugaacgagg

SEQ ID NO: 432 - RNA, 19 nt, artificial
  Chemically synthesized
aaaugccagcugauauaau

SEQ ID NO: 433 - RNA, 19 nt, artificial
  Chemically synthesized
gcuguauuaagugacugac

SEQ ID NO: 434 - RNA, 19 nt, artificial
  Chemically synthesized
ucugagcacagaaagucau

SEQ ID NO: 435 - RNA, 19 nt, artificial
  Chemically synthesized
gaaguuacuuuuuguagag

SEQ ID NO: 436 - RNA, 19 nt, artificial
  Chemically synthesized
aaugccagcugauauaaug

SEQ ID NO: 437 - RNA, 19 nt, artificial
  Chemically synthesized
aaagucaucaaagccuauu

SEQ ID NO: 438 - RNA, 19 nt, artificial
  Chemically synthesized
cuucagcgagugcaugaac

SEQ ID NO: 439 - RNA, 19 nt, artificial
  Chemically synthesized
ggagaaaaauuccucgucc

SEQ ID NO: 440 - RNA, 19 nt, artificial
  Chemically synthesized
cuaccucucuccuuggucc

SEQ ID NO: 441 - RNA, 19 nt, artificial
  Chemically synthesized
cuguauuaagugacugacc

SEQ ID NO: 442 - RNA, 19 nt, artificial
  Chemically synthesized
cauuucguuuuuuacacga

SEQ ID NO: 443 - RNA, 19 nt, artificial
  Chemically synthesized
gcaccuccggaaccugcag

SEQ ID NO: 444 - RNA, 19 nt, artificial
  Chemically synthesized
ugaagcaccuccggaaccu

SEQ ID NO: 445 - RNA, 19 nt, artificial
  Chemically synthesized
gaagcaccuccggaaccug

SEQ ID NO: 446 - RNA, 19 nt, artificial
  Chemically synthesized
aagugacugaccaugcacu

SEQ ID NO: 447 - RNA, 19 nt, artificial
  Chemically synthesized
cugagcacagaaagucauc

SEQ ID NO: 448 - RNA, 19 nt, artificial
  Chemically synthesized
auauuggauugcgccuuug

SEQ ID NO: 449 - RNA, 19 nt, artificial
  Chemically synthesized
gaacgaggugacccgcuuc

SEQ ID NO: 450 - RNA, 19 nt, artificial
  Chemically synthesized
gugaugccaaagauguuug

SEQ ID NO: 451 - RNA, 19 nt, artificial
  Chemically synthesized
aggugacccgcuuccuguc

SEQ ID NO: 452 - RNA, 19 nt, artificial
  Chemically synthesized
ccaccuggccaacugcaug

SEQ ID NO: 453 - RNA, 19 nt, artificial
  Chemically synthesized
cgucuacaccagcaacagc

SEQ ID NO: 454 - RNA, 19 nt, artificial
  Chemically synthesized
accugcagcgggcgcagau

SEQ ID NO: 455 - RNA, 19 nt, artificial
  Chemically synthesized
ucguuuuuuacacgagauu

SEQ ID NO: 456 - RNA, 19 nt, artificial
  Chemically synthesized
guucauauuggauugcgcc

SEQ ID NO: 457 - RNA, 19 nt, artificial
  Chemically synthesized
uucguuuuuuacacgagau

SEQ ID NO: 458 - RNA, 19 nt, artificial
  Chemically synthesized
uaugugaugccaaagaugu

SEQ ID NO: 459 - RNA, 19 nt, artificial
  Chemically synthesized
ggccaacugcaugacccag

SEQ ID NO: 460 - RNA, 19 nt, artificial
  Chemically synthesized
gacauuucguuuuuuacac

SEQ ID NO: 461 - RNA, 19 nt, artificial
  Chemically synthesized
cgagugcaugaacgaggug

SEQ ID NO: 462 - RNA, 19 nt, artificial
  Chemically synthesized
cgaggugcgcacucggcug

SEQ ID NO: 463 - RNA, 19 nt, artificial
  Chemically synthesized
ccugcagcgggcgcagaug

SEQ ID NO: 464 - RNA, 19 nt, artificial
  Chemically synthesized
cugaaaacacugauuuugg

SEQ ID NO: 465 - RNA, 19 nt, artificial
  Chemically synthesized
ggugcgcacucggcugcuc

SEQ ID NO: 466 - RNA, 19 nt, artificial
  Chemically synthesized
ccgaggugcgcacucggcu

SEQ ID NO: 467 - RNA, 19 nt, artificial
  Chemically synthesized
cagugucaacacgacaccg

SEQ ID NO: 468 - RNA, 19 nt, artificial
  Chemically synthesized
ccagugucaacacgacacc

SEQ ID NO: 469 - RNA, 19 nt, artificial
  Chemically synthesized
gagaaaaauuccucguccc

SEQ ID NO: 470 - RNA, 19 nt, artificial
  Chemically synthesized
uucagcgagugcaugaacg

SEQ ID NO: 471 - RNA, 19 nt, artificial
  Chemically synthesized
ccgcuuccuguccacgugc

SEQ ID NO: 472 - RNA, 19 nt, artificial
  Chemically synthesized
ggcagccaggcuggagagg

SEQ ID NO: 473 - RNA, 19 nt, artificial
  Chemically synthesized
ugcucuuaaaauaucuucc

SEQ ID NO: 474 - RNA, 19 nt, artificial
  Chemically synthesized
caacugcaugacccagauc

SEQ ID NO: 475 - RNA, 19 nt, artificial
  Chemically synthesized
cgaggugacccgcuuccug

SEQ ID NO: 476 - RNA, 19 nt, artificial
  Chemically synthesized
uuucguuuuuuacacgaga

SEQ ID NO: 477 - RNA, 19 nt, artificial
  Chemically synthesized
agccggcuucagcgagugc

SEQ ID NO: 478 - RNA, 19 nt, artificial
  Chemically synthesized
aauggagaaaaauuccucg

SEQ ID NO: 479 - RNA, 19 nt, artificial
  Chemically synthesized
cucuccuugguccuggaac

SEQ ID NO: 480 - RNA, 19 nt, artificial
  Chemically synthesized
ugacccgcuuccuguccac

SEQ ID NO: 481 - RNA, 19 nt, artificial
  Chemically synthesized
gugaagcaccuccggaacc

SEQ ID NO: 482 - RNA, 19 nt, artificial
  Chemically synthesized
uucauauuggauugcgccu

SEQ ID NO: 483 - RNA, 19 nt, artificial
  Chemically synthesized
gcagccaggcuggagaggc

SEQ ID NO: 484 - RNA, 19 nt, artificial
  Chemically synthesized
acccgcuuccuguccacgu

SEQ ID NO: 485 - RNA, 19 nt, artificial
  Chemically synthesized
uaauggagaaaaauuccuc

SEQ ID NO: 486 - RNA, 19 nt, artificial
  Chemically synthesized
cuccggaaccugcagcggg

SEQ ID NO: 487 - RNA, 19 nt, artificial
  Chemically synthesized
accuccggaaccugcagcg

SEQ ID NO: 488 - RNA, 19 nt, artificial
  Chemically synthesized
gcagcgggcgcagaugacg

SEQ ID NO: 489 - RNA, 19 nt, artificial
  Chemically synthesized
acagaaagucaucaaagcc

SEQ ID NO: 490 - RNA, 19 nt, artificial
  Chemically synthesized
auguucauauuggauugcg

SEQ ID NO: 491 - RNA, 19 nt, artificial
  Chemically synthesized
gugcaugaacgaggugacc

SEQ ID NO: 492 - RNA, 19 nt, artificial
  Chemically synthesized
uccggaaccugcagcgggc

SEQ ID NO: 493 - RNA, 19 nt, artificial
  Chemically synthesized
ucucuccuugguccuggaa

SEQ ID NO: 494 - RNA, 19 nt, artificial
  Chemically synthesized
acgaggugacccgcuuccu

SEQ ID NO: 495 - RNA, 19 nt, artificial
  Chemically synthesized
cggccaccuggccaacugc

SEQ ID NO: 496 - RNA, 19 nt, artificial
  Chemically synthesized
cuggccaacugcaugaccc

SEQ ID NO: 497 - RNA, 19 nt, artificial
  Chemically synthesized
uaccucucuccuugguccu

SEQ ID NO: 498 - RNA, 19 nt, artificial
  Chemically synthesized
uuuuaugugaugccaaaga

SEQ ID NO: 499 - RNA, 19 nt, artificial
  Chemically synthesized
ugcagcgggcgcagaugac

SEQ ID NO: 500 - RNA, 19 nt, artificial
  Chemically synthesized
uuaugugaugccaaagaug

SEQ ID NO: 501 - RNA, 19 nt, artificial
  Chemically synthesized
aaccugcagcgggcgcaga

SEQ ID NO: 502 - RNA, 19 nt, artificial
  Chemically synthesized
aggugcgcacucggcugcu

SEQ ID NO: 503 - RNA, 19 nt, artificial
  Chemically synthesized
ggugacccgcuuccugucc

SEQ ID NO: 504 - RNA, 19 nt, artificial
  Chemically synthesized
augccagcugauauaaugg

SEQ ID NO: 505 - RNA, 19 nt, artificial
  Chemically synthesized
uauuaagugacugaccaug

SEQ ID NO: 506 - RNA, 19 nt, artificial
  Chemically synthesized
augaacgaggugacccgcu

SEQ ID NO: 507 - RNA, 19 nt, artificial
  Chemically synthesized
aacacugauuuuggaugcu

SEQ ID NO: 508 - RNA, 19 nt, artificial
  Chemically synthesized
gaaccugcagcgggcgcag

SEQ ID NO: 509 - RNA, 19 nt, artificial
  Chemically synthesized
cugggcagccaggcuggag

SEQ ID NO: 510 - RNA, 19 nt, artificial
  Chemically synthesized
auggagaaaaauuccucgu

SEQ ID NO: 511 - RNA, 19 nt, artificial
  Chemically synthesized
ccucucuccuugguccugg

SEQ ID NO: 512 - RNA, 19 nt, artificial
  Chemically synthesized
uggagaaaaauuccucguc

SEQ ID NO: 513 - RNA, 19 nt, artificial
  Chemically synthesized
aaaacacugauuuuggaug

SEQ ID NO: 514 - RNA, 19 nt, artificial
  Chemically synthesized
caccuccggaaccugcagc

SEQ ID NO: 515 - RNA, 19 nt, artificial
  Chemically synthesized
ccuccggaaccugcagcgg

SEQ ID NO: 516 - RNA, 19 nt, artificial
  Chemically synthesized
auuaagugacugaccaugc

SEQ ID NO: 517 - RNA, 19 nt, artificial
  Chemically synthesized
acauuucguuuuuuacacg

SEQ ID NO: 518 - RNA, 19 nt, artificial
  Chemically synthesized
accucucuccuugguccug

SEQ ID NO: 519 - RNA, 19 nt, artificial
  Chemically synthesized
gacccgcuuccuguccacg

SEQ ID NO: 520 - RNA, 19 nt, artificial
  Chemically synthesized
ucuaccucucuccuugguc

SEQ ID NO: 521 - RNA, 19 nt, artificial
  Chemically synthesized
agugucaacacgacaccgg

SEQ ID NO: 522 - RNA, 19 nt, artificial
  Chemically synthesized
gaggugcgcacucggcugc

SEQ ID NO: 523 - RNA, 19 nt, artificial
  Chemically synthesized
aaacacugauuuuggaugc

SEQ ID NO: 524 - RNA, 19 nt, artificial
  Chemically synthesized
ugcaugaacgaggugaccc

SEQ ID NO: 525 - RNA, 19 nt, artificial
  Chemically synthesized
uauguucauauuggauugc

SEQ ID NO: 526 - RNA, 19 nt, artificial
  Chemically synthesized
ccuggccaacugcaugacc

SEQ ID NO: 527 - RNA, 19 nt, artificial
  Chemically synthesized
auuucguuuuuuacacgag

SEQ ID NO: 528 - RNA, 19 nt, artificial
  Chemically synthesized
caugaacgaggugacccgc

SEQ ID NO: 529 - RNA, 19 nt, artificial
  Chemically synthesized
uaagugacugaccaugcac

SEQ ID NO: 530 - RNA, 19 nt, artificial
  Chemically synthesized
aagcaccuccggaaccugc

SEQ ID NO: 531 - RNA, 19 nt, artificial
  Chemically synthesized
uaaaauaucuuccuuuggg

SEQ ID NO: 532 - RNA, 19 nt, artificial
  Chemically synthesized
uuuuuaugugaugccaaag

SEQ ID NO: 533 - RNA, 19 nt, artificial
  Chemically synthesized
accuggccaacugcaugac

SEQ ID NO: 534 - RNA, 19 nt, artificial
  Chemically synthesized
uaccgaggugcgcacucgg

SEQ ID NO: 535 - RNA, 19 nt, artificial
  Chemically synthesized
accgaggugcgcacucggc

SEQ ID NO: 536 - RNA, 19 nt, artificial
  Chemically synthesized
aacgaggugacccgcuucc

SEQ ID NO: 537 - RNA, 19 nt, artificial
  Chemically synthesized
cuuugaugacuuucugugc

SEQ ID NO: 538 - RNA, 19 nt, artificial
  Chemically synthesized
ugcagguuccggaggugcu

SEQ ID NO: 539 - RNA, 19 nt, artificial
  Chemically synthesized
auacaaaggcgcaauccaa

SEQ ID NO: 540 - RNA, 19 nt, artificial
  Chemically synthesized
ugcaguuggccagguggcc

SEQ ID NO: 541 - RNA, 19 nt, artificial
  Chemically synthesized
gcuuuuauaauacaaaggc

SEQ ID NO: 542 - RNA, 19 nt, artificial
  Chemically synthesized
gcuuugaugacuuucugug

SEQ ID NO: 543 - RNA, 19 nt, artificial
  Chemically synthesized
accaaggagagagguagac

SEQ ID NO: 544 - RNA, 19 nt, artificial
  Chemically synthesized
cacuuaauacagcucucuc

SEQ ID NO: 545 - RNA, 19 nt, artificial
  Chemically synthesized
ucguucaugcacucgcuga

SEQ ID NO: 546 - RNA, 19 nt, artificial
  Chemically synthesized
ucaucugcgcccgcugcag

SEQ ID NO: 547 - RNA, 19 nt, artificial
  Chemically synthesized
cuccauuauaucagcuggc

SEQ ID NO: 548 - RNA, 19 nt, artificial
  Chemically synthesized
augcaguuggccagguggc

SEQ ID NO: 549 - RNA, 19 nt, artificial
  Chemically synthesized
aggcuuugaugacuuucug

SEQ ID NO: 550 - RNA, 19 nt, artificial
  Chemically synthesized
aacaucuuuggcaucacau

SEQ ID NO: 551 - RNA, 19 nt, artificial
  Chemically synthesized
cguguugacacuggcuggg

SEQ ID NO: 552 - RNA, 19 nt, artificial
  Chemically synthesized
aggaagauauuuuaagagc

SEQ ID NO: 553 - RNA, 19 nt, artificial
  Chemically synthesized
gugucguguugacacuggc

SEQ ID NO: 554 - RNA, 19 nt, artificial
  Chemically synthesized
gucaccucguucaugcacu

SEQ ID NO: 555 - RNA, 19 nt, artificial
  Chemically synthesized
uccaaaaucaguguuuuca

SEQ ID NO: 556 - RNA, 19 nt, artificial
  Chemically synthesized
ucaugcaguuggccaggug

SEQ ID NO: 557 - RNA, 19 nt, artificial
  Chemically synthesized
acaggaagcgggucaccuc

SEQ ID NO: 558 - RNA, 19 nt, artificial
  Chemically synthesized
cacguggacaggaagcggg

SEQ ID NO: 559 - RNA, 19 nt, artificial
  Chemically synthesized
uucaaacaucuuuggcauc

SEQ ID NO: 560 - RNA, 19 nt, artificial
  Chemically synthesized
cgccucuccagccuggcug

SEQ ID NO: 561 - RNA, 19 nt, artificial
  Chemically synthesized
gucacuuaauacagcucuc

SEQ ID NO: 562 - RNA, 19 nt, artificial
  Chemically synthesized
auccggugucguguugaca

SEQ ID NO: 563 - RNA, 19 nt, artificial
  Chemically synthesized
ccaaggagagagguagacg

SEQ ID NO: 564 - RNA, 19 nt, artificial
  Chemically synthesized
ugaucugggucaugcaguu

SEQ ID NO: 565 - RNA, 19 nt, artificial
  Chemically synthesized
ugggucaugcaguuggcca

SEQ ID NO: 566 - RNA, 19 nt, artificial
  Chemically synthesized
aaaaacgaaaugucaucug

SEQ ID NO: 567 - RNA, 19 nt, artificial
  Chemically synthesized
gcuguuaucagcaccagcu

SEQ ID NO: 568 - RNA, 19 nt, artificial
  Chemically synthesized
ugcgcccgcugcagguucc

SEQ ID NO: 569 - RNA, 19 nt, artificial
  Chemically synthesized
aagcgggucaccucguuca

SEQ ID NO: 570 - RNA, 19 nt, artificial
  Chemically synthesized
ugaugacuuucugugcuca

SEQ ID NO: 571 - RNA, 19 nt, artificial
  Chemically synthesized
uuauaucagcuggcauuuu

SEQ ID NO: 572 - RNA, 19 nt, artificial
  Chemically synthesized
aaggcgcaauccaauauga

SEQ ID NO: 573 - RNA, 19 nt, artificial
  Chemically synthesized
caaaaucaguguuuucagc

SEQ ID NO: 574 - RNA, 19 nt, artificial
  Chemically synthesized
uggacaggaagcgggucac

SEQ ID NO: 575 - RNA, 19 nt, artificial
  Chemically synthesized
gcgcaauccaauaugaaca

SEQ ID NO: 576 - RNA, 19 nt, artificial
  Chemically synthesized
aaacaucuuuggcaucaca

SEQ ID NO: 577 - RNA, 19 nt, artificial
  Chemically synthesized
cgggucaccucguucaugc

SEQ ID NO: 578 - RNA, 19 nt, artificial
  Chemically synthesized
uccauuauaucagcuggca

SEQ ID NO: 579 - RNA, 19 nt, artificial
  Chemically synthesized
caugcacucgcugaagccg

SEQ ID NO: 580 - RNA, 19 nt, artificial
  Chemically synthesized
cucguucaugcacucgcug

SEQ ID NO: 581 - RNA, 19 nt, artificial
  Chemically synthesized
cucucuacaaaaaguaacu

SEQ ID NO: 582 - RNA, 19 nt, artificial
  Chemically synthesized
guuccggaggugcuucacu

SEQ ID NO: 583 - RNA, 19 nt, artificial
  Chemically synthesized
cagucacuuaauacagcuc

SEQ ID NO: 584 - RNA, 19 nt, artificial
  Chemically synthesized
auccaaaaucaguguuuuc

SEQ ID NO: 585 - RNA, 19 nt, artificial
  Chemically synthesized
ucaaacaucuuuggcauca

SEQ ID NO: 586 - RNA, 19 nt, artificial
  Chemically synthesized
acaaaggcgcaauccaaua

SEQ ID NO: 587 - RNA, 19 nt, artificial
  Chemically synthesized
ccucguucaugcacucgcu

SEQ ID NO: 588 - RNA, 19 nt, artificial
  Chemically synthesized
auuauaucagcuggcauuu

SEQ ID NO: 589 - RNA, 19 nt, artificial
  Chemically synthesized
gucagucacuuaauacagc

SEQ ID NO: 590 - RNA, 19 nt, artificial
  Chemically synthesized
augacuuucugugcucaga

SEQ ID NO: 591 - RNA, 19 nt, artificial
  Chemically synthesized
cucuacaaaaaguaacuuc

SEQ ID NO: 592 - RNA, 19 nt, artificial
  Chemically synthesized
cauuauaucagcuggcauu

SEQ ID NO: 593 - RNA, 19 nt, artificial
  Chemically synthesized
aauaggcuuugaugacuuu

SEQ ID NO: 594 - RNA, 19 nt, artificial
  Chemically synthesized
guucaugcacucgcugaag

SEQ ID NO: 595 - RNA, 19 nt, artificial
  Chemically synthesized
ggacgaggaauuuuucucc

SEQ ID NO: 596 - RNA, 19 nt, artificial
  Chemically synthesized
ggaccaaggagagagguag

SEQ ID NO: 597 - RNA, 19 nt, artificial
  Chemically synthesized
ggucagucacuuaauacag

SEQ ID NO: 598 - RNA, 19 nt, artificial
  Chemically synthesized
ucguguaaaaaacgaaaug

SEQ ID NO: 599 - RNA, 19 nt, artificial
  Chemically synthesized
cugcagguuccggaggugc

SEQ ID NO: 600 - RNA, 19 nt, artificial
  Chemically synthesized
agguuccggaggugcuuca

SEQ ID NO: 601 - RNA, 19 nt, artificial
  Chemically synthesized
cagguuccggaggugcuuc

SEQ ID NO: 602 - RNA, 19 nt, artificial
  Chemically synthesized
agugcauggucagucacuu

SEQ ID NO: 603 - RNA, 19 nt, artificial
  Chemically synthesized
gaugacuuucugugcucag

SEQ ID NO: 604 - RNA, 19 nt, artificial
  Chemically synthesized
caaaggcgcaauccaauau

SEQ ID NO: 605 - RNA, 19 nt, artificial
  Chemically synthesized
gaagcgggucaccucguuc

SEQ ID NO: 606 - RNA, 19 nt, artificial
  Chemically synthesized
caaacaucuuuggcaucac

SEQ ID NO: 607 - RNA, 19 nt, artificial
  Chemically synthesized
gacaggaagcgggucaccu

SEQ ID NO: 608 - RNA, 19 nt, artificial
  Chemically synthesized
caugcaguuggccaggugg

SEQ ID NO: 609 - RNA, 19 nt, artificial
  Chemically synthesized
gcuguugcugguguagacg

SEQ ID NO: 610 - RNA, 19 nt, artificial
  Chemically synthesized
aucugcgcccgcugcaggu

SEQ ID NO: 611 - RNA, 19 nt, artificial
  Chemically synthesized
aaucucguguaaaaaacga

SEQ ID NO: 612 - RNA, 19 nt, artificial
  Chemically synthesized
ggcgcaauccaauaugaac

SEQ ID NO: 613 - RNA, 19 nt, artificial
  Chemically synthesized
aucucguguaaaaaacgaa

SEQ ID NO: 614 - RNA, 19 nt, artificial
  Chemically synthesized
acaucuuuggcaucacaua

SEQ ID NO: 615 - RNA, 19 nt, artificial
  Chemically synthesized
cugggucaugcaguuggcc

SEQ ID NO: 616 - RNA, 19 nt, artificial
  Chemically synthesized
guguaaaaaacgaaauguc

SEQ ID NO: 617 - RNA, 19 nt, artificial
  Chemically synthesized
caccucguucaugcacucg

SEQ ID NO: 618 - RNA, 19 nt, artificial
  Chemically synthesized
cagccgagugcgcaccucg

SEQ ID NO: 619 - RNA, 19 nt, artificial
  Chemically synthesized
caucugcgcccgcugcagg

SEQ ID NO: 620 - RNA, 19 nt, artificial
  Chemically synthesized
ccaaaaucaguguuuucag

SEQ ID NO: 621 - RNA, 19 nt, artificial
  Chemically synthesized
gagcagccgagugcgcacc

SEQ ID NO: 622 - RNA, 19 nt, artificial
  Chemically synthesized
agccgagugcgcaccucgg

SEQ ID NO: 623 - RNA, 19 nt, artificial
  Chemically synthesized
cggugucguguugacacug

SEQ ID NO: 624 - RNA, 19 nt, artificial
  Chemically synthesized
ggugucguguugacacugg

SEQ ID NO: 625 - RNA, 19 nt, artificial
  Chemically synthesized
gggacgaggaauuuuucuc

SEQ ID NO: 626 - RNA, 19 nt, artificial
  Chemically synthesized
cguucaugcacucgcugaa

SEQ ID NO: 627 - RNA, 19 nt, artificial
  Chemically synthesized
gcacguggacaggaagcgg

SEQ ID NO: 628 - RNA, 19 nt, artificial
  Chemically synthesized
ccucuccagccuggcugcc

SEQ ID NO: 629 - RNA, 19 nt, artificial
  Chemically synthesized
ggaagauauuuuaagagca

SEQ ID NO: 630 - RNA, 19 nt, artificial
  Chemically synthesized
gaucugggucaugcaguug

SEQ ID NO: 631 - RNA, 19 nt, artificial
  Chemically synthesized
caggaagcgggucaccucg

SEQ ID NO: 632 - RNA, 19 nt, artificial
  Chemically synthesized
ucucguguaaaaaacgaaa

SEQ ID NO: 633 - RNA, 19 nt, artificial
  Chemically synthesized
gcacucgcugaagccggcu

SEQ ID NO: 634 - RNA, 19 nt, artificial
  Chemically synthesized
cgaggaauuuuucuccauu

SEQ ID NO: 635 - RNA, 19 nt, artificial
  Chemically synthesized
guuccaggaccaaggagag

SEQ ID NO: 636 - RNA, 19 nt, artificial
  Chemically synthesized
guggacaggaagcggguca

SEQ ID NO: 637 - RNA, 19 nt, artificial
  Chemically synthesized
gguuccggaggugcuucac

SEQ ID NO: 638 - RNA, 19 nt, artificial
  Chemically synthesized
aggcgcaauccaauaugaa

SEQ ID NO: 639 - RNA, 19 nt, artificial
  Chemically synthesized
gccucuccagccuggcugc

SEQ ID NO: 640 - RNA, 19 nt, artificial
  Chemically synthesized
acguggacaggaagcgggu

SEQ ID NO: 641 - RNA, 19 nt, artificial
  Chemically synthesized
gaggaauuuuucuccauua

SEQ ID NO: 642 - RNA, 19 nt, artificial
  Chemically synthesized
cccgcugcagguuccggag

SEQ ID NO: 643 - RNA, 19 nt, artificial
  Chemically synthesized
cgcugcagguuccggaggu

SEQ ID NO: 644 - RNA, 19 nt, artificial
  Chemically synthesized
cgucaucugcgcccgcugc

SEQ ID NO: 645 - RNA, 19 nt, artificial
  Chemically synthesized
ggcuuugaugacuuucugu

SEQ ID NO: 646 - RNA, 19 nt, artificial
  Chemically synthesized
cgcaauccaauaugaacau

SEQ ID NO: 647 - RNA, 19 nt, artificial
  Chemically synthesized
ggucaccucguucaugcac

SEQ ID NO: 648 - RNA, 19 nt, artificial
  Chemically synthesized
gcccgcugcagguuccgga

SEQ ID NO: 649 - RNA, 19 nt, artificial
  Chemically synthesized
uuccaggaccaaggagaga

SEQ ID NO: 650 - RNA, 19 nt, artificial
  Chemically synthesized
aggaagcgggucaccucgu

SEQ ID NO: 651 - RNA, 19 nt, artificial
  Chemically synthesized
gcaguuggccagguggccg

SEQ ID NO: 652 - RNA, 19 nt, artificial
  Chemically synthesized
gggucaugcaguuggccag

SEQ ID NO: 653 - RNA, 19 nt, artificial
  Chemically synthesized
aggaccaaggagagaggua

SEQ ID NO: 654 - RNA, 19 nt, artificial
  Chemically synthesized
ucuuuggcaucacauaaaa

SEQ ID NO: 655 - RNA, 19 nt, artificial
  Chemically synthesized
gucaucugcgcccgcugca

SEQ ID NO: 656 - RNA, 19 nt, artificial
  Chemically synthesized
caucuuuggcaucacauaa

SEQ ID NO: 657 - RNA, 19 nt, artificial
  Chemically synthesized
ucugcgcccgcugcagguu

SEQ ID NO: 658 - RNA, 19 nt, artificial
  Chemically synthesized
agcagccgagugcgcaccu

SEQ ID NO: 659 - RNA, 19 nt, artificial
  Chemically synthesized
ggacaggaagcgggucacc

SEQ ID NO: 660 - RNA, 19 nt, artificial
  Chemically synthesized
ccauuauaucagcuggcau

SEQ ID NO: 661 - RNA, 19 nt, artificial
  Chemically synthesized
cauggucagucacuuaaua

SEQ ID NO: 662 - RNA, 19 nt, artificial
  Chemically synthesized
agcgggucaccucguucau

SEQ ID NO: 663 - RNA, 19 nt, artificial
  Chemically synthesized
agcauccaaaaucaguguu

SEQ ID NO: 664 - RNA, 19 nt, artificial
  Chemically synthesized
cugcgcccgcugcagguuc

SEQ ID NO: 665 - RNA, 19 nt, artificial
  Chemically synthesized
cuccagccuggcugcccag

SEQ ID NO: 666 - RNA, 19 nt, artificial
  Chemically synthesized
acgaggaauuuuucuccau

SEQ ID NO: 667 - RNA, 19 nt, artificial
  Chemically synthesized
ccaggaccaaggagagagg

SEQ ID NO: 668 - RNA, 19 nt, artificial
  Chemically synthesized
gacgaggaauuuuucucca

SEQ ID NO: 669 - RNA, 19 nt, artificial
  Chemically synthesized
cauccaaaaucaguguuuu

SEQ ID NO: 670 - RNA, 19 nt, artificial
  Chemically synthesized
gcugcagguuccggaggug

SEQ ID NO: 671 - RNA, 19 nt, artificial
  Chemically synthesized
ccgcugcagguuccggagg

SEQ ID NO: 672 - RNA, 19 nt, artificial
  Chemically synthesized
gcauggucagucacuuaau

SEQ ID NO: 673 - RNA, 19 nt, artificial
  Chemically synthesized
cguguaaaaaacgaaaugu

SEQ ID NO: 674 - RNA, 19 nt, artificial
  Chemically synthesized
caggaccaaggagagaggu

SEQ ID NO: 675 - RNA, 19 nt, artificial
  Chemically synthesized
cguggacaggaagcggguc

SEQ ID NO: 676 - RNA, 19 nt, artificial
  Chemically synthesized
gaccaaggagagagguaga

SEQ ID NO: 677 - RNA, 19 nt, artificial
  Chemically synthesized
ccggugucguguugacacu

SEQ ID NO: 678 - RNA, 19 nt, artificial
  Chemically synthesized
gcagccgagugcgcaccuc

SEQ ID NO: 679 - RNA, 19 nt, artificial
  Chemically synthesized
gcauccaaaaucaguguuu

SEQ ID NO: 680 - RNA, 19 nt, artificial
  Chemically synthesized
gggucaccucguucaugca

SEQ ID NO: 681 - RNA, 19 nt, artificial
  Chemically synthesized
gcaauccaauaugaacaua

SEQ ID NO: 682 - RNA, 19 nt, artificial
  Chemically synthesized
ggucaugcaguuggccagg

SEQ ID NO: 683 - RNA, 19 nt, artificial
  Chemically synthesized
cucguguaaaaaacgaaau

SEQ ID NO: 684 - RNA, 19 nt, artificial
  Chemically synthesized
gcgggucaccucguucaug

SEQ ID NO: 685 - RNA, 19 nt, artificial
  Chemically synthesized
gugcauggucagucacuua

SEQ ID NO: 686 - RNA, 19 nt, artificial
  Chemically synthesized
gcagguuccggaggugcuu

SEQ ID NO: 687 - RNA, 19 nt, artificial
  Chemically synthesized
cccaaaggaagauauuuua

SEQ ID NO: 688 - RNA, 19 nt, artificial
  Chemically synthesized
cuuuggcaucacauaaaaa

SEQ ID NO: 689 - RNA, 19 nt, artificial
  Chemically synthesized
gucaugcaguuggccaggu

SEQ ID NO: 690 - RNA, 19 nt, artificial
  Chemically synthesized
ccgagugcgcaccucggua

SEQ ID NO: 691 - RNA, 19 nt, artificial
  Chemically synthesized
gccgagugcgcaccucggu

SEQ ID NO: 692 - RNA, 19 nt, Artificial Sequence
  Chemically synthesized
ggaagcgggucaccucguu

SEQ ID NO: 693 - RNA, 18 nt, artificial
  Chemically synthesized
ggagaaggcggacauucu

SEQ ID NO: 694 - RNA, 18 nt, artificial
  Chemically synthesized
agccuauuauggagaaaa

SEQ ID NO: 695 - RNA, 18 nt, artificial
  Chemically synthesized
cggacauucuggaaauga

SEQ ID NO: 696 - RNA, 18 nt, artificial
  Chemically synthesized
ccgucuaccucucuccuu

SEQ ID NO: 697 - RNA, 18 nt, artificial
  Chemically synthesized
gcacuugcucaguaguuu

SEQ ID NO: 698 - RNA, 18 nt, artificial
  Chemically synthesized
uggagaaggcggacauuc

SEQ ID NO: 699 - RNA, 18 nt, artificial
  Chemically synthesized
ccaaguagccacaaaaua

SEQ ID NO: 700 - RNA, 18 nt, artificial
  Chemically synthesized
gacugaccaugcacuaua

SEQ ID NO: 701 - RNA, 18 nt, artificial
  Chemically synthesized
ccaguuugcuuuccucau

SEQ ID NO: 702 - RNA, 18 nt, artificial
  Chemically synthesized
cuggagaaggcggacauu

SEQ ID NO: 703 - RNA, 18 nt, artificial
  Chemically synthesized
gggcagccaggcuggaga

SEQ ID NO: 704 - RNA, 18 nt, artificial
  Chemically synthesized
gcuggagaaggcggacau

SEQ ID NO: 705 - RNA, 18 nt, artificial
  Chemically synthesized
cggcuaagguguuuggag

SEQ ID NO: 706 - RNA, 18 nt, artificial
  Chemically synthesized
ggcggacauucuggaaau

SEQ ID NO: 707 - RNA, 18 nt, artificial
  Chemically synthesized
cagccagugucaacacga

SEQ ID NO: 708 - RNA, 18 nt, artificial
  Chemically synthesized
caguuugcuuuccucauu

SEQ ID NO: 709 - RNA, 18 nt, artificial
  Chemically synthesized
aggcggacauucuggaaa

SEQ ID NO: 710 - RNA, 18 nt, artificial
  Chemically synthesized
cuauuauggagaaaagac

SEQ ID NO: 711 - RNA, 18 nt, artificial
  Chemically synthesized
agcuggagaaggcggaca

SEQ ID NO: 712 - RNA, 18 nt, artificial
  Chemically synthesized
ccuauuauggagaaaaga

SEQ ID NO: 713 - RNA, 18 nt, artificial
  Chemically synthesized
ccaacgcagugucaccuu

SEQ ID NO: 714 - RNA, 18 nt, artificial
  Chemically synthesized
gggagagaagaggacuuu

SEQ ID NO: 715 - RNA, 18 nt, artificial
  Chemically synthesized
gucugagccagcugaaaa

SEQ ID NO: 716 - RNA, 18 nt, artificial
  Chemically synthesized
gccaguuugcuuuccuca

SEQ ID NO: 717 - RNA, 18 nt, artificial
  Chemically synthesized
agcugaaaacacugauuu

SEQ ID NO: 718 - RNA, 18 nt, artificial
  Chemically synthesized
ggaaguaccgagccggcu

SEQ ID NO: 719 - RNA, 18 nt, artificial
  Chemically synthesized
cgugaagaacuccaaaaa

SEQ ID NO: 720 - RNA, 18 nt, artificial
  Chemically synthesized
ggagagaagaggacuuuu

SEQ ID NO: 721 - RNA, 18 nt, artificial
  Chemically synthesized
ccggauaaaccaaagaca

SEQ ID NO: 722 - RNA, 18 nt, artificial
  Chemically synthesized
ggaaaaugccagcugaua

SEQ ID NO: 723 - RNA, 18 nt, artificial
  Chemically synthesized
gagaaggcggacauucug

SEQ ID NO: 724 - RNA, 18 nt, artificial
  Chemically synthesized
cguuuuuuacacgagauu

SEQ ID NO: 725 - RNA, 18 nt, artificial
  Chemically synthesized
ccggcuucagcgagugca

SEQ ID NO: 726 - RNA, 18 nt, artificial
  Chemically synthesized
caccaaguagccacaaaa

SEQ ID NO: 727 - RNA, 18 nt, artificial
  Chemically synthesized
cgcugagcacagacccaa

SEQ ID NO: 728 - RNA, 18 nt, artificial
  Chemically synthesized
gaauacugggagagaaga

SEQ ID NO: 729 - RNA, 18 nt, artificial
  Chemically synthesized
ggagaggcggcuaaggug

SEQ ID NO: 730 - RNA, 18 nt, artificial
  Chemically synthesized
gguguuuggaggcuucca

SEQ ID NO: 731 - RNA, 18 nt, artificial
  Chemically synthesized
gcacagaaagucaucaaa

SEQ ID NO: 732 - RNA, 18 nt, artificial
  Chemically synthesized
cucagcacuugcucagua

SEQ ID NO: 733 - RNA, 18 nt, artificial
  Chemically synthesized
guaguuuugugaaagucu

SEQ ID NO: 734 - RNA, 18 nt, artificial
  Chemically synthesized
ggaacuugaauacuggga

SEQ ID NO: 735 - RNA, 18 nt, artificial
  Chemically synthesized
gaaguaccgagccggcuu

SEQ ID NO: 736 - RNA, 18 nt, artificial
  Chemically synthesized
agagagagcuguauuaag

SEQ ID NO: 737 - RNA, 18 nt, artificial
  Chemically synthesized
ccaacugcaugacccaga

SEQ ID NO: 738 - RNA, 18 nt, artificial
  Chemically synthesized
gccaaagauguuugaaaa

SEQ ID NO: 739 - RNA, 18 nt, artificial
  Chemically synthesized
cacagaaagucaucaaag

SEQ ID NO: 740 - RNA, 18 nt, artificial
  Chemically synthesized
ccgucuacaccagcaaca

SEQ ID NO: 741 - RNA, 18 nt, artificial
  Chemically synthesized
gucaucaaagccuauuau

SEQ ID NO: 742 - RNA, 18 nt, artificial
  Chemically synthesized
gcggcuaagguguuugga

SEQ ID NO: 743 - RNA, 18 nt, artificial
  Chemically synthesized
gccagcugauauaaugga

SEQ ID NO: 744 - RNA, 18 nt, artificial
  Chemically synthesized
cgaagagcaagaauaaau

SEQ ID NO: 745 - RNA, 18 nt, artificial
  Chemically synthesized
cggauaaaccaaagacag

SEQ ID NO: 746 - RNA, 18 nt, artificial
  Chemically synthesized
cggagcuggugcugauaa

SEQ ID NO: 747 - RNA, 18 nt, artificial
  Chemically synthesized
gccagugucaacacgaca

SEQ ID NO: 748 - RNA, 18 nt, artificial
  Chemically synthesized
gauguuugaaaaugcucu

SEQ ID NO: 749 - RNA, 18 nt, artificial
  Chemically synthesized
agugcaugaacgagguga

SEQ ID NO: 750 - RNA, 18 nt, artificial
  Chemically synthesized
ccaaagacagcaucugag

SEQ ID NO: 751 - RNA, 18 nt, artificial
  Chemically synthesized
ccaugcacuauauuugua

SEQ ID NO: 752 - RNA, 18 nt, artificial
  Chemically synthesized
cgagccggcuucagcgag

SEQ ID NO: 753 - RNA, 18 nt, artificial
  Chemically synthesized
gagagagcuguauuaagu

SEQ ID NO: 754 - RNA, 18 nt, artificial
  Chemically synthesized
ugcugauaacagcggaau

SEQ ID NO: 755 - RNA, 18 nt, artificial
  Chemically synthesized
gauugcgccuuuguauua

SEQ ID NO: 756 - RNA, 18 nt, artificial
  Chemically synthesized
ggugguaccggcucccga

SEQ ID NO: 757 - RNA, 18 nt, artificial
  Chemically synthesized
agaaaagacgaagagcaa

SEQ ID NO: 758 - RNA, 18 nt, artificial
  Chemically synthesized
gagagcuguauuaaguga

SEQ ID NO: 759 - RNA, 18 nt, artificial
  Chemically synthesized
agucaucaaagccuauua

SEQ ID NO: 760 - RNA, 18 nt, artificial
  Chemically synthesized
cauauuggauugcgccuu

SEQ ID NO: 761 - RNA, 18 nt, artificial
  Chemically synthesized
cucugaagaaagauagcu

SEQ ID NO: 762 - RNA, 18 nt, artificial
  Chemically synthesized
guauuaagugacugacca

SEQ ID NO: 763 - RNA, 18 nt, artificial
  Chemically synthesized
gagagaagaggacuuuuu

SEQ ID NO: 764 - RNA, 18 nt, artificial
  Chemically synthesized
ggcuggagaggcggcuaa

SEQ ID NO: 765 - RNA, 18 nt, artificial
  Chemically synthesized
cucaguaguuuugugaaa

SEQ ID NO: 766 - RNA, 18 nt, artificial
  Chemically synthesized
gcaucugagcacagaaag

SEQ ID NO: 767 - RNA, 18 nt, artificial
  Chemically synthesized
gacaccggauaaaccaaa

SEQ ID NO: 768 - RNA, 18 nt, artificial
  Chemically synthesized
ggccguggcggaacugag

SEQ ID NO: 769 - RNA, 18 nt, artificial
  Chemically synthesized
cccuccggacucuaaaca

SEQ ID NO: 770 - RNA, 18 nt, artificial
  Chemically synthesized
ggcuaagguguuuggagg

SEQ ID NO: 771 - RNA, 18 nt, artificial
  Chemically synthesized
agcgcuacugaucaccaa

SEQ ID NO: 772 - RNA, 18 nt, artificial
  Chemically synthesized
agugguuacuuuguguuu

SEQ ID NO: 773 - RNA, 18 nt, artificial
  Chemically synthesized
ugaccaugcacuauauuu

SEQ ID NO: 774 - RNA, 18 nt, artificial
  Chemically synthesized
gggcguuaauaccgaggu

SEQ ID NO: 775 - RNA, 18 nt, artificial
  Chemically synthesized
gagccagcugaaaacacu

SEQ ID NO: 776 - RNA, 18 nt, artificial
  Chemically synthesized
uaagguguuuggaggcuu

SEQ ID NO: 777 - RNA, 18 nt, artificial
  Chemically synthesized
gaggcuuccaggugguac

SEQ ID NO: 778 - RNA, 18 nt, artificial
  Chemically synthesized
gcgagugcaugaacgagg

SEQ ID NO: 779 - RNA, 18 nt, artificial
  Chemically synthesized
gagccggcuucagcgagu

SEQ ID NO: 780 - RNA, 18 nt, artificial
  Chemically synthesized
agagaagaggacuuuuuu

SEQ ID NO: 781 - RNA, 18 nt, artificial
  Chemically synthesized
ggaaaugacagugaagca

SEQ ID NO: 782 - RNA, 18 nt, artificial
  Chemically synthesized
agcacuugcucaguaguu

SEQ ID NO: 783 - RNA, 18 nt, artificial
  Chemically synthesized
agcgagugcaugaacgag

SEQ ID NO: 784 - RNA, 18 nt, artificial
  Chemically synthesized
agcuggugcugauaacag

SEQ ID NO: 785 - RNA, 18 nt, artificial
  Chemically synthesized
cgucuaccucucuccuug

SEQ ID NO: 786 - RNA, 18 nt, artificial
  Chemically synthesized
cccgcuuccuguccacgu

SEQ ID NO: 787 - RNA, 18 nt, artificial
  Chemically synthesized
gugguuacuuuguguuuu

SEQ ID NO: 788 - RNA, 18 nt, artificial
  Chemically synthesized
ccagcugaaaacacugau

SEQ ID NO: 789 - RNA, 18 nt, artificial
  Chemically synthesized
cuugcucaguaguuuugu

SEQ ID NO: 790 - RNA, 18 nt, artificial
  Chemically synthesized
gauuuuggaugcucugaa

SEQ ID NO: 791 - RNA, 18 nt, artificial
  Chemically synthesized
agucucaaguaaaagaga

SEQ ID NO: 792 - RNA, 18 nt, artificial
  Chemically synthesized
aguuugcuuuccucauuc

SEQ ID NO: 793 - RNA, 18 nt, artificial
  Chemically synthesized
ggaugcucugaagaaaga

SEQ ID NO: 794 - RNA, 18 nt, artificial
  Chemically synthesized
cugaccaugcacuauauu

SEQ ID NO: 795 - RNA, 18 nt, artificial
  Chemically synthesized
ggcugcgcugagcacaga

SEQ ID NO: 796 - RNA, 18 nt, artificial
  Chemically synthesized
agcaucugagcacagaaa

SEQ ID NO: 797 - RNA, 18 nt, artificial
  Chemically synthesized
ccuccggacucuaaacag

SEQ ID NO: 798 - RNA, 18 nt, artificial
  Chemically synthesized
gaacagcgcuacugauca

SEQ ID NO: 799 - RNA, 18 nt, artificial
  Chemically synthesized
acgaagagcaagaauaaa

SEQ ID NO: 800 - RNA, 18 nt, artificial
  Chemically synthesized
cccaacgcagugucaccu

SEQ ID NO: 801 - RNA, 18 nt, artificial
  Chemically synthesized
cgauggccaguuugcuuu

SEQ ID NO: 802 - RNA, 18 nt, artificial
  Chemically synthesized
gaaagucaucaaagccua

SEQ ID NO: 803 - RNA, 18 nt, artificial
  Chemically synthesized
gacauucuggaaaugaca

SEQ ID NO: 804 - RNA, 18 nt, artificial
  Chemically synthesized
cuaagguguuuggaggcu

SEQ ID NO: 805 - RNA, 18 nt, artificial
  Chemically synthesized
uggagaggcggcuaaggu

SEQ ID NO: 806 - RNA, 18 nt, artificial
  Chemically synthesized
cgcagugucaccuuccag

SEQ ID NO: 807 - RNA, 18 nt, artificial
  Chemically synthesized
gcuacugaucaccaagua

SEQ ID NO: 808 - RNA, 18 nt, artificial
  Chemically synthesized
gcaugaacgaggugaccc

SEQ ID NO: 809 - RNA, 18 nt, artificial
  Chemically synthesized
gagcacagacccaagugu

SEQ ID NO: 810 - RNA, 18 nt, artificial
  Chemically synthesized
uggauugcgccuuuguau

SEQ ID NO: 811 - RNA, 18 nt, artificial
  Chemically synthesized
cucucuucccuccggacu

SEQ ID NO: 812 - RNA, 18 nt, artificial
  Chemically synthesized
uguucauauuggauugcg

SEQ ID NO: 813 - RNA, 18 nt, artificial
  Chemically synthesized
gcaugacccagaucaaug

SEQ ID NO: 814 - RNA, 18 nt, artificial
  Chemically synthesized
aucaaagccuauuaugga

SEQ ID NO: 815 - RNA, 18 nt, artificial
  Chemically synthesized
gagaggcggcuaaggugu

SEQ ID NO: 816 - RNA, 18 nt, artificial
  Chemically synthesized
caagcuggagaaggcgga

SEQ ID NO: 817 - RNA, 18 nt, artificial
  Chemically synthesized
gaaaugacagugaagcac

SEQ ID NO: 818 - RNA, 18 nt, artificial
  Chemically synthesized
cccagccagugucaacac

SEQ ID NO: 819 - RNA, 18 nt, artificial
  Chemically synthesized
cgugcgagggcguuaaua

SEQ ID NO: 820 - RNA, 18 nt, artificial
  Chemically synthesized
ggcggacuccauguggag

SEQ ID NO: 821 - RNA, 18 nt, artificial
  Chemically synthesized
gguccuggaacagcgcua

SEQ ID NO: 822 - RNA, 18 nt, artificial
  Chemically synthesized
gaccaugcacuauauuug

SEQ ID NO: 823 - RNA, 18 nt, artificial
  Chemically synthesized
caacgcagugucaccuuc

SEQ ID NO: 824 - RNA, 18 nt, artificial
  Chemically synthesized
cugggagagaagaggacu

SEQ ID NO: 825 - RNA, 18 nt, artificial
  Chemically synthesized
cagcgagugcaugaacga

SEQ ID NO: 826 - RNA, 18 nt, artificial
  Chemically synthesized
agagcuguauuaagugac

SEQ ID NO: 827 - RNA, 18 nt, artificial
  Chemically synthesized
gcuguauuaagugacuga

SEQ ID NO: 828 - RNA, 18 nt, artificial
  Chemically synthesized
cagccaggcuggagaggc

SEQ ID NO: 829 - RNA, 18 nt, artificial
  Chemically synthesized
gcagugucaccuuccagc

SEQ ID NO: 830 - RNA, 18 nt, artificial
  Chemically synthesized
gcugaaaacacugauuuu

SEQ ID NO: 831 - RNA, 18 nt, artificial
  Chemically synthesized
gacucuaaacaggaacuu

SEQ ID NO: 832 - RNA, 18 nt, artificial
  Chemically synthesized
cccagaucaaugccauga

SEQ ID NO: 833 - RNA, 18 nt, artificial
  Chemically synthesized
gcuuccaggugguaccgg

SEQ ID NO: 834 - RNA, 18 nt, artificial
  Chemically synthesized
ccuugguccuggaacagc

SEQ ID NO: 835 - RNA, 18 nt, artificial
  Chemically synthesized
cggcggacuccaugugga

SEQ ID NO: 836 - RNA, 18 nt, artificial
  Chemically synthesized
cacugauuuuggaugcuc

SEQ ID NO: 837 - RNA, 18 nt, artificial
  Chemically synthesized
ucuggaaaugacagugaa

SEQ ID NO: 838 - RNA, 18 nt, artificial
  Chemically synthesized
ggaggcuuccagguggua

SEQ ID NO: 839 - RNA, 18 nt, artificial
  Chemically synthesized
cugcaugacccagaucaa

SEQ ID NO: 840 - RNA, 18 nt, artificial
  Chemically synthesized
gaucaaugccaugaccua

SEQ ID NO: 841 - RNA, 18 nt, artificial
  Chemically synthesized
cacuugcucaguaguuuu

SEQ ID NO: 842 - RNA, 18 nt, artificial
  Chemically synthesized
cagcugaaaacacugauu

SEQ ID NO: 843 - RNA, 18 nt, artificial
  Chemically synthesized
ccgauggccaguuugcuu

SEQ ID NO: 844 - RNA, 18 nt, artificial
  Chemically synthesized
accaaagacagcaucuga

SEQ ID NO: 845 - RNA, 18 nt, artificial
  Chemically synthesized
ugcuuuccucauucccaa

SEQ ID NO: 846 - RNA, 18 nt, artificial
  Chemically synthesized
gacccagaucaaugccau

SEQ ID NO: 847 - RNA, 18 nt, artificial
  Chemically synthesized
gauaaaccaaagacagca

SEQ ID NO: 848 - RNA, 18 nt, artificial
  Chemically synthesized
cggcuucagcgagugcau

SEQ ID NO: 849 - RNA, 18 nt, artificial
  Chemically synthesized
cgcuuacggcggacucca

SEQ ID NO: 850 - RNA, 18 nt, artificial
  Chemically synthesized
ggagaaaaauuccucguc

SEQ ID NO: 851 - RNA, 18 nt, artificial
  Chemically synthesized
cuaccucucuccuugguc

SEQ ID NO: 852 - RNA, 18 nt, artificial
  Chemically synthesized
gaagaaagauagcucgcg

SEQ ID NO: 853 - RNA, 18 nt, artificial
  Chemically synthesized
agacagcaucugagcaca

SEQ ID NO: 854 - RNA, 18 nt, artificial
  Chemically synthesized
cugcaagcugggcagcca

SEQ ID NO: 855 - RNA, 18 nt, artificial
  Chemically synthesized
cugaucaccaaguagcca

SEQ ID NO: 856 - RNA, 18 nt, artificial
  Chemically synthesized
gagcuguauuaagugacu

SEQ ID NO: 857 - RNA, 18 nt, artificial
  Chemically synthesized
auuccaagcuggagaagg

SEQ ID NO: 858 - RNA, 18 nt, artificial
  Chemically synthesized
cuguauuaagugacugac

SEQ ID NO: 859 - RNA, 18 nt, artificial
  Chemically synthesized
uugaauacugggagagaa

SEQ ID NO: 860 - RNA, 18 nt, artificial
  Chemically synthesized
cagcacuugcucaguagu

SEQ ID NO: 861 - RNA, 18 nt, artificial
  Chemically synthesized
gcaccuccggaaccugca

SEQ ID NO: 862 - RNA, 18 nt, artificial
  Chemically synthesized
agauguuugaaaaugcuc

SEQ ID NO: 863 - RNA, 18 nt, artificial
  Chemically synthesized
aaagauagcucgcggcau

SEQ ID NO: 864 - RNA, 18 nt, artificial
  Chemically synthesized
auccggagcuggugcuga

SEQ ID NO: 865 - RNA, 18 nt, artificial
  Chemically synthesized
acaggaacuugaauacug

SEQ ID NO: 866 - RNA, 18 nt, artificial
  Chemically synthesized
gcugauaacagcggaauc

SEQ ID NO: 867 - RNA, 18 nt, artificial
  Chemically synthesized
ugcaugacccagaucaau

SEQ ID NO: 868 - RNA, 18 nt, artificial
  Chemically synthesized
cauucuggaaaugacagu

SEQ ID NO: 869 - RNA, 18 nt, artificial
  Chemically synthesized
aaaccaaagacagcaucu

SEQ ID NO: 870 - RNA, 18 nt, artificial
  Chemically synthesized
uggagaaaagacgaagag

SEQ ID NO: 871 - RNA, 18 nt, artificial
  Chemically synthesized
uagagagagcuguauuaa

SEQ ID NO: 872 - RNA, 18 nt, artificial
  Chemically synthesized
agugaagcaccuccggaa

SEQ ID NO: 873 - RNA, 18 nt, artificial
  Chemically synthesized
uggccaguuugcuuuccu

SEQ ID NO: 874 - RNA, 18 nt, artificial
  Chemically synthesized
cggacucuaaacaggaac

SEQ ID NO: 875 - RNA, 18 nt, artificial
  Chemically synthesized
ucaucaaagccuauuaug

SEQ ID NO: 876 - RNA, 18 nt, artificial
  Chemically synthesized
aaugccagcugauauaau

SEQ ID NO: 877 - RNA, 18 nt, artificial
  Chemically synthesized
gcgcuacugaucaccaag

SEQ ID NO: 878 - RNA, 18 nt, artificial
  Chemically synthesized
ccagaucaaugccaugac

SEQ ID NO: 879 - RNA, 18 nt, artificial
  Chemically synthesized
cuuuuuguagagagagcu

SEQ ID NO: 880 - RNA, 18 nt, artificial
  Chemically synthesized
gcguuaauaccgaggugc

SEQ ID NO: 881 - RNA, 18 nt, artificial
  Chemically synthesized
cuggaacagcgcuacuga

SEQ ID NO: 882 - RNA, 18 nt, artificial
  Chemically synthesized
gaggcggcuaagguguuu

SEQ ID NO: 883 - RNA, 18 nt, artificial
  Chemically synthesized
augcucugaagaaagaua

SEQ ID NO: 884 - RNA, 18 nt, artificial
  Chemically synthesized
uacuuuuuguagagagag

SEQ ID NO: 885 - RNA, 18 nt, artificial
  Chemically synthesized
gauuaagugguuacuuug

SEQ ID NO: 886 - RNA, 18 nt, artificial
  Chemically synthesized
aacaggaacuugaauacu

SEQ ID NO: 887 - RNA, 18 nt, artificial
  Chemically synthesized
cgagggcguuaauaccga

SEQ ID NO: 888 - RNA, 18 nt, artificial
  Chemically synthesized
ccgagccggcuucagcga

SEQ ID NO: 889 - RNA, 18 nt, artificial
  Chemically synthesized
gggccuucgcgcacagcg

SEQ ID NO: 890 - RNA, 18 nt, artificial
  Chemically synthesized
cugagcacagaaagucau

SEQ ID NO: 891 - RNA, 18 nt, artificial
  Chemically synthesized
gaacgaggugacccgcuu

SEQ ID NO: 892 - RNA, 18 nt, artificial
  Chemically synthesized
gcucccgauggccaguuu

SEQ ID NO: 893 - RNA, 18 nt, artificial
  Chemically synthesized
gagcuggugcugauaaca

SEQ ID NO: 894 - RNA, 18 nt, artificial
  Chemically synthesized
ugagccagcugaaaacac

SEQ ID NO: 895 - RNA, 18 nt, artificial
  Chemically synthesized
aggccguggcggaacuga

SEQ ID NO: 896 - RNA, 18 nt, artificial
  Chemically synthesized
caguaguuuugugaaagu

SEQ ID NO: 897 - RNA, 18 nt, artificial
  Chemically synthesized
caccggauaaaccaaaga

SEQ ID NO: 898 - RNA, 18 nt, artificial
  Chemically synthesized
aggugacccgcuuccugu

SEQ ID NO: 899 - RNA, 18 nt, artificial
  Chemically synthesized
cuucagcgagugcaugaa

SEQ ID NO: 900 - RNA, 18 nt, artificial
  Chemically synthesized
cgucuacaccagcaacag

SEQ ID NO: 901 - RNA, 18 nt, artificial
  Chemically synthesized
guucauauuggauugcgc

SEQ ID NO: 902 - RNA, 18 nt, artificial
  Chemically synthesized
gaagcaccuccggaaccu

SEQ ID NO: 903 - RNA, 18 nt, artificial
  Chemically synthesized
agcacagacccaagugug

SEQ ID NO: 904 - RNA, 18 nt, artificial
  Chemically synthesized
gucuacaccagcaacagc

SEQ ID NO: 905 - RNA, 18 nt, artificial
  Chemically synthesized
guuuugugaaagucucaa

SEQ ID NO: 906 - RNA, 18 nt, artificial
  Chemically synthesized
uuggauugcgccuuugua

SEQ ID NO: 907 - RNA, 18 nt, artificial
  Chemically synthesized
ggccaacugcaugaccca

SEQ ID NO: 908 - RNA, 18 nt, artificial
  Chemically synthesized
agcucagaugacauuucg

SEQ ID NO: 909 - RNA, 18 nt, artificial
  Chemically synthesized
gaagaggacuuuuuugau

SEQ ID NO: 910 - RNA, 18 nt, artificial
  Chemically synthesized
gggaaguaccgagccggc

SEQ ID NO: 911 - RNA, 18 nt, artificial
  Chemically synthesized
auauuggauugcgccuuu

SEQ ID NO: 912 - RNA, 18 nt, artificial
  Chemically synthesized
ggauccggagcuggugcu

SEQ ID NO: 913 - RNA, 18 nt, artificial
  Chemically synthesized
auggagaaaagacgaaga

SEQ ID NO: 914 - RNA, 18 nt, artificial
  Chemically synthesized
acgcagugucaccuucca

SEQ ID NO: 915 - RNA, 18 nt, artificial
  Chemically synthesized
cccgucuaccucucuccu

SEQ ID NO: 916 - RNA, 18 nt, artificial
  Chemically synthesized
cuacugaucaccaaguag

SEQ ID NO: 917 - RNA, 18 nt, artificial
  Chemically synthesized
aaaugaaagucugagcca

SEQ ID NO: 918 - RNA, 18 nt, artificial
  Chemically synthesized
gugaugccaaagauguuu

SEQ ID NO: 919 - RNA, 18 nt, artificial
  Chemically synthesized
guaccgagccggcuucag

SEQ ID NO: 920 - RNA, 18 nt, artificial
  Chemically synthesized
aaagcucagaugacauuu

SEQ ID NO: 921 - RNA, 18 nt, artificial
  Chemically synthesized
cgcuuccuguccacgugc

SEQ ID NO: 922 - RNA, 18 nt, artificial
  Chemically synthesized
cacagacccaagugugcu

SEQ ID NO: 923 - RNA, 18 nt, artificial
  Chemically synthesized
caucugagcacagaaagu

SEQ ID NO: 924 - RNA, 18 nt, artificial
  Chemically synthesized
ugcucugaagaaagauag

SEQ ID NO: 925 - RNA, 18 nt, artificial
  Chemically synthesized
uuauggagaaaagacgaa

SEQ ID NO: 926 - RNA, 18 nt, artificial
  Chemically synthesized
ccaccuggccaacugcau

SEQ ID NO: 927 - RNA, 18 nt, artificial
  Chemically synthesized
cacacaggauccggagcu

SEQ ID NO: 928 - RNA, 18 nt, artificial
  Chemically synthesized
cuggaaaugacagugaag

SEQ ID NO: 929 - RNA, 18 nt, artificial
  Chemically synthesized
gugcugauaacagcggaa

SEQ ID NO: 930 - RNA, 18 nt, artificial
  Chemically synthesized
gugcgagggcguuaauac

SEQ ID NO: 931 - RNA, 18 nt, artificial
  Chemically synthesized
ggcucccgauggccaguu

SEQ ID NO: 932 - RNA, 18 nt, artificial
  Chemically synthesized
gcuggugcugauaacagc

SEQ ID NO: 933 - RNA, 18 nt, artificial
  Chemically synthesized
aaaugacagugaagcacc

SEQ ID NO: 934 - RNA, 18 nt, artificial
  Chemically synthesized
cugagccagcugaaaaca

SEQ ID NO: 935 - RNA, 18 nt, artificial
  Chemically synthesized
uuggaugcucugaagaaa

SEQ ID NO: 936 - RNA, 18 nt, artificial
  Chemically synthesized
gcuggagaggcggcuaag

SEQ ID NO: 937 - RNA, 18 nt, artificial
  Chemically synthesized
ccggacucuaaacaggaa

SEQ ID NO: 938 - RNA, 18 nt, artificial
  Chemically synthesized
gugacugaccaugcacua

SEQ ID NO: 939 - RNA, 18 nt, artificial
  Chemically synthesized
agcugggcagccaggcug

SEQ ID NO: 940 - RNA, 18 nt, artificial
  Chemically synthesized
ggcguuaauaccgaggug

SEQ ID NO: 941 - RNA, 18 nt, artificial
  Chemically synthesized
gccagcugaaaacacuga

SEQ ID NO: 942 - RNA, 18 nt, artificial
  Chemically synthesized
guguuuggaggcuuccag

SEQ ID NO: 943 - RNA, 18 nt, artificial
  Chemically synthesized
gccaggcuggagaggcgg

SEQ ID NO: 944 - RNA, 18 nt, artificial
  Chemically synthesized
ccagcaacagcggcaccu

SEQ ID NO: 945 - RNA, 18 nt, artificial
  Chemically synthesized
gccaccuggccaacugca

SEQ ID NO: 946 - RNA, 18 nt, artificial
  Chemically synthesized
ccagugucaacacgacac

SEQ ID NO: 947 - RNA, 18 nt, artificial
  Chemically synthesized
ggugcgcacucggcugcu

SEQ ID NO: 948 - RNA, 18 nt, artificial
  Chemically synthesized
gagaaaaauuccucgucc

SEQ ID NO: 949 - RNA, 18 nt, artificial
  Chemically synthesized
gucuaccucucuccuugg

SEQ ID NO: 950 - RNA, 18 nt, artificial
  Chemically synthesized
cugauaacagcggaaucc

SEQ ID NO: 951 - RNA, 18 nt, artificial
  Chemically synthesized
ugacccagaucaaugcca

SEQ ID NO: 952 - RNA, 18 nt, artificial
  Chemically synthesized
agaagaggacuuuuuuga

SEQ ID NO: 953 - RNA, 18 nt, artificial
  Chemically synthesized
aggcggcuaagguguuug

SEQ ID NO: 954 - RNA, 18 nt, artificial
  Chemically synthesized
uucccuccggacucuaaa

SEQ ID NO: 955 - RNA, 18 nt, artificial
  Chemically synthesized
cgagugcaugaacgaggu

SEQ ID NO: 956 - RNA, 18 nt, artificial
  Chemically synthesized
gcggcauuccaagcugga

SEQ ID NO: 957 - RNA, 18 nt, artificial
  Chemically synthesized
cugaaaacacugauuuug

SEQ ID NO: 958 - RNA, 18 nt, artificial
  Chemically synthesized
accucucuucccuccgga

SEQ ID NO: 959 - RNA, 18 nt, artificial
  Chemically synthesized
gugucaccuuccagcggc

SEQ ID NO: 960 - RNA, 18 nt, artificial
  Chemically synthesized
ggccuucgcgcacagcgg

SEQ ID NO: 961 - RNA, 18 nt, artificial
  Chemically synthesized
cgaggugcgcacucggcu

SEQ ID NO: 962 - RNA, 18 nt, artificial
  Chemically synthesized
ccugcagcgggcgcagau

SEQ ID NO: 963 - RNA, 18 nt, artificial
  Chemically synthesized
aguaccgagccggcuuca

SEQ ID NO: 964 - RNA, 18 nt, artificial
  Chemically synthesized
gcuuacggcggacuccau

SEQ ID NO: 965 - RNA, 18 nt, artificial
  Chemically synthesized
cauuccaagcuggagaag

SEQ ID NO: 966 - RNA, 18 nt, artificial
  Chemically synthesized
cagaaagucaucaaagcc

SEQ ID NO: 967 - RNA, 18 nt, artificial
  Chemically synthesized
guuuggaggcuuccaggu

SEQ ID NO: 968 - RNA, 18 nt, artificial
  Chemically synthesized
gaaagauagcucgcggca

SEQ ID NO: 969 - RNA, 18 nt, artificial
  Chemically synthesized
cccgauggccaguuugcu

SEQ ID NO: 970 - RNA, 18 nt, artificial
  Chemically synthesized
cuuccuguccacgugcga

SEQ ID NO: 971 - RNA, 18 nt, artificial
  Chemically synthesized
aacuugaauacugggaga

SEQ ID NO: 972 - RNA, 18 nt, artificial
  Chemically synthesized
ugauaacagcggaauccc

SEQ ID NO: 973 - RNA, 18 nt, artificial
  Chemically synthesized
gaucacacaggauccgga

SEQ ID NO: 974 - RNA, 18 nt, artificial
  Chemically synthesized
gacagugaagcaccuccg

SEQ ID NO: 975 - RNA, 18 nt, artificial
  Chemically synthesized
ccgcuuccuguccacgug

SEQ ID NO: 976 - RNA, 18 nt, artificial
  Chemically synthesized
gcugcgcugagcacagac

SEQ ID NO: 977 - RNA, 18 nt, artificial
  Chemically synthesized
uuguagagagagcuguau

SEQ ID NO: 978 - RNA, 18 nt, artificial
  Chemically synthesized
gcugagcacagacccaag

SEQ ID NO: 979 - RNA, 18 nt, artificial
  Chemically synthesized
gggcgcagaugacggcug

SEQ ID NO: 980 - RNA, 18 nt, artificial
  Chemically synthesized
acugauuuuggaugcucu

SEQ ID NO: 981 - RNA, 18 nt, artificial
  Chemically synthesized
gcucuuaaaauaucuucc

SEQ ID NO: 982 - RNA, 18 nt, artificial
  Chemically synthesized
ugacccgcuuccugucca

SEQ ID NO: 983 - RNA, 18 nt, artificial
  Chemically synthesized
gcauuccaagcuggagaa

SEQ ID NO: 984 - RNA, 18 nt, artificial
  Chemically synthesized
cugaagaaagauagcucg

SEQ ID NO: 985 - RNA, 18 nt, artificial
  Chemically synthesized
cugagcacagacccaagu

SEQ ID NO: 986 - RNA, 18 nt, artificial
  Chemically synthesized
ugggagagaagaggacuu

SEQ ID NO: 987 - RNA, 18 nt, artificial
  Chemically synthesized
ugucaacacgacaccgga

SEQ ID NO: 988 - RNA, 18 nt, artificial
  Chemically synthesized
gcacagcggcccugucau

SEQ ID NO: 989 - RNA, 18 nt, artificial
  Chemically synthesized
agugucaccuuccagcgg

SEQ ID NO: 990 - RNA, 18 nt, artificial
  Chemically synthesized
caacugcaugacccagau

SEQ ID NO: 991 - RNA, 18 nt, artificial
  Chemically synthesized
gcucugaagaaagauagc

SEQ ID NO: 992 - RNA, 18 nt, artificial
  Chemically synthesized
cccuccuccuaaacuccc

SEQ ID NO: 993 - RNA, 18 nt, artificial
  Chemically synthesized
gcuaagguguuuggaggc

SEQ ID NO: 994 - RNA, 18 nt, artificial
  Chemically synthesized
ggcagccaggcuggagag

SEQ ID NO: 995 - RNA, 18 nt, artificial
  Chemically synthesized
aaagacgaagagcaagaa

SEQ ID NO: 996 - RNA, 18 nt, artificial
  Chemically synthesized
agccggcuucagcgagug

SEQ ID NO: 997 - RNA, 18 nt, artificial
  Chemically synthesized
gaggugacccgcuuccug

SEQ ID NO: 998 - RNA, 18 nt, artificial
  Chemically synthesized
gugaagcaccuccggaac

SEQ ID NO: 999 - RNA, 18 nt, artificial
  Chemically synthesized
agaggcggcuaagguguu

SEQ ID NO: 1000 - RNA, 18 nt, artificial
  Chemically synthesized
cucccgauggccaguuug

SEQ ID NO: 1001 - RNA, 18 nt, artificial
  Chemically synthesized
ggacucuaaacaggaacu

SEQ ID NO: 1002 - RNA, 18 nt, artificial
  Chemically synthesized
ucugaagaaagauagcuc

SEQ ID NO: 1003 - RNA, 18 nt, artificial
  Chemically synthesized
augugaugccaaagaugu

SEQ ID NO: 1004 - RNA, 18 nt, artificial
  Chemically synthesized
cccucagcacuugcucag

SEQ ID NO: 1005 - RNA, 18 nt, artificial
  Chemically synthesized
gccuugcaggcgccgcca

SEQ ID NO: 1006 - RNA, 18 nt, artificial
  Chemically synthesized
cgaggugacccgcuuccu

SEQ ID NO: 1007 - RNA, 18 nt, artificial
  Chemically synthesized
ugagcacagacccaagug

SEQ ID NO: 1008 - RNA, 18 nt, artificial
  Chemically synthesized
cucgcggcauuccaagcu

SEQ ID NO: 1009 - RNA, 18 nt, artificial
  Chemically synthesized
cuccuugguccuggaaca

SEQ ID NO: 1010 - RNA, 18 nt, artificial
  Chemically synthesized
aguaguuuugugaaaguc

SEQ ID NO: 1011 - RNA, 18 nt, artificial
  Chemically synthesized
ugacagugaagcaccucc

SEQ ID NO: 1012 - RNA, 18 nt, artificial
  Chemically synthesized
cagugucaacacgacacc

SEQ ID NO: 1013 - RNA, 18 nt, artificial
  Chemically synthesized
cagugucaccuuccagcg

SEQ ID NO: 1014 - RNA, 18 nt, artificial
  Chemically synthesized
uggaacagcgcuacugau

SEQ ID NO: 1015 - RNA, 18 nt, artificial
  Chemically synthesized
gugcaugaacgaggugac

SEQ ID NO: 1016 - RNA, 18 nt, artificial
  Chemically synthesized
gguaccggcucccgaugg

SEQ ID NO: 1017 - RNA, 18 nt, artificial
  Chemically synthesized
cuccggaaccugcagcgg

SEQ ID NO: 1018 - RNA, 18 nt, artificial
  Chemically synthesized
aaaauaucuuccuuuggg

SEQ ID NO: 1019 - RNA, 18 nt, artificial
  Chemically synthesized
agcucgcggcauuccaag

SEQ ID NO: 1020 - RNA, 18 nt, artificial
  Chemically synthesized
aaagacagcaucugagca

SEQ ID NO: 1021 - RNA, 18 nt, artificial
  Chemically synthesized
agaugacggcugcgcuga

SEQ ID NO: 1022 - RNA, 18 nt, artificial
  Chemically synthesized
cuuacggcggacuccaug

SEQ ID NO: 1023 - RNA, 18 nt, artificial
  Chemically synthesized
ccaccucucuucccuccg

SEQ ID NO: 1024 - RNA, 18 nt, artificial
  Chemically synthesized
uccggaaccugcagcggg

SEQ ID NO: 1025 - RNA, 18 nt, artificial
  Chemically synthesized
aagugguuacuuuguguu

SEQ ID NO: 1026 - RNA, 18 nt, artificial
  Chemically synthesized
guuugcuuuccucauucc

SEQ ID NO: 1027 - RNA, 18 nt, artificial
  Chemically synthesized
uucagcgagugcaugaac

SEQ ID NO: 1028 - RNA, 18 nt, artificial
  Chemically synthesized
ccucucuucccuccggac

SEQ ID NO: 1029 - RNA, 18 nt, artificial
  Chemically synthesized
cgcacagcggcccuguca

SEQ ID NO: 1030 - RNA, 18 nt, artificial
  Chemically synthesized
agaauguccgccuucucc

SEQ ID NO: 1031 - RNA, 18 nt, artificial
  Chemically synthesized
uuuucuccauaauaggcu

SEQ ID NO: 1032 - RNA, 18 nt, artificial
  Chemically synthesized
ucauuuccagaauguccg

SEQ ID NO: 1033 - RNA, 18 nt, artificial
  Chemically synthesized
aaggagagagguagacgg

SEQ ID NO: 1034 - RNA, 18 nt, artificial
  Chemically synthesized
aaacuacugagcaagugc

SEQ ID NO: 1035 - RNA, 18 nt, artificial
  Chemically synthesized
gaauguccgccuucucca

SEQ ID NO: 1036 - RNA, 18 nt, artificial
  Chemically synthesized
uauuuuguggcuacuugg

SEQ ID NO: 1037 - RNA, 18 nt, artificial
  Chemically synthesized
uauagugcauggucaguc

SEQ ID NO: 1038 - RNA, 18 nt, artificial
  Chemically synthesized
augaggaaagcaaacugg

SEQ ID NO: 1039 - RNA, 18 nt, artificial
  Chemically synthesized
aauguccgccuucuccag

SEQ ID NO: 1040 - RNA, 18 nt, artificial
  Chemically synthesized
ucuccagccuggcugccc

SEQ ID NO: 1041 - RNA, 18 nt, artificial
  Chemically synthesized
auguccgccuucuccagc

SEQ ID NO: 1042 - RNA, 18 nt, artificial
  Chemically synthesized
cuccaaacaccuuagccg

SEQ ID NO: 1043 - RNA, 18 nt, artificial
  Chemically synthesized
auuuccagaauguccgcc

SEQ ID NO: 1044 - RNA, 18 nt, artificial
  Chemically synthesized
ucguguugacacuggcug

SEQ ID NO: 1045 - RNA, 18 nt, artificial
  Chemically synthesized
aaugaggaaagcaaacug

SEQ ID NO: 1046 - RNA, 18 nt, artificial
  Chemically synthesized
uuuccagaauguccgccu

SEQ ID NO: 1047 - RNA, 18 nt, artificial
  Chemically synthesized
gucuuuucuccauaauag

SEQ ID NO: 1048 - RNA, 18 nt, artificial
  Chemically synthesized
uguccgccuucuccagcu

SEQ ID NO: 1049 - RNA, 18 nt, artificial
  Chemically synthesized
ucuuuucuccauaauagg

SEQ ID NO: 1050 - RNA, 18 nt, artificial
  Chemically synthesized
aaggugacacugcguugg

SEQ ID NO: 1051 - RNA, 18 nt, artificial
  Chemically synthesized
aaaguccucuucucuccc

SEQ ID NO: 1052 - RNA, 18 nt, artificial
  Chemically synthesized
uuuucagcuggcucagac

SEQ ID NO: 1053 - RNA, 18 nt, artificial
  Chemically synthesized
ugaggaaagcaaacuggc

SEQ ID NO: 1054 - RNA, 18 nt, artificial
  Chemically synthesized
aaaucaguguuuucagcu

SEQ ID NO: 1055 - RNA, 18 nt, artificial
  Chemically synthesized
agccggcucgguacuucc

SEQ ID NO: 1056 - RNA, 18 nt, artificial
  Chemically synthesized
uuuuuggaguucuucacg

SEQ ID NO: 1057 - RNA, 18 nt, artificial
  Chemically synthesized
aaaaguccucuucucucc

SEQ ID NO: 1058 - RNA, 18 nt, artificial
  Chemically synthesized
ugucuuugguuuauccgg

SEQ ID NO: 1059 - RNA, 18 nt, artificial
  Chemically synthesized
uaucagcuggcauuuucc

SEQ ID NO: 1060 - RNA, 18 nt, artificial
  Chemically synthesized
cagaauguccgccuucuc

SEQ ID NO: 1061 - RNA, 18 nt, artificial
  Chemically synthesized
aaucucguguaaaaaacg

SEQ ID NO: 1062 - RNA, 18 nt, artificial
  Chemically synthesized
ugcacucgcugaagccgg

SEQ ID NO: 1063 - RNA, 18 nt, artificial
  Chemically synthesized
uuuuguggcuacuuggug

SEQ ID NO: 1064 - RNA, 18 nt, artificial
  Chemically synthesized
uugggucugugcucagcg

SEQ ID NO: 1065 - RNA, 18 nt, artificial
  Chemically synthesized
ucuucucucccaguauuc

SEQ ID NO: 1066 - RNA, 18 nt, artificial
  Chemically synthesized
caccuuagccgccucucc

SEQ ID NO: 1067 - RNA, 18 nt, artificial
  Chemically synthesized
uggaagccuccaaacacc

SEQ ID NO: 1068 - RNA, 18 nt, artificial
  Chemically synthesized
uuugaugacuuucugugc

SEQ ID NO: 1069 - RNA, 18 nt, artificial
  Chemically synthesized
uacugagcaagugcugag

SEQ ID NO: 1070 - RNA, 18 nt, artificial
  Chemically synthesized
agacuuucacaaaacuac

SEQ ID NO: 1071 - RNA, 18 nt, artificial
  Chemically synthesized
ucccaguauucaaguucc

SEQ ID NO: 1072 - RNA, 18 nt, artificial
  Chemically synthesized
aagccggcucgguacuuc

SEQ ID NO: 1073 - RNA, 18 nt, artificial
  Chemically synthesized
cuuaauacagcucucucu

SEQ ID NO: 1074 - RNA, 18 nt, artificial
  Chemically synthesized
ucugggucaugcaguugg

SEQ ID NO: 1075 - RNA, 18 nt, artificial
  Chemically synthesized
uuuucaaacaucuuuggc

SEQ ID NO: 1076 - RNA, 18 nt, artificial
  Chemically synthesized
cuuugaugacuuucugug

SEQ ID NO: 1077 - RNA, 18 nt, artificial
  Chemically synthesized
uguugcugguguagacgg

SEQ ID NO: 1078 - RNA, 18 nt, artificial
  Chemically synthesized
auaauaggcuuugaugac

SEQ ID NO: 1079 - RNA, 18 nt, artificial
  Chemically synthesized
uccaaacaccuuagccgc

SEQ ID NO: 1080 - RNA, 18 nt, artificial
  Chemically synthesized
uccauuauaucagcuggc

SEQ ID NO: 1081 - RNA, 18 nt, artificial
  Chemically synthesized
auuuauucuugcucuucg

SEQ ID NO: 1082 - RNA, 18 nt, artificial
  Chemically synthesized
cugucuuugguuuauccg

SEQ ID NO: 1083 - RNA, 18 nt, artificial
  Chemically synthesized
uuaucagcaccagcuccg

SEQ ID NO: 1084 - RNA, 18 nt, artificial
  Chemically synthesized
ugucguguugacacuggc

SEQ ID NO: 1085 - RNA, 18 nt, artificial
  Chemically synthesized
agagcauuuucaaacauc

SEQ ID NO: 1086 - RNA, 18 nt, artificial
  Chemically synthesized
ucaccucguucaugcacu

SEQ ID NO: 1087 - RNA, 18 nt, artificial
  Chemically synthesized
cucagaugcugucuuugg

SEQ ID NO: 1088 - RNA, 18 nt, artificial
  Chemically synthesized
uacaaauauagugcaugg

SEQ ID NO: 1089 - RNA, 18 nt, artificial
  Chemically synthesized
cucgcugaagccggcucg

SEQ ID NO: 1090 - RNA, 18 nt, artificial
  Chemically synthesized
acuuaauacagcucucuc

SEQ ID NO: 1091 - RNA, 18 nt, artificial
  Chemically synthesized
auuccgcuguuaucagca

SEQ ID NO: 1092 - RNA, 18 nt, artificial
  Chemically synthesized
uaauacaaaggcgcaauc

SEQ ID NO: 1093 - RNA, 18 nt, artificial
  Chemically synthesized
ucgggagccgguaccacc

SEQ ID NO: 1094 - RNA, 18 nt, artificial
  Chemically synthesized
uugcucuucgucuuuucu

SEQ ID NO: 1095 - RNA, 18 nt, artificial
  Chemically synthesized
ucacuuaauacagcucuc

SEQ ID NO: 1096 - RNA, 18 nt, artificial
  Chemically synthesized
uaauaggcuuugaugacu

SEQ ID NO: 1097 - RNA, 18 nt, artificial
  Chemically synthesized
aaggcgcaauccaauaug

SEQ ID NO: 1098 - RNA, 18 nt, artificial
  Chemically synthesized
agcuaucuuucuucagag

SEQ ID NO: 1099 - RNA, 18 nt, artificial
  Chemically synthesized
uggucagucacuuaauac

SEQ ID NO: 1100 - RNA, 18 nt, artificial
  Chemically synthesized
aaaaaguccucuucucuc

SEQ ID NO: 1101 - RNA, 18 nt, artificial
  Chemically synthesized
uuagccgccucuccagcc

SEQ ID NO: 1102 - RNA, 18 nt, artificial
  Chemically synthesized
uuucacaaaacuacugag

SEQ ID NO: 1103 - RNA, 18 nt, artificial
  Chemically synthesized
cuuucugugcucagaugc

SEQ ID NO: 1104 - RNA, 18 nt, artificial
  Chemically synthesized
uuugguuuauccgguguc

SEQ ID NO: 1105 - RNA, 18 nt, artificial
  Chemically synthesized
cucaguuccgccacggcc

SEQ ID NO: 1106 - RNA, 18 nt, artificial
  Chemically synthesized
uguuuagaguccggaggg

SEQ ID NO: 1107 - RNA, 18 nt, artificial
  Chemically synthesized
ccuccaaacaccuuagcc

SEQ ID NO: 1108 - RNA, 18 nt, artificial
  Chemically synthesized
uuggugaucaguagcgcu

SEQ ID NO: 1109 - RNA, 18 nt, artificial
  Chemically synthesized
aaacacaaaguaaccacu

SEQ ID NO: 1110 - RNA, 18 nt, artificial
  Chemically synthesized
aaauauagugcaugguca

SEQ ID NO: 1111 - RNA, 18 nt, artificial
  Chemically synthesized
accucgguauuaacgccc

SEQ ID NO: 1112 - RNA, 18 nt, artificial
  Chemically synthesized
aguguuuucagcuggcuc

SEQ ID NO: 1113 - RNA, 18 nt, artificial
  Chemically synthesized
aagccuccaaacaccuua

SEQ ID NO: 1114 - RNA, 18 nt, artificial
  Chemically synthesized
guaccaccuggaagccuc

SEQ ID NO: 1115 - RNA, 18 nt, artificial
  Chemically synthesized
ccucguucaugcacucgc

SEQ ID NO: 1116 - RNA, 18 nt, artificial
  Chemically synthesized
acucgcugaagccggcuc

SEQ ID NO: 1117 - RNA, 18 nt, artificial
  Chemically synthesized
aaaaaaguccucuucucu

SEQ ID NO: 1118 - RNA, 18 nt, artificial
  Chemically synthesized
ugcuucacugucauuucc

SEQ ID NO: 1119 - RNA, 18 nt, artificial
  Chemically synthesized
aacuacugagcaagugcu

SEQ ID NO: 1120 - RNA, 18 nt, artificial
  Chemically synthesized
cucguucaugcacucgcu

SEQ ID NO: 1121 - RNA, 18 nt, artificial
  Chemically synthesized
cuguuaucagcaccagcu

SEQ ID NO: 1122 - RNA, 18 nt, artificial
  Chemically synthesized
caaggagagagguagacg

SEQ ID NO: 1123 - RNA, 18 nt, artificial
  Chemically synthesized
acguggacaggaagcggg

SEQ ID NO: 1124 - RNA, 18 nt, artificial
  Chemically synthesized
aaaacacaaaguaaccac

SEQ ID NO: 1125 - RNA, 18 nt, artificial
  Chemically synthesized
aucaguguuuucagcugg

SEQ ID NO: 1126 - RNA, 18 nt, artificial
  Chemically synthesized
acaaaacuacugagcaag

SEQ ID NO: 1127 - RNA, 18 nt, artificial
  Chemically synthesized
uucagagcauccaaaauc

SEQ ID NO: 1128 - RNA, 18 nt, artificial
  Chemically synthesized
ucucuuuuacuugagacu

SEQ ID NO: 1129 - RNA, 18 nt, artificial
  Chemically synthesized
gaaugaggaaagcaaacu

SEQ ID NO: 1130 - RNA, 18 nt, artificial
  Chemically synthesized
ucuuucuucagagcaucc

SEQ ID NO: 1131 - RNA, 18 nt, artificial
  Chemically synthesized
aauauagugcauggucag

SEQ ID NO: 1132 - RNA, 18 nt, artificial
  Chemically synthesized
ucugugcucagcgcagcc

SEQ ID NO: 1133 - RNA, 18 nt, artificial
  Chemically synthesized
uuucugugcucagaugcu

SEQ ID NO: 1134 - RNA, 18 nt, artificial
  Chemically synthesized
cuguuuagaguccggagg

SEQ ID NO: 1135 - RNA, 18 nt, artificial
  Chemically synthesized
ugaucaguagcgcuguuc

SEQ ID NO: 1136 - RNA, 18 nt, artificial
  Chemically synthesized
uuuauucuugcucuucgu

SEQ ID NO: 1137 - RNA, 18 nt, artificial
  Chemically synthesized
aggugacacugcguuggg

SEQ ID NO: 1138 - RNA, 18 nt, artificial
  Chemically synthesized
aaagcaaacuggccaucg

SEQ ID NO: 1139 - RNA, 18 nt, artificial
  Chemically synthesized
uaggcuuugaugacuuuc

SEQ ID NO: 1140 - RNA, 18 nt, artificial
  Chemically synthesized
ugucauuuccagaauguc

SEQ ID NO: 1141 - RNA, 18 nt, artificial
  Chemically synthesized
agccuccaaacaccuuag

SEQ ID NO: 1142 - RNA, 18 nt, artificial
  Chemically synthesized
accuuagccgccucucca

SEQ ID NO: 1143 - RNA, 18 nt, artificial
  Chemically synthesized
cuggaaggugacacugcg

SEQ ID NO: 1144 - RNA, 18 nt, artificial
  Chemically synthesized
uacuuggugaucaguagc

SEQ ID NO: 1145 - RNA, 18 nt, artificial
  Chemically synthesized
gggucaccucguucaugc

SEQ ID NO: 1146 - RNA, 18 nt, artificial
  Chemically synthesized
acacuugggucugugcuc

SEQ ID NO: 1147 - RNA, 18 nt, artificial
  Chemically synthesized
auacaaaggcgcaaucca

SEQ ID NO: 1148 - RNA, 18 nt, artificial
  Chemically synthesized
aguccggagggaagagag

SEQ ID NO: 1149 - RNA, 18 nt, artificial
  Chemically synthesized
cgcaauccaauaugaaca

SEQ ID NO: 1150 - RNA, 18 nt, artificial
  Chemically synthesized
cauugaucugggucaugc

SEQ ID NO: 1151 - RNA, 18 nt, artificial
  Chemically synthesized
uccauaauaggcuuugau

SEQ ID NO: 1152 - RNA, 18 nt, artificial
  Chemically synthesized
acaccuuagccgccucuc

SEQ ID NO: 1153 - RNA, 18 nt, artificial
  Chemically synthesized
uccgccuucuccagcuug

SEQ ID NO: 1154 - RNA, 18 nt, artificial
  Chemically synthesized
gugcuucacugucauuuc

SEQ ID NO: 1155 - RNA, 18 nt, artificial
  Chemically synthesized
guguugacacuggcuggg

SEQ ID NO: 1156 - RNA, 18 nt, artificial
  Chemically synthesized
uauuaacgcccucgcacg

SEQ ID NO: 1157 - RNA, 18 nt, artificial
  Chemically synthesized
cuccacauggaguccgcc

SEQ ID NO: 1158 - RNA, 18 nt, artificial
  Chemically synthesized
uagcgcuguuccaggacc

SEQ ID NO: 1159 - RNA, 18 nt, artificial
  Chemically synthesized
caaauauagugcaugguc

SEQ ID NO: 1160 - RNA, 18 nt, artificial
  Chemically synthesized
gaaggugacacugcguug

SEQ ID NO: 1161 - RNA, 18 nt, artificial
  Chemically synthesized
aguccucuucucucccag

SEQ ID NO: 1162 - RNA, 18 nt, artificial
  Chemically synthesized
ucguucaugcacucgcug

SEQ ID NO: 1163 - RNA, 18 nt, artificial
  Chemically synthesized
gucacuuaauacagcucu

SEQ ID NO: 1164 - RNA, 18 nt, artificial
  Chemically synthesized
ucagucacuuaauacagc

SEQ ID NO: 1165 - RNA, 18 nt, artificial
  Chemically synthesized
gccucuccagccuggcug

SEQ ID NO: 1166 - RNA, 18 nt, artificial
  Chemically synthesized
gcuggaaggugacacugc

SEQ ID NO: 1167 - RNA, 18 nt, artificial
  Chemically synthesized
aaaaucaguguuuucagc

SEQ ID NO: 1168 - RNA, 18 nt, artificial
  Chemically synthesized
aaguuccuguuuagaguc

SEQ ID NO: 1169 - RNA, 18 nt, artificial
  Chemically synthesized
ucauggcauugaucuggg

SEQ ID NO: 1170 - RNA, 18 nt, artificial
  Chemically synthesized
ccgguaccaccuggaagc

SEQ ID NO: 1171 - RNA, 18 nt, artificial
  Chemically synthesized
gcuguuccaggaccaagg

SEQ ID NO: 1172 - RNA, 18 nt, artificial
  Chemically synthesized
uccacauggaguccgccg

SEQ ID NO: 1173 - RNA, 18 nt, artificial
  Chemically synthesized
gagcauccaaaaucagug

SEQ ID NO: 1174 - RNA, 18 nt, artificial
  Chemically synthesized
uucacugucauuuccaga

SEQ ID NO: 1175 - RNA, 18 nt, artificial
  Chemically synthesized
uaccaccuggaagccucc

SEQ ID NO: 1176 - RNA, 18 nt, artificial
  Chemically synthesized
uugaucugggucaugcag

SEQ ID NO: 1177 - RNA, 18 nt, artificial
  Chemically synthesized
uaggucauggcauugauc

SEQ ID NO: 1178 - RNA, 18 nt, artificial
  Chemically synthesized
aaaacuacugagcaagug

SEQ ID NO: 1179 - RNA, 18 nt, artificial
  Chemically synthesized
aaucaguguuuucagcug

SEQ ID NO: 1180 - RNA, 18 nt, artificial
  Chemically synthesized
aagcaaacuggccaucgg

SEQ ID NO: 1181 - RNA, 18 nt, artificial
  Chemically synthesized
ucagaugcugucuuuggu

SEQ ID NO: 1182 - RNA, 18 nt, artificial
  Chemically synthesized
uugggaaugaggaaagca

SEQ ID NO: 1183 - RNA, 18 nt, artificial
  Chemically synthesized
auggcauugaucuggguc

SEQ ID NO: 1184 - RNA, 18 nt, artificial
  Chemically synthesized
ugcugucuuugguuuauc

SEQ ID NO: 1185 - RNA, 18 nt, artificial
  Chemically synthesized
augcacucgcugaagccg

SEQ ID NO: 1186 - RNA, 18 nt, artificial
  Chemically synthesized
uggaguccgccguaagcg

SEQ ID NO: 1187 - RNA, 18 nt, artificial
  Chemically synthesized
gacgaggaauuuuucucc

SEQ ID NO: 1188 - RNA, 18 nt, artificial
  Chemically synthesized
gaccaaggagagagguag

SEQ ID NO: 1189 - RNA, 18 nt, artificial
  Chemically synthesized
cgcgagcuaucuuucuuc

SEQ ID NO: 1190 - RNA, 18 nt, artificial
  Chemically synthesized
ugugcucagaugcugucu

SEQ ID NO: 1191 - RNA, 18 nt, artificial
  Chemically synthesized
uggcugcccagcuugcag

SEQ ID NO: 1192 - RNA, 18 nt, artificial
  Chemically synthesized
uggcuacuuggugaucag

SEQ ID NO: 1193 - RNA, 18 nt, artificial
  Chemically synthesized
agucacuuaauacagcuc

SEQ ID NO: 1194 - RNA, 18 nt, artificial
  Chemically synthesized
ccuucuccagcuuggaau

SEQ ID NO: 1195 - RNA, 18 nt, artificial
  Chemically synthesized
gucagucacuuaauacag

SEQ ID NO: 1196 - RNA, 18 nt, artificial
  Chemically synthesized
uucucucccaguauucaa

SEQ ID NO: 1197 - RNA, 18 nt, artificial
  Chemically synthesized
acuacugagcaagugcug

SEQ ID NO: 1198 - RNA, 18 nt, artificial
  Chemically synthesized
ugcagguuccggaggugc

SEQ ID NO: 1199 - RNA, 18 nt, artificial
  Chemically synthesized
gagcauuuucaaacaucu

SEQ ID NO: 1200 - RNA, 18 nt, artificial
  Chemically synthesized
augccgcgagcuaucuuu

SEQ ID NO: 1201 - RNA, 18 nt, artificial
  Chemically synthesized
ucagcaccagcuccggau

SEQ ID NO: 1202 - RNA, 18 nt, artificial
  Chemically synthesized
caguauucaaguuccugu

SEQ ID NO: 1203 - RNA, 18 nt, artificial
  Chemically synthesized
gauuccgcuguuaucagc

SEQ ID NO: 1204 - RNA, 18 nt, artificial
  Chemically synthesized
auugaucugggucaugca

SEQ ID NO: 1205 - RNA, 18 nt, artificial
  Chemically synthesized
acugucauuuccagaaug

SEQ ID NO: 1206 - RNA, 18 nt, artificial
  Chemically synthesized
agaugcugucuuugguuu

SEQ ID NO: 1207 - RNA, 18 nt, artificial
  Chemically synthesized
cucuucgucuuuucucca

SEQ ID NO: 1208 - RNA, 18 nt, artificial
  Chemically synthesized
uuaauacagcucucucua

SEQ ID NO: 1209 - RNA, 18 nt, artificial
  Chemically synthesized
uuccggaggugcuucacu

SEQ ID NO: 1210 - RNA, 18 nt, artificial
  Chemically synthesized
aggaaagcaaacuggcca

SEQ ID NO: 1211 - RNA, 18 nt, artificial
  Chemically synthesized
guuccuguuuagaguccg

SEQ ID NO: 1212 - RNA, 18 nt, artificial
  Chemically synthesized
cauaauaggcuuugauga

SEQ ID NO: 1213 - RNA, 18 nt, artificial
  Chemically synthesized
auuauaucagcuggcauu

SEQ ID NO: 1214 - RNA, 18 nt, artificial
  Chemically synthesized
cuuggugaucaguagcgc

SEQ ID NO: 1215 - RNA, 18 nt, artificial
  Chemically synthesized
gucauggcauugaucugg

SEQ ID NO: 1216 - RNA, 18 nt, artificial
  Chemically synthesized
agcucucucuacaaaaag

SEQ ID NO: 1217 - RNA, 18 nt, artificial
  Chemically synthesized
gcaccucgguauuaacgc

SEQ ID NO: 1218 - RNA, 18 nt, artificial
  Chemically synthesized
ucaguagcgcuguuccag

SEQ ID NO: 1219 - RNA, 18 nt, artificial
  Chemically synthesized
aaacaccuuagccgccuc

SEQ ID NO: 1220 - RNA, 18 nt, artificial
  Chemically synthesized
uaucuuucuucagagcau

SEQ ID NO: 1221 - RNA, 18 nt, artificial
  Chemically synthesized
cucucucuacaaaaagua

SEQ ID NO: 1222 - RNA, 18 nt, artificial
  Chemically synthesized
caaaguaaccacuuaauc

SEQ ID NO: 1223 - RNA, 18 nt, artificial
  Chemically synthesized
aguauucaaguuccuguu

SEQ ID NO: 1224 - RNA, 18 nt, artificial
  Chemically synthesized
ucgguauuaacgcccucg

SEQ ID NO: 1225 - RNA, 18 nt, artificial
  Chemically synthesized
ucgcugaagccggcucgg

SEQ ID NO: 1226 - RNA, 18 nt, artificial
  Chemically synthesized
cgcugugcgcgaaggccc

SEQ ID NO: 1227 - RNA, 18 nt, artificial
  Chemically synthesized
augacuuucugugcucag

SEQ ID NO: 1228 - RNA, 18 nt, artificial
  Chemically synthesized
aagcgggucaccucguuc

SEQ ID NO: 1229 - RNA, 18 nt, artificial
  Chemically synthesized
aaacuggccaucgggagc

SEQ ID NO: 1230 - RNA, 18 nt, artificial
  Chemically synthesized
uguuaucagcaccagcuc

SEQ ID NO: 1231 - RNA, 18 nt, artificial
  Chemically synthesized
guguuuucagcuggcuca

SEQ ID NO: 1232 - RNA, 18 nt, artificial
  Chemically synthesized
ucaguuccgccacggccu

SEQ ID NO: 1233 - RNA, 18 nt, artificial
  Chemically synthesized
acuuucacaaaacuacug

SEQ ID NO: 1234 - RNA, 18 nt, artificial
  Chemically synthesized
ucuuugguuuauccggug

SEQ ID NO: 1235 - RNA, 18 nt, artificial
  Chemically synthesized
acaggaagcgggucaccu

SEQ ID NO: 1236 - RNA, 18 nt, artificial
  Chemically synthesized
uucaugcacucgcugaag

SEQ ID NO: 1237 - RNA, 18 nt, artificial
  Chemically synthesized
cuguugcugguguagacg

SEQ ID NO: 1238 - RNA, 18 nt, artificial
  Chemically synthesized
gcgcaauccaauaugaac

SEQ ID NO: 1239 - RNA, 18 nt, artificial
  Chemically synthesized
agguuccggaggugcuuc

SEQ ID NO: 1240 - RNA, 18 nt, artificial
  Chemically synthesized
cacacuugggucugugcu

SEQ ID NO: 1241 - RNA, 18 nt, artificial
  Chemically synthesized
gcuguugcugguguagac

SEQ ID NO: 1242 - RNA, 18 nt, artificial
  Chemically synthesized
uugagacuuucacaaaac

SEQ ID NO: 1243 - RNA, 18 nt, artificial
  Chemically synthesized
uacaaaggcgcaauccaa

SEQ ID NO: 1244 - RNA, 18 nt, artificial
  Chemically synthesized
ugggucaugcaguuggcc

SEQ ID NO: 1245 - RNA, 18 nt, artificial
  Chemically synthesized
cgaaaugucaucugagcu

SEQ ID NO: 1246 - RNA, 18 nt, artificial
  Chemically synthesized
aucaaaaaaguccucuuc

SEQ ID NO: 1247 - RNA, 18 nt, artificial
  Chemically synthesized
gccggcucgguacuuccc

SEQ ID NO: 1248 - RNA, 18 nt, artificial
  Chemically synthesized
aaaggcgcaauccaauau

SEQ ID NO: 1249 - RNA, 18 nt, artificial
  Chemically synthesized
agcaccagcuccggaucc

SEQ ID NO: 1250 - RNA, 18 nt, artificial
  Chemically synthesized
ucuucgucuuuucuccau

SEQ ID NO: 1251 - RNA, 18 nt, artificial
  Chemically synthesized
uggaaggugacacugcgu

SEQ ID NO: 1252 - RNA, 18 nt, artificial
  Chemically synthesized
aggagagagguagacggg

SEQ ID NO: 1253 - RNA, 18 nt, artificial
  Chemically synthesized
cuacuuggugaucaguag

SEQ ID NO: 1254 - RNA, 18 nt, artificial
  Chemically synthesized
uggcucagacuuucauuu

SEQ ID NO: 1255 - RNA, 18 nt, artificial
  Chemically synthesized
aaacaucuuuggcaucac

SEQ ID NO: 1256 - RNA, 18 nt, artificial
  Chemically synthesized
cugaagccggcucgguac

SEQ ID NO: 1257 - RNA, 18 nt, artificial
  Chemically synthesized
aaaugucaucugagcuuu

SEQ ID NO: 1258 - RNA, 18 nt, artificial
  Chemically synthesized
gcacguggacaggaagcg

SEQ ID NO: 1259 - RNA, 18 nt, artificial
  Chemically synthesized
agcacacuugggucugug

SEQ ID NO: 1260 - RNA, 18 nt, artificial
  Chemically synthesized
acuuucugugcucagaug

SEQ ID NO: 1261 - RNA, 18 nt, artificial
  Chemically synthesized
cuaucuuucuucagagca

SEQ ID NO: 1262 - RNA, 18 nt, artificial
  Chemically synthesized
uucgucuuuucuccauaa

SEQ ID NO: 1263 - RNA, 18 nt, artificial
  Chemically synthesized
augcaguuggccaggugg

SEQ ID NO: 1264 - RNA, 18 nt, artificial
  Chemically synthesized
agcuccggauccugugug

SEQ ID NO: 1265 - RNA, 18 nt, artificial
  Chemically synthesized
cuucacugucauuuccag

SEQ ID NO: 1266 - RNA, 18 nt, artificial
  Chemically synthesized
uuccgcuguuaucagcac

SEQ ID NO: 1267 - RNA, 18 nt, artificial
  Chemically synthesized
guauuaacgcccucgcac

SEQ ID NO: 1268 - RNA, 18 nt, artificial
  Chemically synthesized
aacuggccaucgggagcc

SEQ ID NO: 1269 - RNA, 18 nt, artificial
  Chemically synthesized
gcuguuaucagcaccagc

SEQ ID NO: 1270 - RNA, 18 nt, artificial
  Chemically synthesized
ggugcuucacugucauuu

SEQ ID NO: 1271 - RNA, 18 nt, artificial
  Chemically synthesized
uguuuucagcuggcucag

SEQ ID NO: 1272 - RNA, 18 nt, artificial
  Chemically synthesized
uuucuucagagcauccaa

SEQ ID NO: 1273 - RNA, 18 nt, artificial
  Chemically synthesized
cuuagccgccucuccagc

SEQ ID NO: 1274 - RNA, 18 nt, artificial
  Chemically synthesized
uuccuguuuagaguccgg

SEQ ID NO: 1275 - RNA, 18 nt, artificial
  Chemically synthesized
uagugcauggucagucac

SEQ ID NO: 1276 - RNA, 18 nt, artificial
  Chemically synthesized
cagccuggcugcccagcu

SEQ ID NO: 1277 - RNA, 18 nt, artificial
  Chemically synthesized
caccucgguauuaacgcc

SEQ ID NO: 1278 - RNA, 18 nt, artificial
  Chemically synthesized
ucaguguuuucagcuggc

SEQ ID NO: 1279 - RNA, 18 nt, artificial
  Chemically synthesized
cuggaagccuccaaacac

SEQ ID NO: 1280 - RNA, 18 nt, artificial
  Chemically synthesized
ccgccucuccagccuggc

SEQ ID NO: 1281 - RNA, 18 nt, artificial
  Chemically synthesized
aggugccgcuguugcugg

SEQ ID NO: 1282 - RNA, 18 nt, artificial
  Chemically synthesized
ugcaguuggccagguggc

SEQ ID NO: 1283 - RNA, 18 nt, artificial
  Chemically synthesized
gugucguguugacacugg

SEQ ID NO: 1284 - RNA, 18 nt, artificial
  Chemically synthesized
agcagccgagugcgcacc

SEQ ID NO: 1285 - RNA, 18 nt, artificial
  Chemically synthesized
ggacgaggaauuuuucuc

SEQ ID NO: 1286 - RNA, 18 nt, artificial
  Chemically synthesized
ccaaggagagagguagac

SEQ ID NO: 1287 - RNA, 18 nt, artificial
  Chemically synthesized
ggauuccgcuguuaucag

SEQ ID NO: 1288 - RNA, 18 nt, artificial
  Chemically synthesized
uggcauugaucuggguca

SEQ ID NO: 1289 - RNA, 18 nt, artificial
  Chemically synthesized
ucaaaaaaguccucuucu

SEQ ID NO: 1290 - RNA, 18 nt, artificial
  Chemically synthesized
caaacaccuuagccgccu

SEQ ID NO: 1291 - RNA, 18 nt, artificial
  Chemically synthesized
uuuagaguccggagggaa

SEQ ID NO: 1292 - RNA, 18 nt, artificial
  Chemically synthesized
accucguucaugcacucg

SEQ ID NO: 1293 - RNA, 18 nt, artificial
  Chemically synthesized
uccagcuuggaaugccgc

SEQ ID NO: 1294 - RNA, 18 nt, artificial
  Chemically synthesized
caaaaucaguguuuucag

SEQ ID NO: 1295 - RNA, 18 nt, artificial
  Chemically synthesized
uccggagggaagagaggu

SEQ ID NO: 1296 - RNA, 18 nt, artificial
  Chemically synthesized
gccgcuggaaggugacac

SEQ ID NO: 1297 - RNA, 18 nt, artificial
  Chemically synthesized
ccgcugugcgcgaaggcc

SEQ ID NO: 1298 - RNA, 18 nt, artificial
  Chemically synthesized
agccgagugcgcaccucg

SEQ ID NO: 1299 - RNA, 18 nt, artificial
  Chemically synthesized
aucugcgcccgcugcagg

SEQ ID NO: 1300 - RNA, 18 nt, artificial
  Chemically synthesized
ugaagccggcucgguacu

SEQ ID NO: 1301 - RNA, 18 nt, artificial
  Chemically synthesized
auggaguccgccguaagc

SEQ ID NO: 1302 - RNA, 18 nt, artificial
  Chemically synthesized
cuucuccagcuuggaaug

SEQ ID NO: 1303 - RNA, 18 nt, artificial
  Chemically synthesized
ggcuuugaugacuuucug

SEQ ID NO: 1304 - RNA, 18 nt, artificial
  Chemically synthesized
accuggaagccuccaaac

SEQ ID NO: 1305 - RNA, 18 nt, artificial
  Chemically synthesized
ugccgcgagcuaucuuuc

SEQ ID NO: 1306 - RNA, 18 nt, artificial
  Chemically synthesized
agcaaacuggccaucggg

SEQ ID NO: 1307 - RNA, 18 nt, artificial
  Chemically synthesized
ucgcacguggacaggaag

SEQ ID NO: 1308 - RNA, 18 nt, artificial
  Chemically synthesized
ucucccaguauucaaguu

SEQ ID NO: 1309 - RNA, 18 nt, artificial
  Chemically synthesized
gggauuccgcuguuauca

SEQ ID NO: 1310 - RNA, 18 nt, artificial
  Chemically synthesized
uccggauccugugugauc

SEQ ID NO: 1311 - RNA, 18 nt, artificial
  Chemically synthesized
cggaggugcuucacuguc

SEQ ID NO: 1312 - RNA, 18 nt, artificial
  Chemically synthesized
cacguggacaggaagcgg

SEQ ID NO: 1313 - RNA, 18 nt, artificial
  Chemically synthesized
gucugugcucagcgcagc

SEQ ID NO: 1314 - RNA, 18 nt, artificial
  Chemically synthesized
auacagcucucucuacaa

SEQ ID NO: 1315 - RNA, 18 nt, artificial
  Chemically synthesized
cuugggucugugcucagc

SEQ ID NO: 1316 - RNA, 18 nt, artificial
  Chemically synthesized
cagccgucaucugcgccc

SEQ ID NO: 1317 - RNA, 18 nt, artificial
  Chemically synthesized
agagcauccaaaaucagu

SEQ ID NO: 1318 - RNA, 18 nt, artificial
  Chemically synthesized
ggaagauauuuuaagagc

SEQ ID NO: 1319 - RNA, 18 nt, artificial
  Chemically synthesized
uggacaggaagcggguca

SEQ ID NO: 1320 - RNA, 18 nt, artificial
  Chemically synthesized
uucuccagcuuggaaugc

SEQ ID NO: 1321 - RNA, 18 nt, artificial
  Chemically synthesized
cgagcuaucuuucuucag

SEQ ID NO: 1322 - RNA, 18 nt, artificial
  Chemically synthesized
acuugggucugugcucag

SEQ ID NO: 1323 - RNA, 18 nt, artificial
  Chemically synthesized
aaguccucuucucuccca

SEQ ID NO: 1324 - RNA, 18 nt, artificial
  Chemically synthesized
uccggugucguguugaca

SEQ ID NO: 1325 - RNA, 18 nt, artificial
  Chemically synthesized
augacagggccgcugugc

SEQ ID NO: 1326 - RNA, 18 nt, artificial
  Chemically synthesized
ccgcuggaaggugacacu

SEQ ID NO: 1327 - RNA, 18 nt, artificial
  Chemically synthesized
aucugggucaugcaguug

SEQ ID NO: 1328 - RNA, 18 nt, artificial
  Chemically synthesized
gcuaucuuucuucagagc

SEQ ID NO: 1329 - RNA, 18 nt, artificial
  Chemically synthesized
gggaguuuaggaggaggg

SEQ ID NO: 1330 - RNA, 18 nt, artificial
  Chemically synthesized
gccuccaaacaccuuagc

SEQ ID NO: 1331 - RNA, 18 nt, artificial
  Chemically synthesized
cucuccagccuggcugcc

SEQ ID NO: 1332 - RNA, 18 nt, artificial
  Chemically synthesized
uucuugcucuucgucuuu

SEQ ID NO: 1333 - RNA, 18 nt, artificial
  Chemically synthesized
cacucgcugaagccggcu

SEQ ID NO: 1334 - RNA, 18 nt, artificial
  Chemically synthesized
caggaagcgggucaccuc

SEQ ID NO: 1335 - RNA, 18 nt, artificial
  Chemically synthesized
guuccggaggugcuucac

SEQ ID NO: 1336 - RNA, 18 nt, artificial
  Chemically synthesized
aacaccuuagccgccucu

SEQ ID NO: 1337 - RNA, 18 nt, artificial
  Chemically synthesized
caaacuggccaucgggag

SEQ ID NO: 1338 - RNA, 18 nt, artificial
  Chemically synthesized
aguuccuguuuagagucc

SEQ ID NO: 1339 - RNA, 18 nt, artificial
  Chemically synthesized
gagcuaucuuucuucaga

SEQ ID NO: 1340 - RNA, 18 nt, artificial
  Chemically synthesized
acaucuuuggcaucacau

SEQ ID NO: 1341 - RNA, 18 nt, artificial
  Chemically synthesized
cugagcaagugcugaggg

SEQ ID NO: 1342 - RNA, 18 nt, artificial
  Chemically synthesized
uggcggcgccugcaaggc

SEQ ID NO: 1343 - RNA, 18 nt, artificial
  Chemically synthesized
aggaagcgggucaccucg

SEQ ID NO: 1344 - RNA, 18 nt, artificial
  Chemically synthesized
cacuugggucugugcuca

SEQ ID NO: 1345 - RNA, 18 nt, artificial
  Chemically synthesized
agcuuggaaugccgcgag

SEQ ID NO: 1346 - RNA, 18 nt, artificial
  Chemically synthesized
uguuccaggaccaaggag

SEQ ID NO: 1347 - RNA, 18 nt, artificial
  Chemically synthesized
gacuuucacaaaacuacu

SEQ ID NO: 1348 - RNA, 18 nt, artificial
  Chemically synthesized
ggaggugcuucacuguca

SEQ ID NO: 1349 - RNA, 18 nt, artificial
  Chemically synthesized
ggugucguguugacacug

SEQ ID NO: 1350 - RNA, 18 nt, artificial
  Chemically synthesized
cgcuggaaggugacacug

SEQ ID NO: 1351 - RNA, 18 nt, artificial
  Chemically synthesized
aucaguagcgcuguucca

SEQ ID NO: 1352 - RNA, 18 nt, artificial
  Chemically synthesized
gucaccucguucaugcac

SEQ ID NO: 1353 - RNA, 18 nt, artificial
  Chemically synthesized
ccaucgggagccgguacc

SEQ ID NO: 1354 - RNA, 18 nt, artificial
  Chemically synthesized
ccgcugcagguuccggag

SEQ ID NO: 1355 - RNA, 18 nt, artificial
  Chemically synthesized
cccaaaggaagauauuuu

SEQ ID NO: 1356 - RNA, 18 nt, artificial
  Chemically synthesized
cuuggaaugccgcgagcu

SEQ ID NO: 1357 - RNA, 18 nt, artificial
  Chemically synthesized
ugcucagaugcugucuuu

SEQ ID NO: 1358 - RNA, 18 nt, artificial
  Chemically synthesized
ucagcgcagccgucaucu

SEQ ID NO: 1359 - RNA, 18 nt, artificial
  Chemically synthesized
cauggaguccgccguaag

SEQ ID NO: 1360 - RNA, 18 nt, artificial
  Chemically synthesized
cggagggaagagaggugg

SEQ ID NO: 1361 - RNA, 18 nt, artificial
  Chemically synthesized
cccgcugcagguuccgga

SEQ ID NO: 1362 - RNA, 18 nt, artificial
  Chemically synthesized
aacacaaaguaaccacuu

SEQ ID NO: 1363 - RNA, 18 nt, artificial
  Chemically synthesized
ggaaugaggaaagcaaac

SEQ ID NO: 1364 - RNA, 18 nt, artificial
  Chemically synthesized
guucaugcacucgcugaa

SEQ ID NO: 1365 - RNA, 18 nt, artificial
  Chemically synthesized
guccggagggaagagagg

SEQ ID NO: 1366 - RNA, 18 nt, Artificial Sequence
  Chemically synthesized
ugacagggccgcugugcg

SEQ ID NO: 1367 - RNA, 18 nt, artificial
  Chemically synthesized
ugcagcgggcgcagauga

SEQ ID NO: 1368 - RNA, 18 nt, artificial
  Chemically synthesized
cggccaccuggccaacug

SEQ ID NO: 1369 - RNA, 18 nt, artificial
  Chemically synthesized
cucuccuugguccuggaa

SEQ ID NO: 1370 - RNA, 18 nt, artificial
  Chemically synthesized
cuggccaacugcaugacc

SEQ ID NO: 1371 - RNA, 18 nt, artificial
  Chemically synthesized
cagaugacauuucguuuu

SEQ ID NO: 1372 - RNA, 18 nt, artificial
  Chemically synthesized
ugaacgaggugacccgcu

SEQ ID NO: 1373 - RNA, 18 nt, artificial
  Chemically synthesized
gaaaacacugauuuugga

SEQ ID NO: 1374 - RNA, 18 nt, artificial
  Chemically synthesized
gcagccaggcuggagagg

SEQ ID NO: 1375 - RNA, 18 nt, artificial
  Chemically synthesized
uuuaugugaugccaaaga

SEQ ID NO: 1376 - RNA, 18 nt, artificial
  Chemically synthesized
ucauauuggauugcgccu

SEQ ID NO: 1377 - RNA, 18 nt, artificial
  Chemically synthesized
ggugacccgcuuccuguc

SEQ ID NO: 1378 - RNA, 18 nt, artificial
  Chemically synthesized
ucugagcacagaaaguca

SEQ ID NO: 1379 - RNA, 18 nt, artificial
  Chemically synthesized
aauggagaaaaauuccuc

SEQ ID NO: 1380 - RNA, 18 nt, artificial
  Chemically synthesized
accugcagcgggcgcaga

SEQ ID NO: 1381 - RNA, 18 nt, artificial
  Chemically synthesized
uucguuuuuuacacgaga

SEQ ID NO: 1382 - RNA, 18 nt, artificial
  Chemically synthesized
gaaccugcagcgggcgca

SEQ ID NO: 1383 - RNA, 18 nt, artificial
  Chemically synthesized
acagaaagucaucaaagc

SEQ ID NO: 1384 - RNA, 18 nt, artificial
  Chemically synthesized
uuaugugaugccaaagau

SEQ ID NO: 1385 - RNA, 18 nt, artificial
  Chemically synthesized
uauuggauugcgccuuug

SEQ ID NO: 1386 - RNA, 18 nt, artificial
  Chemically synthesized
accuccggaaccugcagc

SEQ ID NO: 1387 - RNA, 18 nt, artificial
  Chemically synthesized
cugggcagccaggcugga

SEQ ID NO: 1388 - RNA, 18 nt, artificial
  Chemically synthesized
gcagcgggcgcagaugac

SEQ ID NO: 1389 - RNA, 18 nt, artificial
  Chemically synthesized
augccagcugauauaaug

SEQ ID NO: 1390 - RNA, 18 nt, artificial
  Chemically synthesized
auguucauauuggauugc

SEQ ID NO: 1391 - RNA, 18 nt, artificial
  Chemically synthesized
uauuaagugacugaccau

SEQ ID NO: 1392 - RNA, 18 nt, artificial
  Chemically synthesized
uggagaaaaauuccucgu

SEQ ID NO: 1393 - RNA, 18 nt, artificial
  Chemically synthesized
auggagaaaaauuccucg

SEQ ID NO: 1394 - RNA, 18 nt, artificial
  Chemically synthesized
caccuccggaaccugcag

SEQ ID NO: 1395 - RNA, 18 nt, artificial
  Chemically synthesized
ccucucuccuugguccug

SEQ ID NO: 1396 - RNA, 18 nt, artificial
  Chemically synthesized
ugaagcaccuccggaacc

SEQ ID NO: 1397 - RNA, 18 nt, artificial
  Chemically synthesized
aagugacugaccaugcac

SEQ ID NO: 1398 - RNA, 18 nt, artificial
  Chemically synthesized
aaagucaucaaagccuau

SEQ ID NO: 1399 - RNA, 18 nt, artificial
  Chemically synthesized
auuaagugacugaccaug

SEQ ID NO: 1400 - RNA, 18 nt, artificial
  Chemically synthesized
ccggaaccugcagcgggc

SEQ ID NO: 1401 - RNA, 18 nt, artificial
  Chemically synthesized
ccuccggaaccugcagcg

SEQ ID NO: 1402 - RNA, 18 nt, artificial
  Chemically synthesized
ucuaccucucuccuuggu

SEQ ID NO: 1403 - RNA, 18 nt, artificial
  Chemically synthesized
agugucaacacgacaccg

SEQ ID NO: 1404 - RNA, 18 nt, artificial
  Chemically synthesized
accucucuccuugguccu

SEQ ID NO: 1405 - RNA, 18 nt, artificial
  Chemically synthesized
uaugugaugccaaagaug

SEQ ID NO: 1406 - RNA, 18 nt, artificial
  Chemically synthesized
gaggugcgcacucggcug

SEQ ID NO: 1407 - RNA, 18 nt, artificial
  Chemically synthesized
ugcaugaacgaggugacc

SEQ ID NO: 1408 - RNA, 18 nt, artificial
  Chemically synthesized
aaacacugauuuuggaug

SEQ ID NO: 1409 - RNA, 18 nt, artificial
  Chemically synthesized
uaagugacugaccaugca

SEQ ID NO: 1410 - RNA, 18 nt, artificial
  Chemically synthesized
accgaggugcgcacucgg

SEQ ID NO: 1411 - RNA, 18 nt, artificial
  Chemically synthesized
ccgaggugcgcacucggc

SEQ ID NO: 1412 - RNA, 18 nt, artificial
  Chemically synthesized
ccuggccaacugcaugac

SEQ ID NO: 1413 - RNA, 18 nt, artificial
  Chemically synthesized
aaaugccagcugauauaa

SEQ ID NO: 1414 - RNA, 18 nt, artificial
  Chemically synthesized
ucguuuuuuacacgagau

SEQ ID NO: 1415 - RNA, 18 nt, artificial
  Chemically synthesized
caugaacgaggugacccg

SEQ ID NO: 1416 - RNA, 18 nt, artificial
  Chemically synthesized
ugugaugccaaagauguu

SEQ ID NO: 1417 - RNA, 18 nt, artificial
  Chemically synthesized
gacccgcuuccuguccac

SEQ ID NO: 1418 - RNA, 18 nt, artificial
  Chemically synthesized
aagcaccuccggaaccug

SEQ ID NO: 1419 - RNA, 18 nt, artificial
  Chemically synthesized
accuggccaacugcauga

SEQ ID NO: 1420 - RNA, 18 nt, artificial
  Chemically synthesized
cggaaccugcagcgggcg

SEQ ID NO: 1421 - RNA, 18 nt, artificial
  Chemically synthesized
uucauauuggauugcgcc

SEQ ID NO: 1422 - RNA, 18 nt, artificial
  Chemically synthesized
acccgcuuccuguccacg

SEQ ID NO: 1423 - RNA, 18 nt, artificial
  Chemically synthesized
uaccgaggugcgcacucg

SEQ ID NO: 1424 - RNA, 18 nt, artificial
  Chemically synthesized
acgaggugacccgcuucc

SEQ ID NO: 1425 - RNA, 18 nt, artificial
  Chemically synthesized
uaccucucuccuuggucc

SEQ ID NO: 1426 - RNA, 18 nt, artificial
  Chemically synthesized
aacgaggugacccgcuuc

SEQ ID NO: 1427 - RNA, 18 nt, artificial
  Chemically synthesized
aggugcgcacucggcugc

SEQ ID NO: 1428 - RNA, 18 nt, artificial
  Chemically synthesized
augaacgaggugacccgc

SEQ ID NO: 1429 - RNA, 18 nt, artificial
  Chemically synthesized
agaaaaauuccucguccc

SEQ ID NO: 1430 - RNA, 18 nt, artificial
  Chemically synthesized
aacacugauuuuggaugc

SEQ ID NO: 1431 - RNA, 18 nt, artificial
  Chemically synthesized
ucaucugcgcccgcugca

SEQ ID NO: 1432 - RNA, 18 nt, artificial
  Chemically synthesized
caguuggccagguggccg

SEQ ID NO: 1433 - RNA, 18 nt, artificial
  Chemically synthesized
uuccaggaccaaggagag

SEQ ID NO: 1434 - RNA, 18 nt, artificial
  Chemically synthesized
ggucaugcaguuggccag

SEQ ID NO: 1435 - RNA, 18 nt, artificial
  Chemically synthesized
aaaacgaaaugucaucug

SEQ ID NO: 1436 - RNA, 18 nt, artificial
  Chemically synthesized
agcgggucaccucguuca

SEQ ID NO: 1437 - RNA, 18 nt, artificial
  Chemically synthesized
uccaaaaucaguguuuuc

SEQ ID NO: 1438 - RNA, 18 nt, artificial
  Chemically synthesized
ccucuccagccuggcugc

SEQ ID NO: 1439 - RNA, 18 nt, artificial
  Chemically synthesized
ucuuuggcaucacauaaa

SEQ ID NO: 1440 - RNA, 18 nt, artificial
  Chemically synthesized
aggcgcaauccaauauga

SEQ ID NO: 1441 - RNA, 18 nt, artificial
  Chemically synthesized
gacaggaagcgggucacc

SEQ ID NO: 1442 - RNA, 18 nt, artificial
  Chemically synthesized
ugacuuucugugcucaga

SEQ ID NO: 1443 - RNA, 18 nt, artificial
  Chemically synthesized
gaggaauuuuucuccauu

SEQ ID NO: 1444 - RNA, 18 nt, artificial
  Chemically synthesized
ucugcgcccgcugcaggu

SEQ ID NO: 1445 - RNA, 18 nt, artificial
  Chemically synthesized
ucucguguaaaaaacgaa

SEQ ID NO: 1446 - RNA, 18 nt, artificial
  Chemically synthesized
ugcgcccgcugcagguuc

SEQ ID NO: 1447 - RNA, 18 nt, artificial
  Chemically synthesized
gcuuugaugacuuucugu

SEQ ID NO: 1448 - RNA, 18 nt, artificial
  Chemically synthesized
aucuuuggcaucacauaa

SEQ ID NO: 1449 - RNA, 18 nt, artificial
  Chemically synthesized
caaaggcgcaauccaaua

SEQ ID NO: 1450 - RNA, 18 nt, artificial
  Chemically synthesized
gcugcagguuccggaggu

SEQ ID NO: 1451 - RNA, 18 nt, artificial
  Chemically synthesized
uccagccuggcugcccag

SEQ ID NO: 1452 - RNA, 18 nt, artificial
  Chemically synthesized
gucaucugcgcccgcugc

SEQ ID NO: 1453 - RNA, 18 nt, artificial
  Chemically synthesized
cauuauaucagcuggcau

SEQ ID NO: 1454 - RNA, 18 nt, artificial
  Chemically synthesized
gcaauccaauaugaacau

SEQ ID NO: 1455 - RNA, 18 nt, artificial
  Chemically synthesized
auggucagucacuuaaua

SEQ ID NO: 1456 - RNA, 18 nt, artificial
  Chemically synthesized
acgaggaauuuuucucca

SEQ ID NO: 1457 - RNA, 18 nt, artificial
  Chemically synthesized
cgaggaauuuuucuccau

SEQ ID NO: 1458 - RNA, 18 nt, artificial
  Chemically synthesized
cugcagguuccggaggug

SEQ ID NO: 1459 - RNA, 18 nt, artificial
  Chemically synthesized
caggaccaaggagagagg

SEQ ID NO: 1460 - RNA, 18 nt, artificial
  Chemically synthesized
gguuccggaggugcuuca

SEQ ID NO: 1461 - RNA, 18 nt, artificial
  Chemically synthesized
gugcauggucagucacuu

SEQ ID NO: 1462 - RNA, 18 nt, artificial
  Chemically synthesized
auaggcuuugaugacuuu

SEQ ID NO: 1463 - RNA, 18 nt, artificial
  Chemically synthesized
cauggucagucacuuaau

SEQ ID NO: 1464 - RNA, 18 nt, artificial
  Chemically synthesized
gcccgcugcagguuccgg

SEQ ID NO: 1465 - RNA, 18 nt, artificial
  Chemically synthesized
cgcugcagguuccggagg

SEQ ID NO: 1466 - RNA, 18 nt, artificial
  Chemically synthesized
accaaggagagagguaga

SEQ ID NO: 1467 - RNA, 18 nt, artificial
  Chemically synthesized
cggugucguguugacacu

SEQ ID NO: 1468 - RNA, 18 nt, artificial
  Chemically synthesized
aggaccaaggagagaggu

SEQ ID NO: 1469 - RNA, 18 nt, artificial
  Chemically synthesized
caucuuuggcaucacaua

SEQ ID NO: 1470 - RNA, 18 nt, artificial
  Chemically synthesized
cagccgagugcgcaccuc

SEQ ID NO: 1471 - RNA, 18 nt, artificial
  Chemically synthesized
ggucaccucguucaugca

SEQ ID NO: 1472 - RNA, 18 nt, artificial
  Chemically synthesized
cauccaaaaucaguguuu

SEQ ID NO: 1473 - RNA, 18 nt, artificial
  Chemically synthesized
ugcauggucagucacuua

SEQ ID NO: 1474 - RNA, 18 nt, artificial
  Chemically synthesized
ccgagugcgcaccucggu

SEQ ID NO: 1475 - RNA, 18 nt, artificial
  Chemically synthesized
gccgagugcgcaccucgg

SEQ ID NO: 1476 - RNA, 18 nt, artificial
  Chemically synthesized
gucaugcaguuggccagg

SEQ ID NO: 1477 - RNA, 18 nt, artificial
  Chemically synthesized
uuauaucagcuggcauuu

SEQ ID NO: 1478 - RNA, 18 nt, artificial
  Chemically synthesized
aucucguguaaaaaacga

SEQ ID NO: 1479 - RNA, 18 nt, artificial
  Chemically synthesized
cgggucaccucguucaug

SEQ ID NO: 1480 - RNA, 18 nt, artificial
  Chemically synthesized
aacaucuuuggcaucaca

SEQ ID NO: 1481 - RNA, 18 nt, artificial
  Chemically synthesized
guggacaggaagcggguc

SEQ ID NO: 1482 - RNA, 18 nt, artificial
  Chemically synthesized
cagguuccggaggugcuu

SEQ ID NO: 1483 - RNA, 18 nt, artificial
  Chemically synthesized
ucaugcaguuggccaggu

SEQ ID NO: 1484 - RNA, 18 nt, artificial
  Chemically synthesized
cgcccgcugcagguuccg

SEQ ID NO: 1485 - RNA, 18 nt, artificial
  Chemically synthesized
ggcgcaauccaauaugaa

SEQ ID NO: 1486 - RNA, 18 nt, artificial
  Chemically synthesized
cguggacaggaagcgggu

SEQ ID NO: 1487 - RNA, 18 nt, artificial
  Chemically synthesized
cgagugcgcaccucggua

SEQ ID NO: 1488 - RNA, 18 nt, artificial
  Chemically synthesized
ggaagcgggucaccucgu

SEQ ID NO: 1489 - RNA, 18 nt, artificial
  Chemically synthesized
ggaccaaggagagaggua

SEQ ID NO: 1490 - RNA, 18 nt, artificial
  Chemically synthesized
gaagcgggucaccucguu

SEQ ID NO: 1491 - RNA, 18 nt, artificial
  Chemically synthesized
gcagccgagugcgcaccu

SEQ ID NO: 1492 - RNA, 18 nt, artificial
  Chemically synthesized
gcgggucaccucguucau

SEQ ID NO: 1493 - RNA, 18 nt, artificial
  Chemically synthesized
gggacgaggaauuuuucu

SEQ ID NO: 1494 - RNA, 18 nt, Artificial Sequence
  Chemically synthesized
gcauccaaaaucaguguu

SEQ ID NO: 1495 - RNA, 19 nt, artificial
  Chemically synthesized
cuccgaagccgccauaaua

SEQ ID NO: 1496 - RNA, 19 nt, artificial
  Chemically synthesized
ggaagccggugguggagaa

SEQ ID NO: 1497 - RNA, 19 nt, artificial
  Chemically synthesized
guucuguguuugcauuuaa

SEQ ID NO: 1498 - RNA, 19 nt, artificial
  Chemically synthesized
ggguucuaugauauuugua

SEQ ID NO: 1499 - RNA, 19 nt, artificial
  Chemically synthesized
ccuccacuaugauccuuaa

SEQ ID NO: 1500 - RNA, 19 nt, artificial
  Chemically synthesized
gcuguauccucauaggaaa

SEQ ID NO: 1501 - RNA, 19 nt, artificial
  Chemically synthesized
acgacuuuguacucagaaa

SEQ ID NO: 1502 - RNA, 19 nt, artificial
  Chemically synthesized
gguuguucuguguuugcau

SEQ ID NO: 1503 - RNA, 19 nt, artificial
  Chemically synthesized
ccaacuccaagcuggagaa

SEQ ID NO: 1504 - RNA, 19 nt, artificial
  Chemically synthesized
cgacuuuguacucagaaau

SEQ ID NO: 1505 - RNA, 19 nt, artificial
  Chemically synthesized
cuaugauccuuaaaggauu

SEQ ID NO: 1506 - RNA, 19 nt, artificial
  Chemically synthesized
ccgaagccgccauaauaaa

SEQ ID NO: 1507 - RNA, 19 nt, artificial
  Chemically synthesized
gacuuuguacucagaaauu

SEQ ID NO: 1508 - RNA, 19 nt, artificial
  Chemically synthesized
cuuuguacucagaaauuga

SEQ ID NO: 1509 - RNA, 19 nt, artificial
  Chemically synthesized
guuguucuguguuugcauu

SEQ ID NO: 1510 - RNA, 19 nt, artificial
  Chemically synthesized
ggguuguucuguguuugca

SEQ ID NO: 1511 - RNA, 19 nt, artificial
  Chemically synthesized
ggcaccagcccaacuccaa

SEQ ID NO: 1512 - RNA, 19 nt, artificial
  Chemically synthesized
agaaaaaccgacugcggaa

SEQ ID NO: 1513 - RNA, 19 nt, artificial
  Chemically synthesized
uguucuguguuugcauuua

SEQ ID NO: 1514 - RNA, 19 nt, artificial
  Chemically synthesized
agccggugguggagaagau

SEQ ID NO: 1515 - RNA, 19 nt, artificial
  Chemically synthesized
agaugaagcugcuguacca

SEQ ID NO: 1516 - RNA, 19 nt, artificial
  Chemically synthesized
cagagaaugugugugcaga

SEQ ID NO: 1517 - RNA, 19 nt, artificial
  Chemically synthesized
cucagaaauugaacucuca

SEQ ID NO: 1518 - RNA, 19 nt, artificial
  Chemically synthesized
aggacuacagcgaaggcua

SEQ ID NO: 1519 - RNA, 19 nt, artificial
  Chemically synthesized
gcuccgaagccgccauaau

SEQ ID NO: 1520 - RNA, 19 nt, artificial
  Chemically synthesized
gcacgacuuuguacucaga

SEQ ID NO: 1521 - RNA, 19 nt, artificial
  Chemically synthesized
ccgccauaauaaaaucuga

SEQ ID NO: 1522 - RNA, 19 nt, artificial
  Chemically synthesized
ccagcgacacgcagaugaa

SEQ ID NO: 1523 - RNA, 19 nt, artificial
  Chemically synthesized
gcagcaucgagcagcugaa

SEQ ID NO: 1524 - RNA, 19 nt, artificial
  Chemically synthesized
uccgaagccgccauaauaa

SEQ ID NO: 1525 - RNA, 19 nt, artificial
  Chemically synthesized
cgaagccgccauaauaaaa

SEQ ID NO: 1526 - RNA, 19 nt, artificial
  Chemically synthesized
gguucuaugauauuuguag

SEQ ID NO: 1527 - RNA, 19 nt, artificial
  Chemically synthesized
ccaaaaggcuccugagugu

SEQ ID NO: 1528 - RNA, 19 nt, artificial
  Chemically synthesized
cgcagaugaagcugcugua

SEQ ID NO: 1529 - RNA, 19 nt, artificial
  Chemically synthesized
cagagucccugccguuuua

SEQ ID NO: 1530 - RNA, 19 nt, artificial
  Chemically synthesized
gagaaaaaccgacugcgga

SEQ ID NO: 1531 - RNA, 19 nt, artificial
  Chemically synthesized
gccuccacuaugauccuua

SEQ ID NO: 1532 - RNA, 19 nt, artificial
  Chemically synthesized
uguguuugcauuuaagcaa

SEQ ID NO: 1533 - RNA, 19 nt, artificial
  Chemically synthesized
cuaccugaagcacagcaaa

SEQ ID NO: 1534 - RNA, 19 nt, artificial
  Chemically synthesized
gugggugccuccacuauga

SEQ ID NO: 1535 - RNA, 19 nt, artificial
  Chemically synthesized
gacgcgcccuucuccggaa

SEQ ID NO: 1536 - RNA, 19 nt, artificial
  Chemically synthesized
ccaagagccugcaccagga

SEQ ID NO: 1537 - RNA, 19 nt, artificial
  Chemically synthesized
ggagauggcugucagcuac

SEQ ID NO: 1538 - RNA, 19 nt, artificial
  Chemically synthesized
ggccaaaaggcuccugagu

SEQ ID NO: 1539 - RNA, 19 nt, artificial
  Chemically synthesized
ugcaguuccugacgcucca

SEQ ID NO: 1540 - RNA, 19 nt, artificial
  Chemically synthesized
ccauucucagagaaugugu

SEQ ID NO: 1541 - RNA, 19 nt, artificial
  Chemically synthesized
cuguguuugcauuuaagca

SEQ ID NO: 1542 - RNA, 19 nt, artificial
  Chemically synthesized
gagaaugugugugcagagu

SEQ ID NO: 1543 - RNA, 19 nt, artificial
  Chemically synthesized
guguuugcauuuaagcaag

SEQ ID NO: 1544 - RNA, 19 nt, artificial
  Chemically synthesized
ccgugcaguuccugacgcu

SEQ ID NO: 1545 - RNA, 19 nt, artificial
  Chemically synthesized
uggagauggcugucagcua

SEQ ID NO: 1546 - RNA, 19 nt, artificial
  Chemically synthesized
gcaccaggacuacagcgaa

SEQ ID NO: 1547 - RNA, 19 nt, artificial
  Chemically synthesized
gcauuuaagcaagugacuu

SEQ ID NO: 1548 - RNA, 19 nt, artificial
  Chemically synthesized
ggacuacagcgaaggcuac

SEQ ID NO: 1549 - RNA, 19 nt, artificial
  Chemically synthesized
gaaauugaacucucaguca

SEQ ID NO: 1550 - RNA, 19 nt, artificial
  Chemically synthesized
agcuguauccucauaggaa

SEQ ID NO: 1551 - RNA, 19 nt, artificial
  Chemically synthesized
cucgagcuguauccucaua

SEQ ID NO: 1552 - RNA, 19 nt, artificial
  Chemically synthesized
cucagagaaugugugugca

SEQ ID NO: 1553 - RNA, 19 nt, artificial
  Chemically synthesized
agcugaagcugcugcugga

SEQ ID NO: 1554 - RNA, 19 nt, artificial
  Chemically synthesized
cccuucuccggaaggcucu

SEQ ID NO: 1555 - RNA, 19 nt, artificial
  Chemically synthesized
aggccgacauccuggagau

SEQ ID NO: 1556 - RNA, 19 nt, artificial
  Chemically synthesized
cccugagggccauggccaa

SEQ ID NO: 1557 - RNA, 19 nt, artificial
  Chemically synthesized
gggcacgacuuuguacuca

SEQ ID NO: 1558 - RNA, 19 nt, artificial
  Chemically synthesized
gggccauggccaaaaggcu

SEQ ID NO: 1559 - RNA, 19 nt, artificial
  Chemically synthesized
ggcacgacuuuguacucag

SEQ ID NO: 1560 - RNA, 19 nt, artificial
  Chemically synthesized
cagaaauugaacucucagu

SEQ ID NO: 1561 - RNA, 19 nt, artificial
  Chemically synthesized
agcccaacuccaagcugga

SEQ ID NO: 1562 - RNA, 19 nt, artificial
  Chemically synthesized
gccuguagaggacuuucuu

SEQ ID NO: 1563 - RNA, 19 nt, artificial
  Chemically synthesized
gggcgagccugcuccucuc

SEQ ID NO: 1564 - RNA, 19 nt, artificial
  Chemically synthesized
gccagcgacacgcagauga

SEQ ID NO: 1565 - RNA, 19 nt, artificial
  Chemically synthesized
ugcuccgaagccgccauaa

SEQ ID NO: 1566 - RNA, 19 nt, artificial
  Chemically synthesized
aggccgaacucgagcugua

SEQ ID NO: 1567 - RNA, 19 nt, artificial
  Chemically synthesized
ggccgaacucgagcuguau

SEQ ID NO: 1568 - RNA, 19 nt, artificial
  Chemically synthesized
gcagagucccugccguuuu

SEQ ID NO: 1569 - RNA, 19 nt, artificial
  Chemically synthesized
cuguagaggacuuucuuca

SEQ ID NO: 1570 - RNA, 19 nt, artificial
  Chemically synthesized
agagccugcaccaggacua

SEQ ID NO: 1571 - RNA, 19 nt, artificial
  Chemically synthesized
gaagccgccauaauaaaau

SEQ ID NO: 1572 - RNA, 19 nt, artificial
  Chemically synthesized
cccagccuguagaggacuu

SEQ ID NO: 1573 - RNA, 19 nt, artificial
  Chemically synthesized
gcuaccugaagcacagcaa

SEQ ID NO: 1574 - RNA, 19 nt, artificial
  Chemically synthesized
ccaaagagaaaaaccgacu

SEQ ID NO: 1575 - RNA, 19 nt, artificial
  Chemically synthesized
uggagaagaugcgccgcga

SEQ ID NO: 1576 - RNA, 19 nt, artificial
  Chemically synthesized
gggugggugccuccacuau

SEQ ID NO: 1577 - RNA, 19 nt, artificial
  Chemically synthesized
cugucagcuaccugaagca

SEQ ID NO: 1578 - RNA, 19 nt, artificial
  Chemically synthesized
gucagcuaccugaagcaca

SEQ ID NO: 1579 - RNA, 19 nt, artificial
  Chemically synthesized
ccucauaggaaacagugau

SEQ ID NO: 1580 - RNA, 19 nt, artificial
  Chemically synthesized
cacgacuuuguacucagaa

SEQ ID NO: 1581 - RNA, 19 nt, artificial
  Chemically synthesized
ugcggaagccgguggugga

SEQ ID NO: 1582 - RNA, 19 nt, artificial
  Chemically synthesized
gccgccagcgacacgcaga

SEQ ID NO: 1583 - RNA, 19 nt, artificial
  Chemically synthesized
cgcccuucuccggaaggcu

SEQ ID NO: 1584 - RNA, 19 nt, artificial
  Chemically synthesized
gcaagugacuucugggaag

SEQ ID NO: 1585 - RNA, 19 nt, artificial
  Chemically synthesized
cacauuugccuuuugugaa

SEQ ID NO: 1586 - RNA, 19 nt, artificial
  Chemically synthesized
aacucucagucacguggaa

SEQ ID NO: 1587 - RNA, 19 nt, artificial
  Chemically synthesized
ccaagcuggagaaggccga

SEQ ID NO: 1588 - RNA, 19 nt, artificial
  Chemically synthesized
agcuggagaaggccgacau

SEQ ID NO: 1589 - RNA, 19 nt, artificial
  Chemically synthesized
gugcagagucccugccguu

SEQ ID NO: 1590 - RNA, 19 nt, artificial
  Chemically synthesized
gccuguagggaagcgccuu

SEQ ID NO: 1591 - RNA, 19 nt, artificial
  Chemically synthesized
uggcugucagcuaccugaa

SEQ ID NO: 1592 - RNA, 19 nt, artificial
  Chemically synthesized
ggagaagaugcgccgcgac

SEQ ID NO: 1593 - RNA, 19 nt, artificial
  Chemically synthesized
cuguguggguggaugcgug

SEQ ID NO: 1594 - RNA, 19 nt, artificial
  Chemically synthesized
gugugggcacgacuuugua

SEQ ID NO: 1595 - RNA, 19 nt, artificial
  Chemically synthesized
gcaucaacagcagcaucga

SEQ ID NO: 1596 - RNA, 19 nt, artificial
  Chemically synthesized
gccuguuccgcgccaggca

SEQ ID NO: 1597 - RNA, 19 nt, artificial
  Chemically synthesized
gccuuuugugaaggccgaa

SEQ ID NO: 1598 - RNA, 19 nt, artificial
  Chemically synthesized
cauuuaagcaagugacuuc

SEQ ID NO: 1599 - RNA, 19 nt, artificial
  Chemically synthesized
ggguggaugcgugugggca

SEQ ID NO: 1600 - RNA, 19 nt, artificial
  Chemically synthesized
ggcccaucuucugccaagu

SEQ ID NO: 1601 - RNA, 19 nt, artificial
  Chemically synthesized
cugcuccgaagccgccaua

SEQ ID NO: 1602 - RNA, 19 nt, artificial
  Chemically synthesized
ccugcuccucucgccugua

SEQ ID NO: 1603 - RNA, 19 nt, artificial
  Chemically synthesized
gcgacacgcagaugaagcu

SEQ ID NO: 1604 - RNA, 19 nt, artificial
  Chemically synthesized
cuccacuaugauccuuaaa

SEQ ID NO: 1605 - RNA, 19 nt, artificial
  Chemically synthesized
agccuguagaggacuuucu

SEQ ID NO: 1606 - RNA, 19 nt, artificial
  Chemically synthesized
cgccauaauaaaaucugau

SEQ ID NO: 1607 - RNA, 19 nt, artificial
  Chemically synthesized
cggaagccggugguggaga

SEQ ID NO: 1608 - RNA, 19 nt, artificial
  Chemically synthesized
gagugugccugguggucug

SEQ ID NO: 1609 - RNA, 19 nt, artificial
  Chemically synthesized
gcccuucuccggaaggcuc

SEQ ID NO: 1610 - RNA, 19 nt, artificial
  Chemically synthesized
ggagaaggccgacauccug

SEQ ID NO: 1611 - RNA, 19 nt, artificial
  Chemically synthesized
cacuaugauccuuaaagga

SEQ ID NO: 1612 - RNA, 19 nt, artificial
  Chemically synthesized
gccugcuccucucgccugu

SEQ ID NO: 1613 - RNA, 19 nt, artificial
  Chemically synthesized
aacucgagcuguauccuca

SEQ ID NO: 1614 - RNA, 19 nt, artificial
  Chemically synthesized
gcccguagcugcugggcgu

SEQ ID NO: 1615 - RNA, 19 nt, artificial
  Chemically synthesized
gaacucucagucacgugga

SEQ ID NO: 1616 - RNA, 19 nt, artificial
  Chemically synthesized
cccaacuccaagcuggaga

SEQ ID NO: 1617 - RNA, 19 nt, artificial
  Chemically synthesized
gccaaaaggcuccugagug

SEQ ID NO: 1618 - RNA, 19 nt, artificial
  Chemically synthesized
ccaucuucugccaaguguc

SEQ ID NO: 1619 - RNA, 19 nt, artificial
  Chemically synthesized
cgccgcgaccgcaucaaca

SEQ ID NO: 1620 - RNA, 19 nt, artificial
  Chemically synthesized
ggacaaucagggcccaucu

SEQ ID NO: 1621 - RNA, 19 nt, artificial
  Chemically synthesized
agcaagugacuucugggaa

SEQ ID NO: 1622 - RNA, 19 nt, artificial
  Chemically synthesized
cccugccguuuuaggacaa

SEQ ID NO: 1623 - RNA, 19 nt, artificial
  Chemically synthesized
ccacuaugauccuuaaagg

SEQ ID NO: 1624 - RNA, 19 nt, artificial
  Chemically synthesized
uguuugcauuuaagcaagu

SEQ ID NO: 1625 - RNA, 19 nt, artificial
  Chemically synthesized
cccaaagagaaaaaccgac

SEQ ID NO: 1626 - RNA, 19 nt, artificial
  Chemically synthesized
uggagaaggccgacauccu

SEQ ID NO: 1627 - RNA, 19 nt, artificial
  Chemically synthesized
uauuauggcggcuucggag

SEQ ID NO: 1628 - RNA, 19 nt, artificial
  Chemically synthesized
uucuccaccaccggcuucc

SEQ ID NO: 1629 - RNA, 19 nt, artificial
  Chemically synthesized
uuaaaugcaaacacagaac

SEQ ID NO: 1630 - RNA, 19 nt, artificial
  Chemically synthesized
uacaaauaucauagaaccc

SEQ ID NO: 1631 - RNA, 19 nt, artificial
  Chemically synthesized
uuaaggaucauaguggagg

SEQ ID NO: 1632 - RNA, 19 nt, artificial
  Chemically synthesized
uuuccuaugaggauacagc

SEQ ID NO: 1633 - RNA, 19 nt, artificial
  Chemically synthesized
uuucugaguacaaagucgu

SEQ ID NO: 1634 - RNA, 19 nt, artificial
  Chemically synthesized
augcaaacacagaacaacc

SEQ ID NO: 1635 - RNA, 19 nt, artificial
  Chemically synthesized
uucuccagcuuggaguugg

SEQ ID NO: 1636 - RNA, 19 nt, artificial
  Chemically synthesized
auuucugaguacaaagucg

SEQ ID NO: 1637 - RNA, 19 nt, artificial
  Chemically synthesized
aauccuuuaaggaucauag

SEQ ID NO: 1638 - RNA, 19 nt, artificial
  Chemically synthesized
uuuauuauggcggcuucgg

SEQ ID NO: 1639 - RNA, 19 nt, artificial
  Chemically synthesized
aauuucugaguacaaaguc

SEQ ID NO: 1640 - RNA, 19 nt, artificial
  Chemically synthesized
ucaauuucugaguacaaag

SEQ ID NO: 1641 - RNA, 19 nt, artificial
  Chemically synthesized
aaugcaaacacagaacaac

SEQ ID NO: 1642 - RNA, 19 nt, artificial
  Chemically synthesized
ugcaaacacagaacaaccc

SEQ ID NO: 1643 - RNA, 19 nt, artificial
  Chemically synthesized
uuggaguugggcuggugcc

SEQ ID NO: 1644 - RNA, 19 nt, artificial
  Chemically synthesized
uuccgcagucgguuuuucu

SEQ ID NO: 1645 - RNA, 19 nt, artificial
  Chemically synthesized
uaaaugcaaacacagaaca

SEQ ID NO: 1646 - RNA, 19 nt, artificial
  Chemically synthesized
aucuucuccaccaccggcu

SEQ ID NO: 1647 - RNA, 19 nt, artificial
  Chemically synthesized
ugguacagcagcuucaucu

SEQ ID NO: 1648 - RNA, 19 nt, artificial
  Chemically synthesized
ucugcacacacauucucug

SEQ ID NO: 1649 - RNA, 19 nt, artificial
  Chemically synthesized
ugagaguucaauuucugag

SEQ ID NO: 1650 - RNA, 19 nt, artificial
  Chemically synthesized
uagccuucgcuguaguccu

SEQ ID NO: 1651 - RNA, 19 nt, artificial
  Chemically synthesized
auuauggcggcuucggagc

SEQ ID NO: 1652 - RNA, 19 nt, artificial
  Chemically synthesized
ucugaguacaaagucgugc

SEQ ID NO: 1653 - RNA, 19 nt, artificial
  Chemically synthesized
ucagauuuuauuauggcgg

SEQ ID NO: 1654 - RNA, 19 nt, artificial
  Chemically synthesized
uucaucugcgugucgcugg

SEQ ID NO: 1655 - RNA, 19 nt, artificial
  Chemically synthesized
uucagcugcucgaugcugc

SEQ ID NO: 1656 - RNA, 19 nt, artificial
  Chemically synthesized
uuauuauggcggcuucgga

SEQ ID NO: 1657 - RNA, 19 nt, artificial
  Chemically synthesized
uuuuauuauggcggcuucg

SEQ ID NO: 1658 - RNA, 19 nt, artificial
  Chemically synthesized
cuacaaauaucauagaacc

SEQ ID NO: 1659 - RNA, 19 nt, artificial
  Chemically synthesized
acacucaggagccuuuugg

SEQ ID NO: 1660 - RNA, 19 nt, artificial
  Chemically synthesized
uacagcagcuucaucugcg

SEQ ID NO: 1661 - RNA, 19 nt, artificial
  Chemically synthesized
uaaaacggcagggacucug

SEQ ID NO: 1662 - RNA, 19 nt, artificial
  Chemically synthesized
uccgcagucgguuuuucuc

SEQ ID NO: 1663 - RNA, 19 nt, artificial
  Chemically synthesized
uaaggaucauaguggaggc

SEQ ID NO: 1664 - RNA, 19 nt, artificial
  Chemically synthesized
uugcuuaaaugcaaacaca

SEQ ID NO: 1665 - RNA, 19 nt, artificial
  Chemically synthesized
uuugcugugcuucagguag

SEQ ID NO: 1666 - RNA, 19 nt, artificial
  Chemically synthesized
ucauaguggaggcacccac

SEQ ID NO: 1667 - RNA, 19 nt, artificial
  Chemically synthesized
uuccggagaagggcgcguc

SEQ ID NO: 1668 - RNA, 19 nt, artificial
  Chemically synthesized
uccuggugcaggcucuugg

SEQ ID NO: 1669 - RNA, 19 nt, artificial
  Chemically synthesized
guagcugacagccaucucc

SEQ ID NO: 1670 - RNA, 19 nt, artificial
  Chemically synthesized
acucaggagccuuuuggcc

SEQ ID NO: 1671 - RNA, 19 nt, artificial
  Chemically synthesized
uggagcgucaggaacugca

SEQ ID NO: 1672 - RNA, 19 nt, artificial
  Chemically synthesized
acacauucucugagaaugg

SEQ ID NO: 1673 - RNA, 19 nt, artificial
  Chemically synthesized
ugcuuaaaugcaaacacag

SEQ ID NO: 1674 - RNA, 19 nt, artificial
  Chemically synthesized
acucugcacacacauucuc

SEQ ID NO: 1675 - RNA, 19 nt, artificial
  Chemically synthesized
cuugcuuaaaugcaaacac

SEQ ID NO: 1676 - RNA, 19 nt, artificial
  Chemically synthesized
agcgucaggaacugcacgg

SEQ ID NO: 1677 - RNA, 19 nt, artificial
  Chemically synthesized
uagcugacagccaucucca

SEQ ID NO: 1678 - RNA, 19 nt, artificial
  Chemically synthesized
uucgcuguaguccuggugc

SEQ ID NO: 1679 - RNA, 19 nt, artificial
  Chemically synthesized
aagucacuugcuuaaaugc

SEQ ID NO: 1680 - RNA, 19 nt, artificial
  Chemically synthesized
guagccuucgcuguagucc

SEQ ID NO: 1681 - RNA, 19 nt, artificial
  Chemically synthesized
ugacugagaguucaauuuc

SEQ ID NO: 1682 - RNA, 19 nt, artificial
  Chemically synthesized
uuccuaugaggauacagcu

SEQ ID NO: 1683 - RNA, 19 nt, artificial
  Chemically synthesized
uaugaggauacagcucgag

SEQ ID NO: 1684 - RNA, 19 nt, artificial
  Chemically synthesized
ugcacacacauucucugag

SEQ ID NO: 1685 - RNA, 19 nt, artificial
  Chemically synthesized
uccagcagcagcuucagcu

SEQ ID NO: 1686 - RNA, 19 nt, artificial
  Chemically synthesized
agagccuuccggagaaggg

SEQ ID NO: 1687 - RNA, 19 nt, artificial
  Chemically synthesized
aucuccaggaugucggccu

SEQ ID NO: 1688 - RNA, 19 nt, artificial
  Chemically synthesized
uuggccauggcccucaggg

SEQ ID NO: 1689 - RNA, 19 nt, artificial
  Chemically synthesized
ugaguacaaagucgugccc

SEQ ID NO: 1690 - RNA, 19 nt, artificial
  Chemically synthesized
agccuuuuggccauggccc

SEQ ID NO: 1691 - RNA, 19 nt, artificial
  Chemically synthesized
cugaguacaaagucgugcc

SEQ ID NO: 1692 - RNA, 19 nt, artificial
  Chemically synthesized
acugagaguucaauuucug

SEQ ID NO: 1693 - RNA, 19 nt, artificial
  Chemically synthesized
uccagcuuggaguugggcu

SEQ ID NO: 1694 - RNA, 19 nt, artificial
  Chemically synthesized
aagaaaguccucuacaggc

SEQ ID NO: 1695 - RNA, 19 nt, artificial
  Chemically synthesized
gagaggagcaggcucgccc

SEQ ID NO: 1696 - RNA, 19 nt, artificial
  Chemically synthesized
ucaucugcgugucgcuggc

SEQ ID NO: 1697 - RNA, 19 nt, artificial
  Chemically synthesized
uuauggcggcuucggagca

SEQ ID NO: 1698 - RNA, 19 nt, artificial
  Chemically synthesized
uacagcucgaguucggccu

SEQ ID NO: 1699 - RNA, 19 nt, artificial
  Chemically synthesized
auacagcucgaguucggcc

SEQ ID NO: 1700 - RNA, 19 nt, artificial
  Chemically synthesized
aaaacggcagggacucugc

SEQ ID NO: 1701 - RNA, 19 nt, artificial
  Chemically synthesized
ugaagaaaguccucuacag

SEQ ID NO: 1702 - RNA, 19 nt, artificial
  Chemically synthesized
uaguccuggugcaggcucu

SEQ ID NO: 1703 - RNA, 19 nt, artificial
  Chemically synthesized
auuuuauuauggcggcuuc

SEQ ID NO: 1704 - RNA, 19 nt, artificial
  Chemically synthesized
aaguccucuacaggcuggg

SEQ ID NO: 1705 - RNA, 19 nt, artificial
  Chemically synthesized
uugcugugcuucagguagc

SEQ ID NO: 1706 - RNA, 19 nt, artificial
  Chemically synthesized
agucgguuuuucucuuugg

SEQ ID NO: 1707 - RNA, 19 nt, artificial
  Chemically synthesized
ucgcggcgcaucuucucca

SEQ ID NO: 1708 - RNA, 19 nt, artificial
  Chemically synthesized
auaguggaggcacccaccc

SEQ ID NO: 1709 - RNA, 19 nt, artificial
  Chemically synthesized
ugcuucagguagcugacag

SEQ ID NO: 1710 - RNA, 19 nt, artificial
  Chemically synthesized
ugugcuucagguagcugac

SEQ ID NO: 1711 - RNA, 19 nt, artificial
  Chemically synthesized
aucacuguuuccuaugagg

SEQ ID NO: 1712 - RNA, 19 nt, artificial
  Chemically synthesized
uucugaguacaaagucgug

SEQ ID NO: 1713 - RNA, 19 nt, artificial
  Chemically synthesized
uccaccaccggcuuccgca

SEQ ID NO: 1714 - RNA, 19 nt, artificial
  Chemically synthesized
ucugcgugucgcuggcggc

SEQ ID NO: 1715 - RNA, 19 nt, artificial
  Chemically synthesized
agccuuccggagaagggcg

SEQ ID NO: 1716 - RNA, 19 nt, artificial
  Chemically synthesized
cuucccagaagucacuugc

SEQ ID NO: 1717 - RNA, 19 nt, artificial
  Chemically synthesized
uucacaaaaggcaaaugug

SEQ ID NO: 1718 - RNA, 19 nt, artificial
  Chemically synthesized
uuccacgugacugagaguu

SEQ ID NO: 1719 - RNA, 19 nt, artificial
  Chemically synthesized
ucggccuucuccagcuugg

SEQ ID NO: 1720 - RNA, 19 nt, artificial
  Chemically synthesized
augucggccuucuccagcu

SEQ ID NO: 1721 - RNA, 19 nt, artificial
  Chemically synthesized
aacggcagggacucugcac

SEQ ID NO: 1722 - RNA, 19 nt, artificial
  Chemically synthesized
aaggcgcuucccuacaggc

SEQ ID NO: 1723 - RNA, 19 nt, artificial
  Chemically synthesized
uucagguagcugacagcca

SEQ ID NO: 1724 - RNA, 19 nt, artificial
  Chemically synthesized
gucgcggcgcaucuucucc

SEQ ID NO: 1725 - RNA, 19 nt, artificial
  Chemically synthesized
cacgcauccacccacacag

SEQ ID NO: 1726 - RNA, 19 nt, artificial
  Chemically synthesized
uacaaagucgugcccacac

SEQ ID NO: 1727 - RNA, 19 nt, artificial
  Chemically synthesized
ucgaugcugcuguugaugc

SEQ ID NO: 1728 - RNA, 19 nt, artificial
  Chemically synthesized
ugccuggcgcggaacaggc

SEQ ID NO: 1729 - RNA, 19 nt, artificial
  Chemically synthesized
uucggccuucacaaaaggc

SEQ ID NO: 1730 - RNA, 19 nt, artificial
  Chemically synthesized
gaagucacuugcuuaaaug

SEQ ID NO: 1731 - RNA, 19 nt, artificial
  Chemically synthesized
ugcccacacgcauccaccc

SEQ ID NO: 1732 - RNA, 19 nt, artificial
  Chemically synthesized
acuuggcagaagaugggcc

SEQ ID NO: 1733 - RNA, 19 nt, artificial
  Chemically synthesized
uauggcggcuucggagcag

SEQ ID NO: 1734 - RNA, 19 nt, artificial
  Chemically synthesized
uacaggcgagaggagcagg

SEQ ID NO: 1735 - RNA, 19 nt, artificial
  Chemically synthesized
agcuucaucugcgugucgc

SEQ ID NO: 1736 - RNA, 19 nt, artificial
  Chemically synthesized
uuuaaggaucauaguggag

SEQ ID NO: 1737 - RNA, 19 nt, artificial
  Chemically synthesized
agaaaguccucuacaggcu

SEQ ID NO: 1738 - RNA, 19 nt, artificial
  Chemically synthesized
aucagauuuuauuauggcg

SEQ ID NO: 1739 - RNA, 19 nt, artificial
  Chemically synthesized
ucuccaccaccggcuuccg

SEQ ID NO: 1740 - RNA, 19 nt, artificial
  Chemically synthesized
cagaccaccaggcacacuc

SEQ ID NO: 1741 - RNA, 19 nt, artificial
  Chemically synthesized
gagccuuccggagaagggc

SEQ ID NO: 1742 - RNA, 19 nt, artificial
  Chemically synthesized
caggaugucggccuucucc

SEQ ID NO: 1743 - RNA, 19 nt, artificial
  Chemically synthesized
uccuuuaaggaucauagug

SEQ ID NO: 1744 - RNA, 19 nt, artificial
  Chemically synthesized
acaggcgagaggagcaggc

SEQ ID NO: 1745 - RNA, 19 nt, artificial
  Chemically synthesized
ugaggauacagcucgaguu

SEQ ID NO: 1746 - RNA, 19 nt, artificial
  Chemically synthesized
acgcccagcagcuacgggc

SEQ ID NO: 1747 - RNA, 19 nt, artificial
  Chemically synthesized
uccacgugacugagaguuc

SEQ ID NO: 1748 - RNA, 19 nt, artificial
  Chemically synthesized
ucuccagcuuggaguuggg

SEQ ID NO: 1749 - RNA, 19 nt, artificial
  Chemically synthesized
cacucaggagccuuuuggc

SEQ ID NO: 1750 - RNA, 19 nt, artificial
  Chemically synthesized
gacacuuggcagaagaugg

SEQ ID NO: 1751 - RNA, 19 nt, artificial
  Chemically synthesized
uguugaugcggucgcggcg

SEQ ID NO: 1752 - RNA, 19 nt, artificial
  Chemically synthesized
agaugggcccugauugucc

SEQ ID NO: 1753 - RNA, 19 nt, artificial
  Chemically synthesized
uucccagaagucacuugcu

SEQ ID NO: 1754 - RNA, 19 nt, artificial
  Chemically synthesized
uuguccuaaaacggcaggg

SEQ ID NO: 1755 - RNA, 19 nt, artificial
  Chemically synthesized
ccuuuaaggaucauagugg

SEQ ID NO: 1756 - RNA, 19 nt, artificial
  Chemically synthesized
acuugcuuaaaugcaaaca

SEQ ID NO: 1757 - RNA, 19 nt, artificial
  Chemically synthesized
gucgguuuuucucuuuggg

SEQ ID NO: 1758 - RNA, 19 nt, Artificial Sequence
  Chemically synthesized
aggaugucggccuucucca

SEQ ID NO: 1759 - RNA, 19 nt, artificial
  Chemically synthesized
gcacauuugccuuuuguga

SEQ ID NO: 1760 - RNA, 19 nt, artificial
  Chemically synthesized
agagaaugugugugcagag

SEQ ID NO: 1761 - RNA, 19 nt, artificial
  Chemically synthesized
ccgacauccuggagauggc

SEQ ID NO: 1762 - RNA, 19 nt, artificial
  Chemically synthesized
agcaggaguucgcgcggca

SEQ ID NO: 1763 - RNA, 19 nt, artificial
  Chemically synthesized
ugaagcacagcaaagccuu

SEQ ID NO: 1764 - RNA, 19 nt, artificial
  Chemically synthesized
cggcaccagcccaacucca

SEQ ID NO: 1765 - RNA, 19 nt, artificial
  Chemically synthesized
acuccaagcuggagaaggc

SEQ ID NO: 1766 - RNA, 19 nt, artificial
  Chemically synthesized
gggcacauuugccuuuugu

SEQ ID NO: 1767 - RNA, 19 nt, artificial
  Chemically synthesized
gcaccagcccaacuccaag

SEQ ID NO: 1768 - RNA, 19 nt, artificial
  Chemically synthesized
agaaggccgacauccugga

SEQ ID NO: 1769 - RNA, 19 nt, artificial
  Chemically synthesized
ugaagcugcugcuggagca

SEQ ID NO: 1770 - RNA, 19 nt, artificial
  Chemically synthesized
agccugcaccaggacuaca

SEQ ID NO: 1771 - RNA, 19 nt, artificial
  Chemically synthesized
aggaguucgcgcggcacca

SEQ ID NO: 1772 - RNA, 19 nt, artificial
  Chemically synthesized
gcuggagaaggccgacauc

SEQ ID NO: 1773 - RNA, 19 nt, artificial
  Chemically synthesized
gcgcggcaccagcccaacu

SEQ ID NO: 1774 - RNA, 19 nt, artificial
  Chemically synthesized
aagccggugguggagaaga

SEQ ID NO: 1775 - RNA, 19 nt, artificial
  Chemically synthesized
agcugcugcuggagcagga

SEQ ID NO: 1776 - RNA, 19 nt, artificial
  Chemically synthesized
gaagcacagcaaagccuuc

SEQ ID NO: 1777 - RNA, 19 nt, artificial
  Chemically synthesized
ugcugcuggagcaggaguu

SEQ ID NO: 1778 - RNA, 19 nt, artificial
  Chemically synthesized
ggccgacauccuggagaug

SEQ ID NO: 1779 - RNA, 19 nt, artificial
  Chemically synthesized
gccggugguggagaagaug

SEQ ID NO: 1780 - RNA, 19 nt, artificial
  Chemically synthesized
gacugcggaagccgguggu

SEQ ID NO: 1781 - RNA, 19 nt, artificial
  Chemically synthesized
ucgcgcggcaccagcccaa

SEQ ID NO: 1782 - RNA, 19 nt, artificial
  Chemically synthesized
gaccgcaucaacagcagca

SEQ ID NO: 1783 - RNA, 19 nt, artificial
  Chemically synthesized
cugaagcacagcaaagccu

SEQ ID NO: 1784 - RNA, 19 nt, artificial
  Chemically synthesized
cagcccaacuccaagcugg

SEQ ID NO: 1785 - RNA, 19 nt, artificial
  Chemically synthesized
cggugguggagaagaugcg

SEQ ID NO: 1786 - RNA, 19 nt, artificial
  Chemically synthesized
ggcacauuugccuuuugug

SEQ ID NO: 1787 - RNA, 19 nt, artificial
  Chemically synthesized
agagaaaaaccgacugcgg

SEQ ID NO: 1788 - RNA, 19 nt, artificial
  Chemically synthesized
agaaugugugugcagaguc

SEQ ID NO: 1789 - RNA, 19 nt, artificial
  Chemically synthesized
acacgcagaugaagcugcu

SEQ ID NO: 1790 - RNA, 19 nt, artificial
  Chemically synthesized
cgacauccuggagauggcu

SEQ ID NO: 1791 - RNA, 19 nt, artificial
  Chemically synthesized
cagcgacacgcagaugaag

SEQ ID NO: 1792 - RNA, 19 nt, artificial
  Chemically synthesized
ucagcuaccugaagcacag

SEQ ID NO: 1793 - RNA, 19 nt, artificial
  Chemically synthesized
ggugguggagaagaugcgc

SEQ ID NO: 1794 - RNA, 19 nt, artificial
  Chemically synthesized
gaaaaaccgacugcggaag

SEQ ID NO: 1795 - RNA, 19 nt, artificial
  Chemically synthesized
gaagccggugguggagaag

SEQ ID NO: 1796 - RNA, 19 nt, artificial
  Chemically synthesized
ggaguucgcgcggcaccag

SEQ ID NO: 1797 - RNA, 19 nt, artificial
  Chemically synthesized
agcuaccugaagcacagca

SEQ ID NO: 1798 - RNA, 19 nt, artificial
  Chemically synthesized
ccgcaucaacagcagcauc

SEQ ID NO: 1799 - RNA, 19 nt, artificial
  Chemically synthesized
ccggugguggagaagaugc

SEQ ID NO: 1800 - RNA, 19 nt, artificial
  Chemically synthesized
gccugcaccaggacuacag

SEQ ID NO: 1801 - RNA, 19 nt, artificial
  Chemically synthesized
gagccugcaccaggacuac

SEQ ID NO: 1802 - RNA, 19 nt, artificial
  Chemically synthesized
ccucuggcggcccugguga

SEQ ID NO: 1803 - RNA, 19 nt, artificial
  Chemically synthesized
gauccuuaaaggauuccuc

SEQ ID NO: 1804 - RNA, 19 nt, artificial
  Chemically synthesized
gcugcuggagcaggaguuc

SEQ ID NO: 1805 - RNA, 19 nt, artificial
  Chemically synthesized
cgggcacauuugccuuuug

SEQ ID NO: 1806 - RNA, 19 nt, artificial
  Chemically synthesized
gcggcaccagcccaacucc

SEQ ID NO: 1807 - RNA, 19 nt, artificial
  Chemically synthesized
ugcaccaggacuacagcga

SEQ ID NO: 1808 - RNA, 19 nt, artificial
  Chemically synthesized
gcggaagccggugguggag

SEQ ID NO: 1809 - RNA, 19 nt, artificial
  Chemically synthesized
gagaaggccgacauccugg

SEQ ID NO: 1810 - RNA, 19 nt, artificial
  Chemically synthesized
gccgacauccuggagaugg

SEQ ID NO: 1811 - RNA, 19 nt, artificial
  Chemically synthesized
gacacgcagaugaagcugc

SEQ ID NO: 1812 - RNA, 19 nt, artificial
  Chemically synthesized
cccaagagccugcaccagg

SEQ ID NO: 1813 - RNA, 19 nt, artificial
  Chemically synthesized
aaggccgacauccuggaga

SEQ ID NO: 1814 - RNA, 19 nt, artificial
  Chemically synthesized
ccugaagcacagcaaagcc

SEQ ID NO: 1815 - RNA, 19 nt, artificial
  Chemically synthesized
cugcugcuggagcaggagu

SEQ ID NO: 1816 - RNA, 19 nt, artificial
  Chemically synthesized
ggacuuucuucagggcccg

SEQ ID NO: 1817 - RNA, 19 nt, artificial
  Chemically synthesized
uguagaggacuuucuucag

SEQ ID NO: 1818 - RNA, 19 nt, artificial
  Chemically synthesized
cgccagcgacacgcagaug

SEQ ID NO: 1819 - RNA, 19 nt, artificial
  Chemically synthesized
uaccugaagcacagcaaag

SEQ ID NO: 1820 - RNA, 19 nt, artificial
  Chemically synthesized
acauuugccuuuugugaag

SEQ ID NO: 1821 - RNA, 19 nt, artificial
  Chemically synthesized
agcgacacgcagaugaagc

SEQ ID NO: 1822 - RNA, 19 nt, artificial
  Chemically synthesized
caccagcccaacuccaagc

SEQ ID NO: 1823 - RNA, 19 nt, artificial
  Chemically synthesized
accgcaucaacagcagcau

SEQ ID NO: 1824 - RNA, 19 nt, artificial
  Chemically synthesized
uaugauccuuaaaggauuc

SEQ ID NO: 1825 - RNA, 19 nt, artificial
  Chemically synthesized
ccgacugcggaagccggug

SEQ ID NO: 1826 - RNA, 19 nt, artificial
  Chemically synthesized
caagcuggagaaggccgac

SEQ ID NO: 1827 - RNA, 19 nt, artificial
  Chemically synthesized
aagcuggagaaggccgaca

SEQ ID NO: 1828 - RNA, 19 nt, artificial
  Chemically synthesized
ggagcaggaguucgcgcgg

SEQ ID NO: 1829 - RNA, 19 nt, artificial
  Chemically synthesized
cgcggcaccagcccaacuc

SEQ ID NO: 1830 - RNA, 19 nt, artificial
  Chemically synthesized
gcaggaguucgcgcggcac

SEQ ID NO: 1831 - RNA, 19 nt, artificial
  Chemically synthesized
cuggagaaggccgacaucc

SEQ ID NO: 1832 - RNA, 19 nt, artificial
  Chemically synthesized
caacuccaagcuggagaag

SEQ ID NO: 1833 - RNA, 19 nt, artificial
  Chemically synthesized
accugaagcacagcaaagc

SEQ ID NO: 1834 - RNA, 19 nt, artificial
  Chemically synthesized
guagaggacuuucuucagg

SEQ ID NO: 1835 - RNA, 19 nt, artificial
  Chemically synthesized
agcagcugaagcugcugcu

SEQ ID NO: 1836 - RNA, 19 nt, artificial
  Chemically synthesized
cugcuggagcaggaguucg

SEQ ID NO: 1837 - RNA, 19 nt, artificial
  Chemically synthesized
gcuggagcaggaguucgcg

SEQ ID NO: 1838 - RNA, 19 nt, artificial
  Chemically synthesized
gcccaacuccaagcuggag

SEQ ID NO: 1839 - RNA, 19 nt, artificial
  Chemically synthesized
cgacacgcagaugaagcug

SEQ ID NO: 1840 - RNA, 19 nt, artificial
  Chemically synthesized
gaguucgcgcggcaccagc

SEQ ID NO: 1841 - RNA, 19 nt, artificial
  Chemically synthesized
cgacugcggaagccggugg

SEQ ID NO: 1842 - RNA, 19 nt, artificial
  Chemically synthesized
cacgcagaugaagcugcug

SEQ ID NO: 1843 - RNA, 19 nt, artificial
  Chemically synthesized
ugcuggagcaggaguucgc

SEQ ID NO: 1844 - RNA, 19 nt, artificial
  Chemically synthesized
ccagcccaacuccaagcug

SEQ ID NO: 1845 - RNA, 19 nt, artificial
  Chemically synthesized
aacuccaagcuggagaagg

SEQ ID NO: 1846 - RNA, 19 nt, artificial
  Chemically synthesized
agcacagcaaagccuucgu

SEQ ID NO: 1847 - RNA, 19 nt, artificial
  Chemically synthesized
aggacuuucuucagggccc

SEQ ID NO: 1848 - RNA, 19 nt, artificial
  Chemically synthesized
agaggacuuucuucagggc

SEQ ID NO: 1849 - RNA, 19 nt, artificial
  Chemically synthesized
uucgcgcggcaccagccca

SEQ ID NO: 1850 - RNA, 19 nt, artificial
  Chemically synthesized
acuuucuucagggcccgua

SEQ ID NO: 1851 - RNA, 19 nt, artificial
  Chemically synthesized
caggaguucgcgcggcacc

SEQ ID NO: 1852 - RNA, 19 nt, artificial
  Chemically synthesized
cucuggcggcccuggugac

SEQ ID NO: 1853 - RNA, 19 nt, artificial
  Chemically synthesized
cugcggaagccgguggugg

SEQ ID NO: 1854 - RNA, 19 nt, artificial
  Chemically synthesized
caagagccugcaccaggac

SEQ ID NO: 1855 - RNA, 19 nt, artificial
  Chemically synthesized
ccugcaccaggacuacagc

SEQ ID NO: 1856 - RNA, 19 nt, artificial
  Chemically synthesized
aguucgcgcggcaccagcc

SEQ ID NO: 1857 - RNA, 19 nt, artificial
  Chemically synthesized
cgagcagcugaagcugcug

SEQ ID NO: 1858 - RNA, 19 nt, artificial
  Chemically synthesized
cuccaagcuggagaaggcc

SEQ ID NO: 1859 - RNA, 19 nt, artificial
  Chemically synthesized
gacuuucuucagggcccgu

SEQ ID NO: 1860 - RNA, 19 nt, artificial
  Chemically synthesized
ugauccuuaaaggauuccu

SEQ ID NO: 1861 - RNA, 19 nt, artificial
  Chemically synthesized
aagagccugcaccaggacu

SEQ ID NO: 1862 - RNA, 19 nt, artificial
  Chemically synthesized
gagcaggaguucgcgcggc

SEQ ID NO: 1863 - RNA, 19 nt, artificial
  Chemically synthesized
gcugaagcugcugcuggag

SEQ ID NO: 1864 - RNA, 19 nt, artificial
  Chemically synthesized
accagcccaacuccaagcu

SEQ ID NO: 1865 - RNA, 19 nt, artificial
  Chemically synthesized
gaagcugcugcuggagcag

SEQ ID NO: 1866 - RNA, 19 nt, artificial
  Chemically synthesized
cauuugccuuuugugaagg

SEQ ID NO: 1867 - RNA, 19 nt, artificial
  Chemically synthesized
uggagcaggaguucgcgcg

SEQ ID NO: 1868 - RNA, 19 nt, artificial
  Chemically synthesized
gcagcugaagcugcugcug

SEQ ID NO: 1869 - RNA, 19 nt, artificial
  Chemically synthesized
aaaccgacugcggaagccg

SEQ ID NO: 1870 - RNA, 19 nt, artificial
  Chemically synthesized
uccaagcuggagaaggccg

SEQ ID NO: 1871 - RNA, 19 nt, artificial
  Chemically synthesized
cagcuaccugaagcacagc

SEQ ID NO: 1872 - RNA, 19 nt, artificial
  Chemically synthesized
aaaaccgacugcggaagcc

SEQ ID NO: 1873 - RNA, 19 nt, artificial
  Chemically synthesized
cgaccgcaucaacagcagc

SEQ ID NO: 1874 - RNA, 19 nt, artificial
  Chemically synthesized
gaaggccgacauccuggag

SEQ ID NO: 1875 - RNA, 19 nt, artificial
  Chemically synthesized
cugcaccaggacuacagcg

SEQ ID NO: 1876 - RNA, 19 nt, artificial
  Chemically synthesized
gcugcugcuggagcaggag

SEQ ID NO: 1877 - RNA, 19 nt, artificial
  Chemically synthesized
cagcugaagcugcugcugg

SEQ ID NO: 1878 - RNA, 19 nt, artificial
  Chemically synthesized
cuggagcaggaguucgcgc

SEQ ID NO: 1879 - RNA, 19 nt, artificial
  Chemically synthesized
ugucagcuaccugaagcac

SEQ ID NO: 1880 - RNA, 19 nt, artificial
  Chemically synthesized
uagaggacuuucuucaggg

SEQ ID NO: 1881 - RNA, 19 nt, artificial
  Chemically synthesized
acugcggaagccgguggug

SEQ ID NO: 1882 - RNA, 19 nt, artificial
  Chemically synthesized
gagcagcugaagcugcugc

SEQ ID NO: 1883 - RNA, 19 nt, artificial
  Chemically synthesized
cugaagcugcugcuggagc

SEQ ID NO: 1884 - RNA, 19 nt, artificial
  Chemically synthesized
aagcacagcaaagccuucg

SEQ ID NO: 1885 - RNA, 19 nt, artificial
  Chemically synthesized
aaaaaccgacugcggaagc

SEQ ID NO: 1886 - RNA, 19 nt, artificial
  Chemically synthesized
gaggacuuucuucagggcc

SEQ ID NO: 1887 - RNA, 19 nt, artificial
  Chemically synthesized
guaccacuuccagcggccc

SEQ ID NO: 1888 - RNA, 19 nt, artificial
  Chemically synthesized
auuugccuuuugugaaggc

SEQ ID NO: 1889 - RNA, 19 nt, artificial
  Chemically synthesized
aagcugcugcuggagcagg

SEQ ID NO: 1890 - RNA, 19 nt, artificial
  Chemically synthesized
augauccuuaaaggauucc

SEQ ID NO: 1891 - RNA, 19 nt, artificial
  Chemically synthesized
ucuggcggcccuggugacc

SEQ ID NO: 1892 - RNA, 19 nt, artificial
  Chemically synthesized
guggugccugcaggaggcc

SEQ ID NO: 1893 - RNA, 19 nt, artificial
  Chemically synthesized
uuugccuuuugugaaggcc

SEQ ID NO: 1894 - RNA, 19 nt, artificial
  Chemically synthesized
ucacaaaaggcaaaugugc

SEQ ID NO: 1895 - RNA, 19 nt, artificial
  Chemically synthesized
cucugcacacacauucucu

SEQ ID NO: 1896 - RNA, 19 nt, artificial
  Chemically synthesized
gccaucuccaggaugucgg

SEQ ID NO: 1897 - RNA, 19 nt, artificial
  Chemically synthesized
ugccgcgcgaacuccugcu

SEQ ID NO: 1898 - RNA, 19 nt, artificial
  Chemically synthesized
aaggcuuugcugugcuuca

SEQ ID NO: 1899 - RNA, 19 nt, artificial
  Chemically synthesized
uggaguugggcuggugccg

SEQ ID NO: 1900 - RNA, 19 nt, artificial
  Chemically synthesized
gccuucuccagcuuggagu

SEQ ID NO: 1901 - RNA, 19 nt, artificial
  Chemically synthesized
acaaaaggcaaaugugccc

SEQ ID NO: 1902 - RNA, 19 nt, artificial
  Chemically synthesized
cuuggaguugggcuggugc

SEQ ID NO: 1903 - RNA, 19 nt, artificial
  Chemically synthesized
uccaggaugucggccuucu

SEQ ID NO: 1904 - RNA, 19 nt, artificial
  Chemically synthesized
ugcuccagcagcagcuuca

SEQ ID NO: 1905 - RNA, 19 nt, artificial
  Chemically synthesized
uguaguccuggugcaggcu

SEQ ID NO: 1906 - RNA, 19 nt, artificial
  Chemically synthesized
uggugccgcgcgaacuccu

SEQ ID NO: 1907 - RNA, 19 nt, artificial
  Chemically synthesized
gaugucggccuucuccagc

SEQ ID NO: 1908 - RNA, 19 nt, artificial
  Chemically synthesized
aguugggcuggugccgcgc

SEQ ID NO: 1909 - RNA, 19 nt, artificial
  Chemically synthesized
ucuucuccaccaccggcuu

SEQ ID NO: 1910 - RNA, 19 nt, artificial
  Chemically synthesized
uccugcuccagcagcagcu

SEQ ID NO: 1911 - RNA, 19 nt, artificial
  Chemically synthesized
gaaggcuuugcugugcuuc

SEQ ID NO: 1912 - RNA, 19 nt, artificial
  Chemically synthesized
aacuccugcuccagcagca

SEQ ID NO: 1913 - RNA, 19 nt, artificial
  Chemically synthesized
caucuccaggaugucggcc

SEQ ID NO: 1914 - RNA, 19 nt, artificial
  Chemically synthesized
caucuucuccaccaccggc

SEQ ID NO: 1915 - RNA, 19 nt, artificial
  Chemically synthesized
accaccggcuuccgcaguc

SEQ ID NO: 1916 - RNA, 19 nt, artificial
  Chemically synthesized
uugggcuggugccgcgcga

SEQ ID NO: 1917 - RNA, 19 nt, artificial
  Chemically synthesized
ugcugcuguugaugcgguc

SEQ ID NO: 1918 - RNA, 19 nt, artificial
  Chemically synthesized
aggcuuugcugugcuucag

SEQ ID NO: 1919 - RNA, 19 nt, artificial
  Chemically synthesized
ccagcuuggaguugggcug

SEQ ID NO: 1920 - RNA, 19 nt, artificial
  Chemically synthesized
cgcaucuucuccaccaccg

SEQ ID NO: 1921 - RNA, 19 nt, artificial
  Chemically synthesized
cacaaaaggcaaaugugcc

SEQ ID NO: 1922 - RNA, 19 nt, artificial
  Chemically synthesized
ccgcagucgguuuuucucu

SEQ ID NO: 1923 - RNA, 19 nt, artificial
  Chemically synthesized
gacucugcacacacauucu

SEQ ID NO: 1924 - RNA, 19 nt, artificial
  Chemically synthesized
agcagcuucaucugcgugu

SEQ ID NO: 1925 - RNA, 19 nt, artificial
  Chemically synthesized
agccaucuccaggaugucg

SEQ ID NO: 1926 - RNA, 19 nt, artificial
  Chemically synthesized
cuucaucugcgugucgcug

SEQ ID NO: 1927 - RNA, 19 nt, artificial
  Chemically synthesized
cugugcuucagguagcuga

SEQ ID NO: 1928 - RNA, 19 nt, artificial
  Chemically synthesized
gcgcaucuucuccaccacc

SEQ ID NO: 1929 - RNA, 19 nt, artificial
  Chemically synthesized
cuuccgcagucgguuuuuc

SEQ ID NO: 1930 - RNA, 19 nt, artificial
  Chemically synthesized
cuucuccaccaccggcuuc

SEQ ID NO: 1931 - RNA, 19 nt, artificial
  Chemically synthesized
cuggugccgcgcgaacucc

SEQ ID NO: 1932 - RNA, 19 nt, artificial
  Chemically synthesized
ugcugugcuucagguagcu

SEQ ID NO: 1933 - RNA, 19 nt, artificial
  Chemically synthesized
gaugcugcuguugaugcgg

SEQ ID NO: 1934 - RNA, 19 nt, artificial
  Chemically synthesized
gcaucuucuccaccaccgg

SEQ ID NO: 1935 - RNA, 19 nt, artificial
  Chemically synthesized
cuguaguccuggugcaggc

SEQ ID NO: 1936 - RNA, 19 nt, artificial
  Chemically synthesized
guaguccuggugcaggcuc

SEQ ID NO: 1937 - RNA, 19 nt, artificial
  Chemically synthesized
ucaccagggccgccagagg

SEQ ID NO: 1938 - RNA, 19 nt, artificial
  Chemically synthesized
gaggaauccuuuaaggauc

SEQ ID NO: 1939 - RNA, 19 nt, artificial
  Chemically synthesized
gaacuccugcuccagcagc

SEQ ID NO: 1940 - RNA, 19 nt, artificial
  Chemically synthesized
caaaaggcaaaugugcccg

SEQ ID NO: 1941 - RNA, 19 nt, artificial
  Chemically synthesized
ggaguugggcuggugccgc

SEQ ID NO: 1942 - RNA, 19 nt, artificial
  Chemically synthesized
ucgcuguaguccuggugca

SEQ ID NO: 1943 - RNA, 19 nt, artificial
  Chemically synthesized
cuccaccaccggcuuccgc

SEQ ID NO: 1944 - RNA, 19 nt, artificial
  Chemically synthesized
ccaggaugucggccuucuc

SEQ ID NO: 1945 - RNA, 19 nt, artificial
  Chemically synthesized
ccaucuccaggaugucggc

SEQ ID NO: 1946 - RNA, 19 nt, artificial
  Chemically synthesized
gcagcuucaucugcguguc

SEQ ID NO: 1947 - RNA, 19 nt, artificial
  Chemically synthesized
ccuggugcaggcucuuggg

SEQ ID NO: 1948 - RNA, 19 nt, artificial
  Chemically synthesized
ucuccaggaugucggccuu

SEQ ID NO: 1949 - RNA, 19 nt, artificial
  Chemically synthesized
ggcuuugcugugcuucagg

SEQ ID NO: 1950 - RNA, 19 nt, artificial
  Chemically synthesized
acuccugcuccagcagcag

SEQ ID NO: 1951 - RNA, 19 nt, artificial
  Chemically synthesized
cgggcccugaagaaagucc

SEQ ID NO: 1952 - RNA, 19 nt, artificial
  Chemically synthesized
cugaagaaaguccucuaca

SEQ ID NO: 1953 - RNA, 19 nt, artificial
  Chemically synthesized
caucugcgugucgcuggcg

SEQ ID NO: 1954 - RNA, 19 nt, artificial
  Chemically synthesized
cuuugcugugcuucaggua

SEQ ID NO: 1955 - RNA, 19 nt, artificial
  Chemically synthesized
cuucacaaaaggcaaaugu

SEQ ID NO: 1956 - RNA, 19 nt, artificial
  Chemically synthesized
gcuucaucugcgugucgcu

SEQ ID NO: 1957 - RNA, 19 nt, artificial
  Chemically synthesized
gcuuggaguugggcuggug

SEQ ID NO: 1958 - RNA, 19 nt, artificial
  Chemically synthesized
augcugcuguugaugcggu

SEQ ID NO: 1959 - RNA, 19 nt, artificial
  Chemically synthesized
gaauccuuuaaggaucaua

SEQ ID NO: 1960 - RNA, 19 nt, artificial
  Chemically synthesized
caccggcuuccgcagucgg

SEQ ID NO: 1961 - RNA, 19 nt, artificial
  Chemically synthesized
gucggccuucuccagcuug

SEQ ID NO: 1962 - RNA, 19 nt, artificial
  Chemically synthesized
ugucggccuucuccagcuu

SEQ ID NO: 1963 - RNA, 19 nt, artificial
  Chemically synthesized
ccgcgcgaacuccugcucc

SEQ ID NO: 1964 - RNA, 19 nt, artificial
  Chemically synthesized
gaguugggcuggugccgcg

SEQ ID NO: 1965 - RNA, 19 nt, artificial
  Chemically synthesized
gugccgcgcgaacuccugc

SEQ ID NO: 1966 - RNA, 19 nt, artificial
  Chemically synthesized
ggaugucggccuucuccag

SEQ ID NO: 1967 - RNA, 19 nt, artificial
  Chemically synthesized
cuucuccagcuuggaguug

SEQ ID NO: 1968 - RNA, 19 nt, artificial
  Chemically synthesized
gcuuugcugugcuucaggu

SEQ ID NO: 1969 - RNA, 19 nt, artificial
  Chemically synthesized
ccugaagaaaguccucuac

SEQ ID NO: 1970 - RNA, 19 nt, artificial
  Chemically synthesized
agcagcagcuucagcugcu

SEQ ID NO: 1971 - RNA, 19 nt, artificial
  Chemically synthesized
cgaacuccugcuccagcag

SEQ ID NO: 1972 - RNA, 19 nt, artificial
  Chemically synthesized
cgcgaacuccugcuccagc

SEQ ID NO: 1973 - RNA, 19 nt, artificial
  Chemically synthesized
cuccagcuuggaguugggc

SEQ ID NO: 1974 - RNA, 19 nt, artificial
  Chemically synthesized
cagcuucaucugcgugucg

SEQ ID NO: 1975 - RNA, 19 nt, artificial
  Chemically synthesized
gcuggugccgcgcgaacuc

SEQ ID NO: 1976 - RNA, 19 nt, artificial
  Chemically synthesized
ccaccggcuuccgcagucg

SEQ ID NO: 1977 - RNA, 19 nt, artificial
  Chemically synthesized
cagcagcuucaucugcgug

SEQ ID NO: 1978 - RNA, 19 nt, artificial
  Chemically synthesized
gcgaacuccugcuccagca

SEQ ID NO: 1979 - RNA, 19 nt, artificial
  Chemically synthesized
cagcuuggaguugggcugg

SEQ ID NO: 1980 - RNA, 19 nt, artificial
  Chemically synthesized
ccuucuccagcuuggaguu

SEQ ID NO: 1981 - RNA, 19 nt, artificial
  Chemically synthesized
acgaaggcuuugcugugcu

SEQ ID NO: 1982 - RNA, 19 nt, artificial
  Chemically synthesized
gggcccugaagaaaguccu

SEQ ID NO: 1983 - RNA, 19 nt, artificial
  Chemically synthesized
gcccugaagaaaguccucu

SEQ ID NO: 1984 - RNA, 19 nt, artificial
  Chemically synthesized
ugggcuggugccgcgcgaa

SEQ ID NO: 1985 - RNA, 19 nt, artificial
  Chemically synthesized
uacgggcccugaagaaagu

SEQ ID NO: 1986 - RNA, 19 nt, artificial
  Chemically synthesized
ggugccgcgcgaacuccug

SEQ ID NO: 1987 - RNA, 19 nt, artificial
  Chemically synthesized
gucaccagggccgccagag

SEQ ID NO: 1988 - RNA, 19 nt, artificial
  Chemically synthesized
ccaccaccggcuuccgcag

SEQ ID NO: 1989 - RNA, 19 nt, artificial
  Chemically synthesized
guccuggugcaggcucuug

SEQ ID NO: 1990 - RNA, 19 nt, artificial
  Chemically synthesized
gcuguaguccuggugcagg

SEQ ID NO: 1991 - RNA, 19 nt, artificial
  Chemically synthesized
ggcuggugccgcgcgaacu

SEQ ID NO: 1992 - RNA, 19 nt, artificial
  Chemically synthesized
cagcagcuucagcugcucg

SEQ ID NO: 1993 - RNA, 19 nt, artificial
  Chemically synthesized
ggccuucuccagcuuggag

SEQ ID NO: 1994 - RNA, 19 nt, artificial
  Chemically synthesized
acgggcccugaagaaaguc

SEQ ID NO: 1995 - RNA, 19 nt, artificial
  Chemically synthesized
aggaauccuuuaaggauca

SEQ ID NO: 1996 - RNA, 19 nt, artificial
  Chemically synthesized
aguccuggugcaggcucuu

SEQ ID NO: 1997 - RNA, 19 nt, artificial
  Chemically synthesized
gccgcgcgaacuccugcuc

SEQ ID NO: 1998 - RNA, 19 nt, artificial
  Chemically synthesized
cuccagcagcagcuucagc

SEQ ID NO: 1999 - RNA, 19 nt, artificial
  Chemically synthesized
agcuuggaguugggcuggu

SEQ ID NO: 2000 - RNA, 19 nt, artificial
  Chemically synthesized
cugcuccagcagcagcuuc

SEQ ID NO: 2001 - RNA, 19 nt, artificial
  Chemically synthesized
ccuucacaaaaggcaaaug

SEQ ID NO: 2002 - RNA, 19 nt, artificial
  Chemically synthesized
cgcgcgaacuccugcucca

SEQ ID NO: 2003 - RNA, 19 nt, artificial
  Chemically synthesized
cagcagcagcuucagcugc

SEQ ID NO: 2004 - RNA, 19 nt, artificial
  Chemically synthesized
cggcuuccgcagucgguuu

SEQ ID NO: 2005 - RNA, 19 nt, artificial
  Chemically synthesized
cggccuucuccagcuugga

SEQ ID NO: 2006 - RNA, 19 nt, artificial
  Chemically synthesized
gcugugcuucagguagcug

SEQ ID NO: 2007 - RNA, 19 nt, artificial
  Chemically synthesized
ggcuuccgcagucgguuuu

SEQ ID NO: 2008 - RNA, 19 nt, artificial
  Chemically synthesized
gcugcuguugaugcggucg

SEQ ID NO: 2009 - RNA, 19 nt, artificial
  Chemically synthesized
cuccaggaugucggccuuc

SEQ ID NO: 2010 - RNA, 19 nt, artificial
  Chemically synthesized
cgcuguaguccuggugcag

SEQ ID NO: 2011 - RNA, 19 nt, artificial
  Chemically synthesized
cuccugcuccagcagcagc

SEQ ID NO: 2012 - RNA, 19 nt, artificial
  Chemically synthesized
ccagcagcagcuucagcug

SEQ ID NO: 2013 - RNA, 19 nt, artificial
  Chemically synthesized
gcgcgaacuccugcuccag

SEQ ID NO: 2014 - RNA, 19 nt, artificial
  Chemically synthesized
gugcuucagguagcugaca

SEQ ID NO: 2015 - RNA, 19 nt, artificial
  Chemically synthesized
cccugaagaaaguccucua

SEQ ID NO: 2016 - RNA, 19 nt, artificial
  Chemically synthesized
caccaccggcuuccgcagu

SEQ ID NO: 2017 - RNA, 19 nt, artificial
  Chemically synthesized
gcagcagcuucagcugcuc

SEQ ID NO: 2018 - RNA, 19 nt, artificial
  Chemically synthesized
gcuccagcagcagcuucag

SEQ ID NO: 2019 - RNA, 19 nt, artificial
  Chemically synthesized
cgaaggcuuugcugugcuu

SEQ ID NO: 2020 - RNA, 19 nt, artificial
  Chemically synthesized
gcuuccgcagucgguuuuu

SEQ ID NO: 2021 - RNA, 19 nt, artificial
  Chemically synthesized
ggcccugaagaaaguccuc

SEQ ID NO: 2022 - RNA, 19 nt, artificial
  Chemically synthesized
gggccgcuggaagugguac

SEQ ID NO: 2023 - RNA, 19 nt, artificial
  Chemically synthesized
gccuucacaaaaggcaaau

SEQ ID NO: 2024 - RNA, 19 nt, artificial
  Chemically synthesized
ccugcuccagcagcagcuu

SEQ ID NO: 2025 - RNA, 19 nt, artificial
  Chemically synthesized
ggaauccuuuaaggaucau

SEQ ID NO: 2026 - RNA, 19 nt, artificial
  Chemically synthesized
ggucaccagggccgccaga

SEQ ID NO: 2027 - RNA, 19 nt, artificial
  Chemically synthesized
ggccuccugcaggcaccac

SEQ ID NO: 2028 - RNA, 19 nt, Artificial Sequence
  Chemically synthesized
ggccuucacaaaaggcaaa

SEQ ID NO: 2029 - RNA, 18 nt, artificial
  Chemically synthesized
gggcgagccugcuccucu

SEQ ID NO: 2030 - RNA, 18 nt, artificial
  Chemically synthesized
ggagauggcugucagcua

SEQ ID NO: 2031 - RNA, 18 nt, artificial
  Chemically synthesized
ggacuacagcgaaggcua

SEQ ID NO: 2032 - RNA, 18 nt, artificial
  Chemically synthesized
guguuugcauuuaagcaa

SEQ ID NO: 2033 - RNA, 18 nt, artificial
  Chemically synthesized
gguuguucuguguuugca

SEQ ID NO: 2034 - RNA, 18 nt, artificial
  Chemically synthesized
ggcacgacuuuguacuca

SEQ ID NO: 2035 - RNA, 18 nt, artificial
  Chemically synthesized
cgacuuuguacucagaaa

SEQ ID NO: 2036 - RNA, 18 nt, artificial
  Chemically synthesized
gagugugccugguggucu

SEQ ID NO: 2037 - RNA, 18 nt, artificial
  Chemically synthesized
ggagaagaugcgccgcga

SEQ ID NO: 2038 - RNA, 18 nt, artificial
  Chemically synthesized
agccggugguggagaaga

SEQ ID NO: 2039 - RNA, 18 nt, artificial
  Chemically synthesized
cuaugauccuuaaaggau

SEQ ID NO: 2040 - RNA, 18 nt, artificial
  Chemically synthesized
gacuuuguacucagaaau

SEQ ID NO: 2041 - RNA, 18 nt, artificial
  Chemically synthesized
guuguucuguguuugcau

SEQ ID NO: 2042 - RNA, 18 nt, artificial
  Chemically synthesized
cauuuaagcaagugacuu

SEQ ID NO: 2043 - RNA, 18 nt, artificial
  Chemically synthesized
cuguguggguggaugcgu

SEQ ID NO: 2044 - RNA, 18 nt, artificial
  Chemically synthesized
cccaaagagaaaaaccga

SEQ ID NO: 2045 - RNA, 18 nt, artificial
  Chemically synthesized
gcccuucuccggaaggcu

SEQ ID NO: 2046 - RNA, 18 nt, artificial
  Chemically synthesized
ccaaaaggcuccugagug

SEQ ID NO: 2047 - RNA, 18 nt, artificial
  Chemically synthesized
ccaucuucugccaagugu

SEQ ID NO: 2048 - RNA, 18 nt, artificial
  Chemically synthesized
cuaugauauuuguagugc

SEQ ID NO: 2049 - RNA, 18 nt, artificial
  Chemically synthesized
gcaagugacuucugggaa

SEQ ID NO: 2050 - RNA, 18 nt, artificial
  Chemically synthesized
gggacugcuccgaagccg

SEQ ID NO: 2051 - RNA, 18 nt, artificial
  Chemically synthesized
agagaaugugugugcaga

SEQ ID NO: 2052 - RNA, 18 nt, artificial
  Chemically synthesized
ggagaaggccgacauccu

SEQ ID NO: 2053 - RNA, 18 nt, artificial
  Chemically synthesized
gguggaugcgugugggca

SEQ ID NO: 2054 - RNA, 18 nt, artificial
  Chemically synthesized
ccgacauccuggagaugg

SEQ ID NO: 2055 - RNA, 18 nt, artificial
  Chemically synthesized
gccaaaaggcuccugagu

SEQ ID NO: 2056 - RNA, 18 nt, artificial
  Chemically synthesized
aggccgacauccuggaga

SEQ ID NO: 2057 - RNA, 18 nt, artificial
  Chemically synthesized
gcagagucccugccguuu

SEQ ID NO: 2058 - RNA, 18 nt, artificial
  Chemically synthesized
gaaugugugugcagaguc

SEQ ID NO: 2059 - RNA, 18 nt, artificial
  Chemically synthesized
gccuguagaggacuuucu

SEQ ID NO: 2060 - RNA, 18 nt, artificial
  Chemically synthesized
gcaccagcccaacuccaa

SEQ ID NO: 2061 - RNA, 18 nt, artificial
  Chemically synthesized
cauucucagagaaugugu

SEQ ID NO: 2062 - RNA, 18 nt, artificial
  Chemically synthesized
ggugggugccuccacuau

SEQ ID NO: 2063 - RNA, 18 nt, artificial
  Chemically synthesized
ccuucuccggaaggcucu

SEQ ID NO: 2064 - RNA, 18 nt, artificial
  Chemically synthesized
ggcugucagcuaccugaa

SEQ ID NO: 2065 - RNA, 18 nt, artificial
  Chemically synthesized
ggccaaaaggcuccugag

SEQ ID NO: 2066 - RNA, 18 nt, artificial
  Chemically synthesized
gcuccgaagccgccauaa

SEQ ID NO: 2067 - RNA, 18 nt, artificial
  Chemically synthesized
ccauucucagagaaugug

SEQ ID NO: 2068 - RNA, 18 nt, artificial
  Chemically synthesized
ggccauggccaaaaggcu

SEQ ID NO: 2069 - RNA, 18 nt, artificial
  Chemically synthesized
acucagaaauugaacucu

SEQ ID NO: 2070 - RNA, 18 nt, artificial
  Chemically synthesized
ccgugcaguuccugacgc

SEQ ID NO: 2071 - RNA, 18 nt, artificial
  Chemically synthesized
gcuggagaaggccgacau

SEQ ID NO: 2072 - RNA, 18 nt, artificial
  Chemically synthesized
ccacuaugauccuuaaag

SEQ ID NO: 2073 - RNA, 18 nt, artificial
  Chemically synthesized
gcgugugggcacgacuuu

SEQ ID NO: 2074 - RNA, 18 nt, artificial
  Chemically synthesized
acuccaagcuggagaagg

SEQ ID NO: 2075 - RNA, 18 nt, artificial
  Chemically synthesized
cgagcuguauccucauag

SEQ ID NO: 2076 - RNA, 18 nt, artificial
  Chemically synthesized
gaagcacagcaaagccuu

SEQ ID NO: 2077 - RNA, 18 nt, artificial
  Chemically synthesized
cucucagucacguggaag

SEQ ID NO: 2078 - RNA, 18 nt, artificial
  Chemically synthesized
cccuucuccggaaggcuc

SEQ ID NO: 2079 - RNA, 18 nt, artificial
  Chemically synthesized
ccucuguguggguggaug

SEQ ID NO: 2080 - RNA, 18 nt, artificial
  Chemically synthesized
ggaugcgugugggcacga

SEQ ID NO: 2081 - RNA, 18 nt, artificial
  Chemically synthesized
gggcccaucuucugccaa

SEQ ID NO: 2082 - RNA, 18 nt, artificial
  Chemically synthesized
cccauucucagagaaugu

SEQ ID NO: 2083 - RNA, 18 nt, artificial
  Chemically synthesized
ggccgaacucgagcugua

SEQ ID NO: 2084 - RNA, 18 nt, artificial
  Chemically synthesized
gggccauggccaaaaggc

SEQ ID NO: 2085 - RNA, 18 nt, artificial
  Chemically synthesized
gaagccgccauaauaaaa

SEQ ID NO: 2086 - RNA, 18 nt, artificial
  Chemically synthesized
gcuuggacgcgcccuucu

SEQ ID NO: 2087 - RNA, 18 nt, artificial
  Chemically synthesized
gcauuuaagcaagugacu

SEQ ID NO: 2088 - RNA, 18 nt, artificial
  Chemically synthesized
gggugggugccuccacua

SEQ ID NO: 2089 - RNA, 18 nt, artificial
  Chemically synthesized
gugcaguuccugacgcuc

SEQ ID NO: 2090 - RNA, 18 nt, artificial
  Chemically synthesized
ccuguagaggacuuucuu

SEQ ID NO: 2091 - RNA, 18 nt, artificial
  Chemically synthesized
ccucauaggaaacaguga

SEQ ID NO: 2092 - RNA, 18 nt, artificial
  Chemically synthesized
gggugccuccacuaugau

SEQ ID NO: 2093 - RNA, 18 nt, artificial
  Chemically synthesized
agaaauugaacucucagu

SEQ ID NO: 2094 - RNA, 18 nt, artificial
  Chemically synthesized
ggccgacauccuggagau

SEQ ID NO: 2095 - RNA, 18 nt, artificial
  Chemically synthesized
gccggugguggagaagau

SEQ ID NO: 2096 - RNA, 18 nt, artificial
  Chemically synthesized
ccaaagagaaaaaccgac

SEQ ID NO: 2097 - RNA, 18 nt, artificial
  Chemically synthesized
aaauugaacucucaguca

SEQ ID NO: 2098 - RNA, 18 nt, artificial
  Chemically synthesized
gccgcgaccgcaucaaca

SEQ ID NO: 2099 - RNA, 18 nt, artificial
  Chemically synthesized
cagcccaacuccaagcug

SEQ ID NO: 2100 - RNA, 18 nt, artificial
  Chemically synthesized
gccgaacucgagcuguau

SEQ ID NO: 2101 - RNA, 18 nt, artificial
  Chemically synthesized
ccguggagcugcucagcc

SEQ ID NO: 2102 - RNA, 18 nt, artificial
  Chemically synthesized
ggccgugcaguuccugac

SEQ ID NO: 2103 - RNA, 18 nt, artificial
  Chemically synthesized
gcagaugaagcugcugua

SEQ ID NO: 2104 - RNA, 18 nt, artificial
  Chemically synthesized
cuguauccucauaggaaa

SEQ ID NO: 2105 - RNA, 18 nt, artificial
  Chemically synthesized
agaaugugugugcagagu

SEQ ID NO: 2106 - RNA, 18 nt, artificial
  Chemically synthesized
gcaguuccugacgcucca

SEQ ID NO: 2107 - RNA, 18 nt, artificial
  Chemically synthesized
ccucucgccuguagggaa

SEQ ID NO: 2108 - RNA, 18 nt, artificial
  Chemically synthesized
agagaaaaaccgacugcg

SEQ ID NO: 2109 - RNA, 18 nt, artificial
  Chemically synthesized
agcuggagaaggccgaca

SEQ ID NO: 2110 - RNA, 18 nt, artificial
  Chemically synthesized
ugauauuuguagugccgg

SEQ ID NO: 2111 - RNA, 18 nt, artificial
  Chemically synthesized
gagaaugugugugcagag

SEQ ID NO: 2112 - RNA, 18 nt, artificial
  Chemically synthesized
cagccuguagaggacuuu

SEQ ID NO: 2113 - RNA, 18 nt, artificial
  Chemically synthesized
caaagagaaaaaccgacu

SEQ ID NO: 2114 - RNA, 18 nt, artificial
  Chemically synthesized
gccgccauaauaaaaucu

SEQ ID NO: 2115 - RNA, 18 nt, artificial
  Chemically synthesized
ccgccagcgacacgcaga

SEQ ID NO: 2116 - RNA, 18 nt, artificial
  Chemically synthesized
gcuccacgccgccagcga

SEQ ID NO: 2117 - RNA, 18 nt, artificial
  Chemically synthesized
ucagcuaccugaagcaca

SEQ ID NO: 2118 - RNA, 18 nt, artificial
  Chemically synthesized
cucauaggaaacagugau

SEQ ID NO: 2119 - RNA, 18 nt, artificial
  Chemically synthesized
ggcacauuugccuuuugu

SEQ ID NO: 2120 - RNA, 18 nt, artificial
  Chemically synthesized
ggacugcuccgaagccgc

SEQ ID NO: 2121 - RNA, 18 nt, artificial
  Chemically synthesized
ccuggagauggcugucag

SEQ ID NO: 2122 - RNA, 18 nt, artificial
  Chemically synthesized
cgcccuucuccggaaggc

SEQ ID NO: 2123 - RNA, 18 nt, artificial
  Chemically synthesized
cccagccuguagaggacu

SEQ ID NO: 2124 - RNA, 18 nt, artificial
  Chemically synthesized
gguggagaagaugcgccg

SEQ ID NO: 2125 - RNA, 18 nt, artificial
  Chemically synthesized
gaaaaaccgacugcggaa

SEQ ID NO: 2126 - RNA, 18 nt, artificial
  Chemically synthesized
cagucacguggaagccac

SEQ ID NO: 2127 - RNA, 18 nt, artificial
  Chemically synthesized
ggauuccucugugugggu

SEQ ID NO: 2128 - RNA, 18 nt, artificial
  Chemically synthesized
ggugguggagaagaugcg

SEQ ID NO: 2129 - RNA, 18 nt, artificial
  Chemically synthesized
ggaguucgcgcggcacca

SEQ ID NO: 2130 - RNA, 18 nt, artificial
  Chemically synthesized
gccgugcaguuccugacg

SEQ ID NO: 2131 - RNA, 18 nt, artificial
  Chemically synthesized
gagccugcaccaggacua

SEQ ID NO: 2132 - RNA, 18 nt, artificial
  Chemically synthesized
gggcguccaggacccuga

SEQ ID NO: 2133 - RNA, 18 nt, artificial
  Chemically synthesized
gccguuuuaggacaauca

SEQ ID NO: 2134 - RNA, 18 nt, artificial
  Chemically synthesized
gugugugcagagucccug

SEQ ID NO: 2135 - RNA, 18 nt, artificial
  Chemically synthesized
gaagcugcuguaccacuu

SEQ ID NO: 2136 - RNA, 18 nt, artificial
  Chemically synthesized
guacucagaaauugaacu

SEQ ID NO: 2137 - RNA, 18 nt, artificial
  Chemically synthesized
cgccauaauaaaaucuga

SEQ ID NO: 2138 - RNA, 18 nt, artificial
  Chemically synthesized
gggcuuggacgcgcccuu

SEQ ID NO: 2139 - RNA, 18 nt, artificial
  Chemically synthesized
gagaagaugcgccgcgac

SEQ ID NO: 2140 - RNA, 18 nt, artificial
  Chemically synthesized
gccugcaccaggacuaca

SEQ ID NO: 2141 - RNA, 18 nt, artificial
  Chemically synthesized
guuugcauuuaagcaagu

SEQ ID NO: 2142 - RNA, 18 nt, artificial
  Chemically synthesized
cauaggaaacagugauca

SEQ ID NO: 2143 - RNA, 18 nt, artificial
  Chemically synthesized
uccucuguguggguggau

SEQ ID NO: 2144 - RNA, 18 nt, artificial
  Chemically synthesized
ucagucacguggaagcca

SEQ ID NO: 2145 - RNA, 18 nt, artificial
  Chemically synthesized
gaccagagggcgagccug

SEQ ID NO: 2146 - RNA, 18 nt, artificial
  Chemically synthesized
aggccgugcaguuccuga

SEQ ID NO: 2147 - RNA, 18 nt, artificial
  Chemically synthesized
ccguuuuaggacaaucag

SEQ ID NO: 2148 - RNA, 18 nt, artificial
  Chemically synthesized
cgagccugcuccucucgc

SEQ ID NO: 2149 - RNA, 18 nt, artificial
  Chemically synthesized
cgugcaguuccugacgcu

SEQ ID NO: 2150 - RNA, 18 nt, artificial
  Chemically synthesized
ccggugguggagaagaug

SEQ ID NO: 2151 - RNA, 18 nt, artificial
  Chemically synthesized
gcgccgcgaccgcaucaa

SEQ ID NO: 2152 - RNA, 18 nt, artificial
  Chemically synthesized
ccgcaucaacagcagcau

SEQ ID NO: 2153 - RNA, 18 nt, artificial
  Chemically synthesized
gcgacacgcagaugaagc

SEQ ID NO: 2154 - RNA, 18 nt, artificial
  Chemically synthesized
caaaaggcuccugagugu

SEQ ID NO: 2155 - RNA, 18 nt, artificial
  Chemically synthesized
caccaggacuacagcgaa

SEQ ID NO: 2156 - RNA, 18 nt, artificial
  Chemically synthesized
uggccaaaaggcuccuga

SEQ ID NO: 2157 - RNA, 18 nt, artificial
  Chemically synthesized
ccacgggacugcuccgaa

SEQ ID NO: 2158 - RNA, 18 nt, artificial
  Chemically synthesized
agccuguagaggacuuuc

SEQ ID NO: 2159 - RNA, 18 nt, artificial
  Chemically synthesized
cggugguggagaagaugc

SEQ ID NO: 2160 - RNA, 18 nt, artificial
  Chemically synthesized
ggcccaucuucugccaag

SEQ ID NO: 2161 - RNA, 18 nt, artificial
  Chemically synthesized
gugcagagucccugccgu

SEQ ID NO: 2162 - RNA, 18 nt, artificial
  Chemically synthesized
gccuguagggaagcgccu

SEQ ID NO: 2163 - RNA, 18 nt, artificial
  Chemically synthesized
aagccgccauaauaaaau

SEQ ID NO: 2164 - RNA, 18 nt, artificial
  Chemically synthesized
ggcuccugagugugccug

SEQ ID NO: 2165 - RNA, 18 nt, artificial
  Chemically synthesized
gauuccucugugugggug

SEQ ID NO: 2166 - RNA, 18 nt, artificial
  Chemically synthesized
cgaccagagggcgagccu

SEQ ID NO: 2167 - RNA, 18 nt, artificial
  Chemically synthesized
ccuguagggaagcgccuu

SEQ ID NO: 2168 - RNA, 18 nt, artificial
  Chemically synthesized
gcggcaccagcccaacuc

SEQ ID NO: 2169 - RNA, 18 nt, artificial
  Chemically synthesized
gauccuuaaaggauuccu

SEQ ID NO: 2170 - RNA, 18 nt, artificial
  Chemically synthesized
cagcgacacgcagaugaa

SEQ ID NO: 2171 - RNA, 18 nt, artificial
  Chemically synthesized
cagaaauugaacucucag

SEQ ID NO: 2172 - RNA, 18 nt, artificial
  Chemically synthesized
ggcgagccugcuccucuc

SEQ ID NO: 2173 - RNA, 18 nt, artificial
  Chemically synthesized
gcgaccgcaucaacagca

SEQ ID NO: 2174 - RNA, 18 nt, artificial
  Chemically synthesized
gcugucagcuaccugaag

SEQ ID NO: 2175 - RNA, 18 nt, artificial
  Chemically synthesized
uccuggagauggcuguca

SEQ ID NO: 2176 - RNA, 18 nt, artificial
  Chemically synthesized
gcggaagccgguggugga

SEQ ID NO: 2177 - RNA, 18 nt, artificial
  Chemically synthesized
gccugcuccucucgccug

SEQ ID NO: 2178 - RNA, 18 nt, artificial
  Chemically synthesized
ggacaaucagggcccauc

SEQ ID NO: 2179 - RNA, 18 nt, artificial
  Chemically synthesized
gugacuucugggaagucc

SEQ ID NO: 2180 - RNA, 18 nt, artificial
  Chemically synthesized
gcccguagcugcugggcg

SEQ ID NO: 2181 - RNA, 18 nt, artificial
  Chemically synthesized
gcgggcacauuugccuuu

SEQ ID NO: 2182 - RNA, 18 nt, artificial
  Chemically synthesized
gaacucgagcuguauccu

SEQ ID NO: 2183 - RNA, 18 nt, artificial
  Chemically synthesized
uggagaaggccgacaucc

SEQ ID NO: 2184 - RNA, 18 nt, artificial
  Chemically synthesized
uccuuaaaggauuccucu

SEQ ID NO: 2185 - RNA, 18 nt, artificial
  Chemically synthesized
ugcauuuaagcaagugac

SEQ ID NO: 2186 - RNA, 18 nt, artificial
  Chemically synthesized
aauugaacucucagucac

SEQ ID NO: 2187 - RNA, 18 nt, artificial
  Chemically synthesized
gacacgcagaugaagcug

SEQ ID NO: 2188 - RNA, 18 nt, artificial
  Chemically synthesized
ggacuuucuucagggccc

SEQ ID NO: 2189 - RNA, 18 nt, artificial
  Chemically synthesized
uguuugcauuuaagcaag

SEQ ID NO: 2190 - RNA, 18 nt, artificial
  Chemically synthesized
ugagggccauggccaaaa

SEQ ID NO: 2191 - RNA, 18 nt, artificial
  Chemically synthesized
gcaucgagcagcugaagc

SEQ ID NO: 2192 - RNA, 18 nt, artificial
  Chemically synthesized
gaagccggugguggagaa

SEQ ID NO: 2193 - RNA, 18 nt, artificial
  Chemically synthesized
ggcuuggacgcgcccuuc

SEQ ID NO: 2194 - RNA, 18 nt, artificial
  Chemically synthesized
uguagaggacuuucuuca

SEQ ID NO: 2195 - RNA, 18 nt, artificial
  Chemically synthesized
uguacucagaaauugaac

SEQ ID NO: 2196 - RNA, 18 nt, artificial
  Chemically synthesized
uaccugaagcacagcaaa

SEQ ID NO: 2197 - RNA, 18 nt, artificial
  Chemically synthesized
gagauggcugucagcuac

SEQ ID NO: 2198 - RNA, 18 nt, artificial
  Chemically synthesized
ccuuaaaggauuccucug

SEQ ID NO: 2199 - RNA, 18 nt, artificial
  Chemically synthesized
cgggcacauuugccuuuu

SEQ ID NO: 2200 - RNA, 18 nt, artificial
  Chemically synthesized
ggugccuccacuaugauc

SEQ ID NO: 2201 - RNA, 18 nt, artificial
  Chemically synthesized
gagaaggccgacauccug

SEQ ID NO: 2202 - RNA, 18 nt, artificial
  Chemically synthesized
ccuguuccgcgccaggca

SEQ ID NO: 2203 - RNA, 18 nt, artificial
  Chemically synthesized
uugcauuuaagcaaguga

SEQ ID NO: 2204 - RNA, 18 nt, artificial
  Chemically synthesized
gccgacauccuggagaug

SEQ ID NO: 2205 - RNA, 18 nt, artificial
  Chemically synthesized
ggagggugggugccucca

SEQ ID NO: 2206 - RNA, 18 nt, artificial
  Chemically synthesized
gacuacagcgaaggcuac

SEQ ID NO: 2207 - RNA, 18 nt, artificial
  Chemically synthesized
cccaagagccugcaccag

SEQ ID NO: 2208 - RNA, 18 nt, artificial
  Chemically synthesized
cuuaaaggauuccucugu

SEQ ID NO: 2209 - RNA, 18 nt, artificial
  Chemically synthesized
ggcucacggugggcuguc

SEQ ID NO: 2210 - RNA, 18 nt, artificial
  Chemically synthesized
cgcgcggcaccagcccaa

SEQ ID NO: 2211 - RNA, 18 nt, artificial
  Chemically synthesized
agcgacacgcagaugaag

SEQ ID NO: 2212 - RNA, 18 nt, artificial
  Chemically synthesized
ccgaacucgagcuguauc

SEQ ID NO: 2213 - RNA, 18 nt, artificial
  Chemically synthesized
ggcugugccgcgggcaca

SEQ ID NO: 2214 - RNA, 18 nt, artificial
  Chemically synthesized
aggaaacagugaucaccc

SEQ ID NO: 2215 - RNA, 18 nt, artificial
  Chemically synthesized
cgggacugcuccgaagcc

SEQ ID NO: 2216 - RNA, 18 nt, artificial
  Chemically synthesized
caagugacuucugggaag

SEQ ID NO: 2217 - RNA, 18 nt, artificial
  Chemically synthesized
caagcuggagaaggccga

SEQ ID NO: 2218 - RNA, 18 nt, artificial
  Chemically synthesized
ugugaaggccgaacucga

SEQ ID NO: 2219 - RNA, 18 nt, artificial
  Chemically synthesized
caccagcccaacuccaag

SEQ ID NO: 2220 - RNA, 18 nt, artificial
  Chemically synthesized
cugcuccucucgccugua

SEQ ID NO: 2221 - RNA, 18 nt, artificial
  Chemically synthesized
gcgcccuucuccggaagg

SEQ ID NO: 2222 - RNA, 18 nt, artificial
  Chemically synthesized
ucagagaaugugugugca

SEQ ID NO: 2223 - RNA, 18 nt, artificial
  Chemically synthesized
agccugcuccucucgccu

SEQ ID NO: 2224 - RNA, 18 nt, artificial
  Chemically synthesized
cuccaagcuggagaaggc

SEQ ID NO: 2225 - RNA, 18 nt, artificial
  Chemically synthesized
gcugcuguaccacuucca

SEQ ID NO: 2226 - RNA, 18 nt, artificial
  Chemically synthesized
ccagccuguagaggacuu

SEQ ID NO: 2227 - RNA, 18 nt, artificial
  Chemically synthesized
cgccagcgacacgcagau

SEQ ID NO: 2228 - RNA, 18 nt, artificial
  Chemically synthesized
ugaagcugcuguaccacu

SEQ ID NO: 2229 - RNA, 18 nt, artificial
  Chemically synthesized
cuguuccgcgccaggcau

SEQ ID NO: 2230 - RNA, 18 nt, artificial
  Chemically synthesized
ugugggcacgacuuugua

SEQ ID NO: 2231 - RNA, 18 nt, artificial
  Chemically synthesized
gcaggaguucgcgcggca

SEQ ID NO: 2232 - RNA, 18 nt, artificial
  Chemically synthesized
ccagagggcgagccugcu

SEQ ID NO: 2233 - RNA, 18 nt, artificial
  Chemically synthesized
gucgccuguuccgcgcca

SEQ ID NO: 2234 - RNA, 18 nt, artificial
  Chemically synthesized
guauccucauaggaaaca

SEQ ID NO: 2235 - RNA, 18 nt, artificial
  Chemically synthesized
ccguagcugcugggcgua

SEQ ID NO: 2236 - RNA, 18 nt, artificial
  Chemically synthesized
cgugugggcacgacuuug

SEQ ID NO: 2237 - RNA, 18 nt, artificial
  Chemically synthesized
cguagcugcugggcguac

SEQ ID NO: 2238 - RNA, 18 nt, artificial
  Chemically synthesized
cuuucuucagggcccgua

SEQ ID NO: 2239 - RNA, 18 nt, artificial
  Chemically synthesized
gugggcacgacuuuguac

SEQ ID NO: 2240 - RNA, 18 nt, artificial
  Chemically synthesized
ggaagccacgggacugcu

SEQ ID NO: 2241 - RNA, 18 nt, artificial
  Chemically synthesized
cguggaagccacgggacu

SEQ ID NO: 2242 - RNA, 18 nt, artificial
  Chemically synthesized
acuacagcgaaggcuacu

SEQ ID NO: 2243 - RNA, 18 nt, artificial
  Chemically synthesized
gugguggagaagaugcgc

SEQ ID NO: 2244 - RNA, 18 nt, artificial
  Chemically synthesized
guguggguggaugcgugu

SEQ ID NO: 2245 - RNA, 18 nt, artificial
  Chemically synthesized
cuggagaaggccgacauc

SEQ ID NO: 2246 - RNA, 18 nt, artificial
  Chemically synthesized
cugccguuuuaggacaau

SEQ ID NO: 2247 - RNA, 18 nt, artificial
  Chemically synthesized
acucgagcuguauccuca

SEQ ID NO: 2248 - RNA, 18 nt, artificial
  Chemically synthesized
ggacgggcguccaggacc

SEQ ID NO: 2249 - RNA, 18 nt, artificial
  Chemically synthesized
caucuucugccaaguguc

SEQ ID NO: 2250 - RNA, 18 nt, artificial
  Chemically synthesized
ggagcaggaguucgcgcg

SEQ ID NO: 2251 - RNA, 18 nt, artificial
  Chemically synthesized
cgcggcaccagcccaacu

SEQ ID NO: 2252 - RNA, 18 nt, artificial
  Chemically synthesized
ugggcacgacuuuguacu

SEQ ID NO: 2253 - RNA, 18 nt, artificial
  Chemically synthesized
ccgacugcggaagccggu

SEQ ID NO: 2254 - RNA, 18 nt, artificial
  Chemically synthesized
caucaacagcagcaucga

SEQ ID NO: 2255 - RNA, 18 nt, artificial
  Chemically synthesized
uccugacgcuccacgccg

SEQ ID NO: 2256 - RNA, 18 nt, artificial
  Chemically synthesized
cgggcuuggacgcgcccu

SEQ ID NO: 2257 - RNA, 18 nt, artificial
  Chemically synthesized
cauccuggagauggcugu

SEQ ID NO: 2258 - RNA, 18 nt, artificial
  Chemically synthesized
ugaagcacagcaaagccu

SEQ ID NO: 2259 - RNA, 18 nt, artificial
  Chemically synthesized
gccugguggucuggcugg

SEQ ID NO: 2260 - RNA, 18 nt, artificial
  Chemically synthesized
gggcacauuugccuuuug

SEQ ID NO: 2261 - RNA, 18 nt, artificial
  Chemically synthesized
gacaaucagggcccaucu

SEQ ID NO: 2262 - RNA, 18 nt, artificial
  Chemically synthesized
gcccaucuucugccaagu

SEQ ID NO: 2263 - RNA, 18 nt, artificial
  Chemically synthesized
cguggagcugcucagccc

SEQ ID NO: 2264 - RNA, 18 nt, artificial
  Chemically synthesized
ccugaagcacagcaaagc

SEQ ID NO: 2265 - RNA, 18 nt, artificial
  Chemically synthesized
aguuccugacgcuccacg

SEQ ID NO: 2266 - RNA, 18 nt, artificial
  Chemically synthesized
cagaugaagcugcuguac

SEQ ID NO: 2267 - RNA, 18 nt, artificial
  Chemically synthesized
cccaucuucugccaagug

SEQ ID NO: 2268 - RNA, 18 nt, artificial
  Chemically synthesized
guggagaagaugcgccgc

SEQ ID NO: 2269 - RNA, 18 nt, artificial
  Chemically synthesized
caaucagggcccaucuuc

SEQ ID NO: 2270 - RNA, 18 nt, artificial
  Chemically synthesized
acauuugccuuuugugaa

SEQ ID NO: 2271 - RNA, 18 nt, artificial
  Chemically synthesized
gagcaggaguucgcgcgg

SEQ ID NO: 2272 - RNA, 18 nt, artificial
  Chemically synthesized
gcccaacuccaagcugga

SEQ ID NO: 2273 - RNA, 18 nt, artificial
  Chemically synthesized
accugaagcacagcaaag

SEQ ID NO: 2274 - RNA, 18 nt, artificial
  Chemically synthesized
guggaugcgugugggcac

SEQ ID NO: 2275 - RNA, 18 nt, artificial
  Chemically synthesized
gaugaagcugcuguacca

SEQ ID NO: 2276 - RNA, 18 nt, artificial
  Chemically synthesized
aaaucugauuguucagcc

SEQ ID NO: 2277 - RNA, 18 nt, artificial
  Chemically synthesized
ccgacgaccagagggcga

SEQ ID NO: 2278 - RNA, 18 nt, artificial
  Chemically synthesized
gcgcggcaccagcccaac

SEQ ID NO: 2279 - RNA, 18 nt, artificial
  Chemically synthesized
aaaggauuccucugugug

SEQ ID NO: 2280 - RNA, 18 nt, artificial
  Chemically synthesized
agaagaugcgccgcgacc

SEQ ID NO: 2281 - RNA, 18 nt, artificial
  Chemically synthesized
acugcuccgaagccgcca

SEQ ID NO: 2282 - RNA, 18 nt, artificial
  Chemically synthesized
cgcgggcacauuugccuu

SEQ ID NO: 2283 - RNA, 18 nt, artificial
  Chemically synthesized
guggguggaugcgugugg

SEQ ID NO: 2284 - RNA, 18 nt, artificial
  Chemically synthesized
uccacuaugauccuuaaa

SEQ ID NO: 2285 - RNA, 18 nt, artificial
  Chemically synthesized
gagggugggugccuccac

SEQ ID NO: 2286 - RNA, 18 nt, artificial
  Chemically synthesized
ugugccgcgggcacauuu

SEQ ID NO: 2287 - RNA, 18 nt, artificial
  Chemically synthesized
ccgcgaccgcaucaacag

SEQ ID NO: 2288 - RNA, 18 nt, artificial
  Chemically synthesized
ccaggacuacagcgaagg

SEQ ID NO: 2289 - RNA, 18 nt, artificial
  Chemically synthesized
guagaggacuuucuucag

SEQ ID NO: 2290 - RNA, 18 nt, artificial
  Chemically synthesized
gaguucgcgcggcaccag

SEQ ID NO: 2291 - RNA, 18 nt, artificial
  Chemically synthesized
ugcuggagcaggaguucg

SEQ ID NO: 2292 - RNA, 18 nt, artificial
  Chemically synthesized
cagcaucgagcagcugaa

SEQ ID NO: 2293 - RNA, 18 nt, artificial
  Chemically synthesized
gaugcgccgcgaccgcau

SEQ ID NO: 2294 - RNA, 18 nt, artificial
  Chemically synthesized
aaccgacugcggaagccg

SEQ ID NO: 2295 - RNA, 18 nt, artificial
  Chemically synthesized
ugguggagaagaugcgcc

SEQ ID NO: 2296 - RNA, 18 nt, artificial
  Chemically synthesized
cuacagcgaaggcuacuc

SEQ ID NO: 2297 - RNA, 18 nt, artificial
  Chemically synthesized
gcugcuggagcaggaguu

SEQ ID NO: 2298 - RNA, 18 nt, artificial
  Chemically synthesized
cucuggcggcccugguga

SEQ ID NO: 2299 - RNA, 18 nt, artificial
  Chemically synthesized
gccauggccaaaaggcuc

SEQ ID NO: 2300 - RNA, 18 nt, artificial
  Chemically synthesized
aggacuuucuucagggcc

SEQ ID NO: 2301 - RNA, 18 nt, artificial
  Chemically synthesized
uuguucuguguuugcauu

SEQ ID NO: 2302 - RNA, 18 nt, artificial
  Chemically synthesized
agaggagcaggcucgccc

SEQ ID NO: 2303 - RNA, 18 nt, artificial
  Chemically synthesized
uagcugacagccaucucc

SEQ ID NO: 2304 - RNA, 18 nt, artificial
  Chemically synthesized
uagccuucgcuguagucc

SEQ ID NO: 2305 - RNA, 18 nt, artificial
  Chemically synthesized
uugcuuaaaugcaaacac

SEQ ID NO: 2306 - RNA, 18 nt, artificial
  Chemically synthesized
ugcaaacacagaacaacc

SEQ ID NO: 2307 - RNA, 18 nt, artificial
  Chemically synthesized
ugaguacaaagucgugcc

SEQ ID NO: 2308 - RNA, 18 nt, artificial
  Chemically synthesized
uuucugaguacaaagucg

SEQ ID NO: 2309 - RNA, 18 nt, artificial
  Chemically synthesized
agaccaccaggcacacuc

SEQ ID NO: 2310 - RNA, 18 nt, artificial
  Chemically synthesized
ucgcggcgcaucuucucc

SEQ ID NO: 2311 - RNA, 18 nt, artificial
  Chemically synthesized
ucuucuccaccaccggcu

SEQ ID NO: 2312 - RNA, 18 nt, artificial
  Chemically synthesized
auccuuuaaggaucauag

SEQ ID NO: 2313 - RNA, 18 nt, artificial
  Chemically synthesized
auuucugaguacaaaguc

SEQ ID NO: 2314 - RNA, 18 nt, artificial
  Chemically synthesized
augcaaacacagaacaac

SEQ ID NO: 2315 - RNA, 18 nt, artificial
  Chemically synthesized
aagucacuugcuuaaaug

SEQ ID NO: 2316 - RNA, 18 nt, artificial
  Chemically synthesized
acgcauccacccacacag

SEQ ID NO: 2317 - RNA, 18 nt, artificial
  Chemically synthesized
ucgguuuuucucuuuggg

SEQ ID NO: 2318 - RNA, 18 nt, artificial
  Chemically synthesized
agccuuccggagaagggc

SEQ ID NO: 2319 - RNA, 18 nt, artificial
  Chemically synthesized
cacucaggagccuuuugg

SEQ ID NO: 2320 - RNA, 18 nt, artificial
  Chemically synthesized
acacuuggcagaagaugg

SEQ ID NO: 2321 - RNA, 18 nt, artificial
  Chemically synthesized
gcacuacaaauaucauag

SEQ ID NO: 2322 - RNA, 18 nt, artificial
  Chemically synthesized
uucccagaagucacuugc

SEQ ID NO: 2323 - RNA, 18 nt, artificial
  Chemically synthesized
cggcuucggagcaguccc

SEQ ID NO: 2324 - RNA, 18 nt, artificial
  Chemically synthesized
ucugcacacacauucucu

SEQ ID NO: 2325 - RNA, 18 nt, artificial
  Chemically synthesized
aggaugucggccuucucc

SEQ ID NO: 2326 - RNA, 18 nt, artificial
  Chemically synthesized
ugcccacacgcauccacc

SEQ ID NO: 2327 - RNA, 18 nt, artificial
  Chemically synthesized
ccaucuccaggaugucgg

SEQ ID NO: 2328 - RNA, 18 nt, artificial
  Chemically synthesized
acucaggagccuuuuggc

SEQ ID NO: 2329 - RNA, 18 nt, artificial
  Chemically synthesized
ucuccaggaugucggccu

SEQ ID NO: 2330 - RNA, 18 nt, artificial
  Chemically synthesized
aaacggcagggacucugc

SEQ ID NO: 2331 - RNA, 18 nt, artificial
  Chemically synthesized
gacucugcacacacauuc

SEQ ID NO: 2332 - RNA, 18 nt, artificial
  Chemically synthesized
agaaaguccucuacaggc

SEQ ID NO: 2333 - RNA, 18 nt, artificial
  Chemically synthesized
uuggaguugggcuggugc

SEQ ID NO: 2334 - RNA, 18 nt, artificial
  Chemically synthesized
acacauucucugagaaug

SEQ ID NO: 2335 - RNA, 18 nt, artificial
  Chemically synthesized
auaguggaggcacccacc

SEQ ID NO: 2336 - RNA, 18 nt, artificial
  Chemically synthesized
agagccuuccggagaagg

SEQ ID NO: 2337 - RNA, 18 nt, artificial
  Chemically synthesized
uucagguagcugacagcc

SEQ ID NO: 2338 - RNA, 18 nt, artificial
  Chemically synthesized
cucaggagccuuuuggcc

SEQ ID NO: 2339 - RNA, 18 nt, artificial
  Chemically synthesized
uuauggcggcuucggagc

SEQ ID NO: 2340 - RNA, 18 nt, artificial
  Chemically synthesized
cacauucucugagaaugg

SEQ ID NO: 2341 - RNA, 18 nt, artificial
  Chemically synthesized
agccuuuuggccauggcc

SEQ ID NO: 2342 - RNA, 18 nt, artificial
  Chemically synthesized
agaguucaauuucugagu

SEQ ID NO: 2343 - RNA, 18 nt, artificial
  Chemically synthesized
gcgucaggaacugcacgg

SEQ ID NO: 2344 - RNA, 18 nt, artificial
  Chemically synthesized
augucggccuucuccagc

SEQ ID NO: 2345 - RNA, 18 nt, artificial
  Chemically synthesized
cuuuaaggaucauagugg

SEQ ID NO: 2346 - RNA, 18 nt, artificial
  Chemically synthesized
aaagucgugcccacacgc

SEQ ID NO: 2347 - RNA, 18 nt, artificial
  Chemically synthesized
ccuucuccagcuuggagu

SEQ ID NO: 2348 - RNA, 18 nt, artificial
  Chemically synthesized
cuaugaggauacagcucg

SEQ ID NO: 2349 - RNA, 18 nt, artificial
  Chemically synthesized
aaggcuuugcugugcuuc

SEQ ID NO: 2350 - RNA, 18 nt, artificial
  Chemically synthesized
cuuccacgugacugagag

SEQ ID NO: 2351 - RNA, 18 nt, artificial
  Chemically synthesized
gagccuuccggagaaggg

SEQ ID NO: 2352 - RNA, 18 nt, artificial
  Chemically synthesized
cauccacccacacagagg

SEQ ID NO: 2353 - RNA, 18 nt, artificial
  Chemically synthesized
ucgugcccacacgcaucc

SEQ ID NO: 2354 - RNA, 18 nt, artificial
  Chemically synthesized
uuggcagaagaugggccc

SEQ ID NO: 2355 - RNA, 18 nt, artificial
  Chemically synthesized
acauucucugagaauggg

SEQ ID NO: 2356 - RNA, 18 nt, artificial
  Chemically synthesized
uacagcucgaguucggcc

SEQ ID NO: 2357 - RNA, 18 nt, artificial
  Chemically synthesized
gccuuuuggccauggccc

SEQ ID NO: 2358 - RNA, 18 nt, artificial
  Chemically synthesized
uuuuauuauggcggcuuc

SEQ ID NO: 2359 - RNA, 18 nt, artificial
  Chemically synthesized
agaagggcgcguccaagc

SEQ ID NO: 2360 - RNA, 18 nt, artificial
  Chemically synthesized
agucacuugcuuaaaugc

SEQ ID NO: 2361 - RNA, 18 nt, artificial
  Chemically synthesized
uaguggaggcacccaccc

SEQ ID NO: 2362 - RNA, 18 nt, artificial
  Chemically synthesized
gagcgucaggaacugcac

SEQ ID NO: 2363 - RNA, 18 nt, artificial
  Chemically synthesized
aagaaaguccucuacagg

SEQ ID NO: 2364 - RNA, 18 nt, artificial
  Chemically synthesized
ucacuguuuccuaugagg

SEQ ID NO: 2365 - RNA, 18 nt, artificial
  Chemically synthesized
aucauaguggaggcaccc

SEQ ID NO: 2366 - RNA, 18 nt, artificial
  Chemically synthesized
acugagaguucaauuucu

SEQ ID NO: 2367 - RNA, 18 nt, artificial
  Chemically synthesized
aucuccaggaugucggcc

SEQ ID NO: 2368 - RNA, 18 nt, artificial
  Chemically synthesized
aucuucuccaccaccggc

SEQ ID NO: 2369 - RNA, 18 nt, artificial
  Chemically synthesized
gucgguuuuucucuuugg

SEQ ID NO: 2370 - RNA, 18 nt, artificial
  Chemically synthesized
ugacugagaguucaauuu

SEQ ID NO: 2371 - RNA, 18 nt, artificial
  Chemically synthesized
uguugaugcggucgcggc

SEQ ID NO: 2372 - RNA, 18 nt, artificial
  Chemically synthesized
cagcuuggaguugggcug

SEQ ID NO: 2373 - RNA, 18 nt, artificial
  Chemically synthesized
auacagcucgaguucggc

SEQ ID NO: 2374 - RNA, 18 nt, artificial
  Chemically synthesized
ggcugagcagcuccacgg

SEQ ID NO: 2375 - RNA, 18 nt, artificial
  Chemically synthesized
gucaggaacugcacggcc

SEQ ID NO: 2376 - RNA, 18 nt, artificial
  Chemically synthesized
uacagcagcuucaucugc

SEQ ID NO: 2377 - RNA, 18 nt, artificial
  Chemically synthesized
uuuccuaugaggauacag

SEQ ID NO: 2378 - RNA, 18 nt, artificial
  Chemically synthesized
acucugcacacacauucu

SEQ ID NO: 2379 - RNA, 18 nt, artificial
  Chemically synthesized
uggagcgucaggaacugc

SEQ ID NO: 2380 - RNA, 18 nt, artificial
  Chemically synthesized
uucccuacaggcgagagg

SEQ ID NO: 2381 - RNA, 18 nt, artificial
  Chemically synthesized
cgcagucgguuuuucucu

SEQ ID NO: 2382 - RNA, 18 nt, artificial
  Chemically synthesized
ugucggccuucuccagcu

SEQ ID NO: 2383 - RNA, 18 nt, artificial
  Chemically synthesized
ccggcacuacaaauauca

SEQ ID NO: 2384 - RNA, 18 nt, artificial
  Chemically synthesized
cucugcacacacauucuc

SEQ ID NO: 2385 - RNA, 18 nt, artificial
  Chemically synthesized
aaaguccucuacaggcug

SEQ ID NO: 2386 - RNA, 18 nt, artificial
  Chemically synthesized
agucgguuuuucucuuug

SEQ ID NO: 2387 - RNA, 18 nt, artificial
  Chemically synthesized
agauuuuauuauggcggc

SEQ ID NO: 2388 - RNA, 18 nt, artificial
  Chemically synthesized
ucugcgugucgcuggcgg

SEQ ID NO: 2389 - RNA, 18 nt, artificial
  Chemically synthesized
ucgcuggcggcguggagc

SEQ ID NO: 2390 - RNA, 18 nt, artificial
  Chemically synthesized
ugugcuucagguagcuga

SEQ ID NO: 2391 - RNA, 18 nt, artificial
  Chemically synthesized
aucacuguuuccuaugag

SEQ ID NO: 2392 - RNA, 18 nt, artificial
  Chemically synthesized
acaaaaggcaaaugugcc

SEQ ID NO: 2393 - RNA, 18 nt, artificial
  Chemically synthesized
gcggcuucggagcagucc

SEQ ID NO: 2394 - RNA, 18 nt, artificial
  Chemically synthesized
cugacagccaucuccagg

SEQ ID NO: 2395 - RNA, 18 nt, artificial
  Chemically synthesized
gccuuccggagaagggcg

SEQ ID NO: 2396 - RNA, 18 nt, artificial
  Chemically synthesized
aguccucuacaggcuggg

SEQ ID NO: 2397 - RNA, 18 nt, artificial
  Chemically synthesized
cggcgcaucuucuccacc

SEQ ID NO: 2398 - RNA, 18 nt, artificial
  Chemically synthesized
uuccgcagucgguuuuuc

SEQ ID NO: 2399 - RNA, 18 nt, artificial
  Chemically synthesized
guggcuuccacgugacug

SEQ ID NO: 2400 - RNA, 18 nt, artificial
  Chemically synthesized
acccacacagaggaaucc

SEQ ID NO: 2401 - RNA, 18 nt, artificial
  Chemically synthesized
cgcaucuucuccaccacc

SEQ ID NO: 2402 - RNA, 18 nt, artificial
  Chemically synthesized
uggugccgcgcgaacucc

SEQ ID NO: 2403 - RNA, 18 nt, artificial
  Chemically synthesized
cgucaggaacugcacggc

SEQ ID NO: 2404 - RNA, 18 nt, artificial
  Chemically synthesized
uaguccuggugcaggcuc

SEQ ID NO: 2405 - RNA, 18 nt, artificial
  Chemically synthesized
ucaggguccuggacgccc

SEQ ID NO: 2406 - RNA, 18 nt, artificial
  Chemically synthesized
ugauuguccuaaaacggc

SEQ ID NO: 2407 - RNA, 18 nt, artificial
  Chemically synthesized
cagggacucugcacacac

SEQ ID NO: 2408 - RNA, 18 nt, artificial
  Chemically synthesized
aagugguacagcagcuuc

SEQ ID NO: 2409 - RNA, 18 nt, artificial
  Chemically synthesized
aguucaauuucugaguac

SEQ ID NO: 2410 - RNA, 18 nt, artificial
  Chemically synthesized
ucagauuuuauuauggcg

SEQ ID NO: 2411 - RNA, 18 nt, artificial
  Chemically synthesized
aagggcgcguccaagccc

SEQ ID NO: 2412 - RNA, 18 nt, artificial
  Chemically synthesized
gucgcggcgcaucuucuc

SEQ ID NO: 2413 - RNA, 18 nt, artificial
  Chemically synthesized
uguaguccuggugcaggc

SEQ ID NO: 2414 - RNA, 18 nt, artificial
  Chemically synthesized
acuugcuuaaaugcaaac

SEQ ID NO: 2415 - RNA, 18 nt, artificial
  Chemically synthesized
ugaucacuguuuccuaug

SEQ ID NO: 2416 - RNA, 18 nt, artificial
  Chemically synthesized
auccacccacacagagga

SEQ ID NO: 2417 - RNA, 18 nt, artificial
  Chemically synthesized
uggcuuccacgugacuga

SEQ ID NO: 2418 - RNA, 18 nt, artificial
  Chemically synthesized
caggcucgcccucugguc

SEQ ID NO: 2419 - RNA, 18 nt, artificial
  Chemically synthesized
ucaggaacugcacggccu

SEQ ID NO: 2420 - RNA, 18 nt, artificial
  Chemically synthesized
cugauuguccuaaaacgg

SEQ ID NO: 2421 - RNA, 18 nt, artificial
  Chemically synthesized
gcgagaggagcaggcucg

SEQ ID NO: 2422 - RNA, 18 nt, artificial
  Chemically synthesized
agcgucaggaacugcacg

SEQ ID NO: 2423 - RNA, 18 nt, artificial
  Chemically synthesized
caucuucuccaccaccgg

SEQ ID NO: 2424 - RNA, 18 nt, artificial
  Chemically synthesized
uugaugcggucgcggcgc

SEQ ID NO: 2425 - RNA, 18 nt, artificial
  Chemically synthesized
augcugcuguugaugcgg

SEQ ID NO: 2426 - RNA, 18 nt, artificial
  Chemically synthesized
gcuucaucugcgugucgc

SEQ ID NO: 2427 - RNA, 18 nt, artificial
  Chemically synthesized
acacucaggagccuuuug

SEQ ID NO: 2428 - RNA, 18 nt, artificial
  Chemically synthesized
uucgcuguaguccuggug

SEQ ID NO: 2429 - RNA, 18 nt, artificial
  Chemically synthesized
ucaggagccuuuuggcca

SEQ ID NO: 2430 - RNA, 18 nt, artificial
  Chemically synthesized
uucggagcagucccgugg

SEQ ID NO: 2431 - RNA, 18 nt, artificial
  Chemically synthesized
gaaaguccucuacaggcu

SEQ ID NO: 2432 - RNA, 18 nt, artificial
  Chemically synthesized
gcaucuucuccaccaccg

SEQ ID NO: 2433 - RNA, 18 nt, artificial
  Chemically synthesized
cuuggcagaagaugggcc

SEQ ID NO: 2434 - RNA, 18 nt, artificial
  Chemically synthesized
acggcagggacucugcac

SEQ ID NO: 2435 - RNA, 18 nt, artificial
  Chemically synthesized
aggcgcuucccuacaggc

SEQ ID NO: 2436 - RNA, 18 nt, artificial
  Chemically synthesized
auuuuauuauggcggcuu

SEQ ID NO: 2437 - RNA, 18 nt, artificial
  Chemically synthesized
caggcacacucaggagcc

SEQ ID NO: 2438 - RNA, 18 nt, artificial
  Chemically synthesized
cacccacacagaggaauc

SEQ ID NO: 2439 - RNA, 18 nt, artificial
  Chemically synthesized
aggcucgcccucuggucg

SEQ ID NO: 2440 - RNA, 18 nt, artificial
  Chemically synthesized
aaggcgcuucccuacagg

SEQ ID NO: 2441 - RNA, 18 nt, artificial
  Chemically synthesized
gaguugggcuggugccgc

SEQ ID NO: 2442 - RNA, 18 nt, artificial
  Chemically synthesized
aggaauccuuuaaggauc

SEQ ID NO: 2443 - RNA, 18 nt, artificial
  Chemically synthesized
uucaucugcgugucgcug

SEQ ID NO: 2444 - RNA, 18 nt, artificial
  Chemically synthesized
cugagaguucaauuucug

SEQ ID NO: 2445 - RNA, 18 nt, artificial
  Chemically synthesized
gagaggagcaggcucgcc

SEQ ID NO: 2446 - RNA, 18 nt, artificial
  Chemically synthesized
ugcuguugaugcggucgc

SEQ ID NO: 2447 - RNA, 18 nt, artificial
  Chemically synthesized
cuucagguagcugacagc

SEQ ID NO: 2448 - RNA, 18 nt, artificial
  Chemically synthesized
ugacagccaucuccagga

SEQ ID NO: 2449 - RNA, 18 nt, artificial
  Chemically synthesized
uccaccaccggcuuccgc

SEQ ID NO: 2450 - RNA, 18 nt, artificial
  Chemically synthesized
caggcgagaggagcaggc

SEQ ID NO: 2451 - RNA, 18 nt, artificial
  Chemically synthesized
gaugggcccugauugucc

SEQ ID NO: 2452 - RNA, 18 nt, artificial
  Chemically synthesized
ggacuucccagaagucac

SEQ ID NO: 2453 - RNA, 18 nt, artificial
  Chemically synthesized
cgcccagcagcuacgggc

SEQ ID NO: 2454 - RNA, 18 nt, artificial
  Chemically synthesized
aaaggcaaaugugcccgc

SEQ ID NO: 2455 - RNA, 18 nt, artificial
  Chemically synthesized
aggauacagcucgaguuc

SEQ ID NO: 2456 - RNA, 18 nt, artificial
  Chemically synthesized
ggaugucggccuucucca

SEQ ID NO: 2457 - RNA, 18 nt, artificial
  Chemically synthesized
agaggaauccuuuaagga

SEQ ID NO: 2458 - RNA, 18 nt, artificial
  Chemically synthesized
gucacuugcuuaaaugca

SEQ ID NO: 2459 - RNA, 18 nt, artificial
  Chemically synthesized
gugacugagaguucaauu

SEQ ID NO: 2460 - RNA, 18 nt, artificial
  Chemically synthesized
cagcuucaucugcguguc

SEQ ID NO: 2461 - RNA, 18 nt, artificial
  Chemically synthesized
gggcccugaagaaagucc

SEQ ID NO: 2462 - RNA, 18 nt, artificial
  Chemically synthesized
cuugcuuaaaugcaaaca

SEQ ID NO: 2463 - RNA, 18 nt, artificial
  Chemically synthesized
uuuuggccauggcccuca

SEQ ID NO: 2464 - RNA, 18 nt, artificial
  Chemically synthesized
gcuucagcugcucgaugc

SEQ ID NO: 2465 - RNA, 18 nt, artificial
  Chemically synthesized
uucuccaccaccggcuuc

SEQ ID NO: 2466 - RNA, 18 nt, artificial
  Chemically synthesized
gaagggcgcguccaagcc

SEQ ID NO: 2467 - RNA, 18 nt, artificial
  Chemically synthesized
ugaagaaaguccucuaca

SEQ ID NO: 2468 - RNA, 18 nt, artificial
  Chemically synthesized
guucaauuucugaguaca

SEQ ID NO: 2469 - RNA, 18 nt, artificial
  Chemically synthesized
uuugcugugcuucaggua

SEQ ID NO: 2470 - RNA, 18 nt, artificial
  Chemically synthesized
guagcugacagccaucuc

SEQ ID NO: 2471 - RNA, 18 nt, artificial
  Chemically synthesized
cagaggaauccuuuaagg

SEQ ID NO: 2472 - RNA, 18 nt, artificial
  Chemically synthesized
aaaaggcaaaugugcccg

SEQ ID NO: 2473 - RNA, 18 nt, artificial
  Chemically synthesized
gaucauaguggaggcacc

SEQ ID NO: 2474 - RNA, 18 nt, artificial
  Chemically synthesized
caggaugucggccuucuc

SEQ ID NO: 2475 - RNA, 18 nt, artificial
  Chemically synthesized
ugccuggcgcggaacagg

SEQ ID NO: 2476 - RNA, 18 nt, artificial
  Chemically synthesized
ucacuugcuuaaaugcaa

SEQ ID NO: 2477 - RNA, 18 nt, artificial
  Chemically synthesized
caucuccaggaugucggc

SEQ ID NO: 2478 - RNA, 18 nt, artificial
  Chemically synthesized
uggaggcacccacccucc

SEQ ID NO: 2479 - RNA, 18 nt, artificial
  Chemically synthesized
guagccuucgcuguaguc

SEQ ID NO: 2480 - RNA, 18 nt, artificial
  Chemically synthesized
cuggugcaggcucuuggg

SEQ ID NO: 2481 - RNA, 18 nt, artificial
  Chemically synthesized
acagaggaauccuuuaag

SEQ ID NO: 2482 - RNA, 18 nt, artificial
  Chemically synthesized
gacagcccaccgugagcc

SEQ ID NO: 2483 - RNA, 18 nt, artificial
  Chemically synthesized
uugggcuggugccgcgcg

SEQ ID NO: 2484 - RNA, 18 nt, artificial
  Chemically synthesized
cuucaucugcgugucgcu

SEQ ID NO: 2485 - RNA, 18 nt, artificial
  Chemically synthesized
gauacagcucgaguucgg

SEQ ID NO: 2486 - RNA, 18 nt, artificial
  Chemically synthesized
ugugcccgcggcacagcc

SEQ ID NO: 2487 - RNA, 18 nt, artificial
  Chemically synthesized
gggugaucacuguuuccu

SEQ ID NO: 2488 - RNA, 18 nt, artificial
  Chemically synthesized
ggcuucggagcagucccg

SEQ ID NO: 2489 - RNA, 18 nt, artificial
  Chemically synthesized
cuucccagaagucacuug

SEQ ID NO: 2490 - RNA, 18 nt, artificial
  Chemically synthesized
ucggccuucuccagcuug

SEQ ID NO: 2491 - RNA, 18 nt, artificial
  Chemically synthesized
ucgaguucggccuucaca

SEQ ID NO: 2492 - RNA, 18 nt, artificial
  Chemically synthesized
cuuggaguugggcuggug

SEQ ID NO: 2493 - RNA, 18 nt, artificial
  Chemically synthesized
uacaggcgagaggagcag

SEQ ID NO: 2494 - RNA, 18 nt, artificial
  Chemically synthesized
ccuuccggagaagggcgc

SEQ ID NO: 2495 - RNA, 18 nt, artificial
  Chemically synthesized
ugcacacacauucucuga

SEQ ID NO: 2496 - RNA, 18 nt, artificial
  Chemically synthesized
aggcgagaggagcaggcu

SEQ ID NO: 2497 - RNA, 18 nt, artificial
  Chemically synthesized
gccuucuccagcuuggag

SEQ ID NO: 2498 - RNA, 18 nt, artificial
  Chemically synthesized
uggaagugguacagcagc

SEQ ID NO: 2499 - RNA, 18 nt, artificial
  Chemically synthesized
aaguccucuacaggcugg

SEQ ID NO: 2500 - RNA, 18 nt, artificial
  Chemically synthesized
aucugcgugucgcuggcg

SEQ ID NO: 2501 - RNA, 18 nt, artificial
  Chemically synthesized
agugguacagcagcuuca

SEQ ID NO: 2502 - RNA, 18 nt, artificial
  Chemically synthesized
augccuggcgcggaacag

SEQ ID NO: 2503 - RNA, 18 nt, artificial
  Chemically synthesized
uacaaagucgugcccaca

SEQ ID NO: 2504 - RNA, 18 nt, artificial
  Chemically synthesized
ugccgcgcgaacuccugc

SEQ ID NO: 2505 - RNA, 18 nt, artificial
  Chemically synthesized
agcaggcucgcccucugg

SEQ ID NO: 2506 - RNA, 18 nt, artificial
  Chemically synthesized
uggcgcggaacaggcgac

SEQ ID NO: 2507 - RNA, 18 nt, artificial
  Chemically synthesized
uguuuccuaugaggauac

SEQ ID NO: 2508 - RNA, 18 nt, artificial
  Chemically synthesized
uacgcccagcagcuacgg

SEQ ID NO: 2509 - RNA, 18 nt, artificial
  Chemically synthesized
caaagucgugcccacacg

SEQ ID NO: 2510 - RNA, 18 nt, artificial
  Chemically synthesized
guacgcccagcagcuacg

SEQ ID NO: 2511 - RNA, 18 nt, artificial
  Chemically synthesized
uacgggcccugaagaaag

SEQ ID NO: 2512 - RNA, 18 nt, artificial
  Chemically synthesized
guacaaagucgugcccac

SEQ ID NO: 2513 - RNA, 18 nt, artificial
  Chemically synthesized
agcagucccguggcuucc

SEQ ID NO: 2514 - RNA, 18 nt, artificial
  Chemically synthesized
agucccguggcuuccacg

SEQ ID NO: 2515 - RNA, 18 nt, artificial
  Chemically synthesized
aguagccuucgcuguagu

SEQ ID NO: 2516 - RNA, 18 nt, artificial
  Chemically synthesized
gcgcaucuucuccaccac

SEQ ID NO: 2517 - RNA, 18 nt, artificial
  Chemically synthesized
acacgcauccacccacac

SEQ ID NO: 2518 - RNA, 18 nt, artificial
  Chemically synthesized
gaugucggccuucuccag

SEQ ID NO: 2519 - RNA, 18 nt, artificial
  Chemically synthesized
auuguccuaaaacggcag

SEQ ID NO: 2520 - RNA, 18 nt, artificial
  Chemically synthesized
ugaggauacagcucgagu

SEQ ID NO: 2521 - RNA, 18 nt, artificial
  Chemically synthesized
gguccuggacgcccgucc

SEQ ID NO: 2522 - RNA, 18 nt, artificial
  Chemically synthesized
gacacuuggcagaagaug

SEQ ID NO: 2523 - RNA, 18 nt, artificial
  Chemically synthesized
cgcgcgaacuccugcucc

SEQ ID NO: 2524 - RNA, 18 nt, artificial
  Chemically synthesized
aguugggcuggugccgcg

SEQ ID NO: 2525 - RNA, 18 nt, artificial
  Chemically synthesized
aguacaaagucgugccca

SEQ ID NO: 2526 - RNA, 18 nt, artificial
  Chemically synthesized
accggcuuccgcagucgg

SEQ ID NO: 2527 - RNA, 18 nt, artificial
  Chemically synthesized
ucgaugcugcuguugaug

SEQ ID NO: 2528 - RNA, 18 nt, artificial
  Chemically synthesized
cggcguggagcgucagga

SEQ ID NO: 2529 - RNA, 18 nt, artificial
  Chemically synthesized
agggcgcguccaagcccg

SEQ ID NO: 2530 - RNA, 18 nt, artificial
  Chemically synthesized
acagccaucuccaggaug

SEQ ID NO: 2531 - RNA, 18 nt, artificial
  Chemically synthesized
aggcuuugcugugcuuca

SEQ ID NO: 2532 - RNA, 18 nt, artificial
  Chemically synthesized
ccagccagaccaccaggc

SEQ ID NO: 2533 - RNA, 18 nt, artificial
  Chemically synthesized
caaaaggcaaaugugccc

SEQ ID NO: 2534 - RNA, 18 nt, artificial
  Chemically synthesized
agaugggcccugauuguc

SEQ ID NO: 2535 - RNA, 18 nt, artificial
  Chemically synthesized
acuuggcagaagaugggc

SEQ ID NO: 2536 - RNA, 18 nt, artificial
  Chemically synthesized
gggcugagcagcuccacg

SEQ ID NO: 2537 - RNA, 18 nt, artificial
  Chemically synthesized
gcuuugcugugcuucagg

SEQ ID NO: 2538 - RNA, 18 nt, artificial
  Chemically synthesized
cguggagcgucaggaacu

SEQ ID NO: 2539 - RNA, 18 nt, artificial
  Chemically synthesized
guacagcagcuucaucug

SEQ ID NO: 2540 - RNA, 18 nt, artificial
  Chemically synthesized
cacuuggcagaagauggg

SEQ ID NO: 2541 - RNA, 18 nt, artificial
  Chemically synthesized
gcggcgcaucuucuccac

SEQ ID NO: 2542 - RNA, 18 nt, artificial
  Chemically synthesized
gaagaugggcccugauug

SEQ ID NO: 2543 - RNA, 18 nt, artificial
  Chemically synthesized
uucacaaaaggcaaaugu

SEQ ID NO: 2544 - RNA, 18 nt, artificial
  Chemically synthesized
ccgcgcgaacuccugcuc

SEQ ID NO: 2545 - RNA, 18 nt, artificial
  Chemically synthesized
uccagcuuggaguugggc

SEQ ID NO: 2546 - RNA, 18 nt, artificial
  Chemically synthesized
cuuugcugugcuucaggu

SEQ ID NO: 2547 - RNA, 18 nt, artificial
  Chemically synthesized
gugcccacacgcauccac

SEQ ID NO: 2548 - RNA, 18 nt, artificial
  Chemically synthesized
ugguacagcagcuucauc

SEQ ID NO: 2549 - RNA, 18 nt, artificial
  Chemically synthesized
ggcugaacaaucagauuu

SEQ ID NO: 2550 - RNA, 18 nt, artificial
  Chemically synthesized
ucgcccucuggucgucgg

SEQ ID NO: 2551 - RNA, 18 nt, artificial
  Chemically synthesized
guugggcuggugccgcgc

SEQ ID NO: 2552 - RNA, 18 nt, artificial
  Chemically synthesized
cacacagaggaauccuuu

SEQ ID NO: 2553 - RNA, 18 nt, artificial
  Chemically synthesized
ggucgcggcgcaucuucu

SEQ ID NO: 2554 - RNA, 18 nt, artificial
  Chemically synthesized
uggcggcuucggagcagu

SEQ ID NO: 2555 - RNA, 18 nt, artificial
  Chemically synthesized
aaggcaaaugugcccgcg

SEQ ID NO: 2556 - RNA, 18 nt, artificial
  Chemically synthesized
ccacacgcauccacccac

SEQ ID NO: 2557 - RNA, 18 nt, artificial
  Chemically synthesized
uuuaaggaucauagugga

SEQ ID NO: 2558 - RNA, 18 nt, artificial
  Chemically synthesized
guggaggcacccacccuc

SEQ ID NO: 2559 - RNA, 18 nt, artificial
  Chemically synthesized
aaaugugcccgcggcaca

SEQ ID NO: 2560 - RNA, 18 nt, artificial
  Chemically synthesized
cuguugaugcggucgcgg

SEQ ID NO: 2561 - RNA, 18 nt, artificial
  Chemically synthesized
ccuucgcuguaguccugg

SEQ ID NO: 2562 - RNA, 18 nt, artificial
  Chemically synthesized
cugaagaaaguccucuac

SEQ ID NO: 2563 - RNA, 18 nt, artificial
  Chemically synthesized
cuggugccgcgcgaacuc

SEQ ID NO: 2564 - RNA, 18 nt, artificial
  Chemically synthesized
cgaacuccugcuccagca

SEQ ID NO: 2565 - RNA, 18 nt, artificial
  Chemically synthesized
uucagcugcucgaugcug

SEQ ID NO: 2566 - RNA, 18 nt, artificial
  Chemically synthesized
augcggucgcggcgcauc

SEQ ID NO: 2567 - RNA, 18 nt, artificial
  Chemically synthesized
cggcuuccgcagucgguu

SEQ ID NO: 2568 - RNA, 18 nt, artificial
  Chemically synthesized
ggcgcaucuucuccacca

SEQ ID NO: 2569 - RNA, 18 nt, artificial
  Chemically synthesized
gaguagccuucgcuguag

SEQ ID NO: 2570 - RNA, 18 nt, artificial
  Chemically synthesized
aacuccugcuccagcagc

SEQ ID NO: 2571 - RNA, 18 nt, artificial
  Chemically synthesized
ucaccagggccgccagag

SEQ ID NO: 2572 - RNA, 18 nt, artificial
  Chemically synthesized
gagccuuuuggccauggc

SEQ ID NO: 2573 - RNA, 18 nt, artificial
  Chemically synthesized
ggcccugaagaaaguccu

SEQ ID NO: 2574 - RNA, 18 nt, Artificial Sequence
  Chemically synthesized
aaugcaaacacagaacaa

SEQ ID NO: 2575 - RNA, 18 nt, artificial
  Chemically synthesized
caggaguucgcgcggcac

SEQ ID NO: 2576 - RNA, 18 nt, artificial
  Chemically synthesized
caagagccugcaccagga

SEQ ID NO: 2577 - RNA, 18 nt, artificial
  Chemically synthesized
cgacugcggaagccggug

SEQ ID NO: 2578 - RNA, 18 nt, artificial
  Chemically synthesized
agaggacuuucuucaggg

SEQ ID NO: 2579 - RNA, 18 nt, artificial
  Chemically synthesized
cgacacgcagaugaagcu

SEQ ID NO: 2580 - RNA, 18 nt, artificial
  Chemically synthesized
agcacagcaaagccuucg

SEQ ID NO: 2581 - RNA, 18 nt, artificial
  Chemically synthesized
gacugcggaagccggugg

SEQ ID NO: 2582 - RNA, 18 nt, artificial
  Chemically synthesized
cacgcagaugaagcugcu

SEQ ID NO: 2583 - RNA, 18 nt, artificial
  Chemically synthesized
ccagcccaacuccaagcu

SEQ ID NO: 2584 - RNA, 18 nt, artificial
  Chemically synthesized
ugcugcuggagcaggagu

SEQ ID NO: 2585 - RNA, 18 nt, artificial
  Chemically synthesized
caacuccaagcuggagaa

SEQ ID NO: 2586 - RNA, 18 nt, artificial
  Chemically synthesized
ccugcaccaggacuacag

SEQ ID NO: 2587 - RNA, 18 nt, artificial
  Chemically synthesized
cugaagcacagcaaagcc

SEQ ID NO: 2588 - RNA, 18 nt, artificial
  Chemically synthesized
cugcggaagccgguggug

SEQ ID NO: 2589 - RNA, 18 nt, artificial
  Chemically synthesized
gcugaagcugcugcugga

SEQ ID NO: 2590 - RNA, 18 nt, artificial
  Chemically synthesized
gccucuggcggcccuggu

SEQ ID NO: 2591 - RNA, 18 nt, artificial
  Chemically synthesized
acacgcagaugaagcugc

SEQ ID NO: 2592 - RNA, 18 nt, artificial
  Chemically synthesized
cgacauccuggagauggc

SEQ ID NO: 2593 - RNA, 18 nt, artificial
  Chemically synthesized
cugcuggagcaggaguuc

SEQ ID NO: 2594 - RNA, 18 nt, artificial
  Chemically synthesized
gcuggagcaggaguucgc

SEQ ID NO: 2595 - RNA, 18 nt, artificial
  Chemically synthesized
gaagcugcugcuggagca

SEQ ID NO: 2596 - RNA, 18 nt, artificial
  Chemically synthesized
cgagcagcugaagcugcu

SEQ ID NO: 2597 - RNA, 18 nt, artificial
  Chemically synthesized
aguucgcgcggcaccagc

SEQ ID NO: 2598 - RNA, 18 nt, artificial
  Chemically synthesized
aacuccaagcuggagaag

SEQ ID NO: 2599 - RNA, 18 nt, artificial
  Chemically synthesized
cagcuaccugaagcacag

SEQ ID NO: 2600 - RNA, 18 nt, artificial
  Chemically synthesized
gcagcugaagcugcugcu

SEQ ID NO: 2601 - RNA, 18 nt, artificial
  Chemically synthesized
gaaggccgacauccugga

SEQ ID NO: 2602 - RNA, 18 nt, artificial
  Chemically synthesized
cgaccgcaucaacagcag

SEQ ID NO: 2603 - RNA, 18 nt, artificial
  Chemically synthesized
cugaagcugcugcuggag

SEQ ID NO: 2604 - RNA, 18 nt, artificial
  Chemically synthesized
gcugcugcuggagcagga

SEQ ID NO: 2605 - RNA, 18 nt, artificial
  Chemically synthesized
ugucagcuaccugaagca

SEQ ID NO: 2606 - RNA, 18 nt, artificial
  Chemically synthesized
cuggagcaggaguucgcg

SEQ ID NO: 2607 - RNA, 18 nt, artificial
  Chemically synthesized
cagcugaagcugcugcug

SEQ ID NO: 2608 - RNA, 18 nt, artificial
  Chemically synthesized
ccacgccgccagcgacac

SEQ ID NO: 2609 - RNA, 18 nt, artificial
  Chemically synthesized
uggagcaggaguucgcgc

SEQ ID NO: 2610 - RNA, 18 nt, artificial
  Chemically synthesized
cugcugcuggagcaggag

SEQ ID NO: 2611 - RNA, 18 nt, artificial
  Chemically synthesized
accgcaucaacagcagca

SEQ ID NO: 2612 - RNA, 18 nt, artificial
  Chemically synthesized
aaaccgacugcggaagcc

SEQ ID NO: 2613 - RNA, 18 nt, artificial
  Chemically synthesized
guucgcgcggcaccagcc

SEQ ID NO: 2614 - RNA, 18 nt, artificial
  Chemically synthesized
uccaagcuggagaaggcc

SEQ ID NO: 2615 - RNA, 18 nt, artificial
  Chemically synthesized
uagaggacuuucuucagg

SEQ ID NO: 2616 - RNA, 18 nt, artificial
  Chemically synthesized
cauuugccuuuugugaag

SEQ ID NO: 2617 - RNA, 18 nt, artificial
  Chemically synthesized
aaaaccgacugcggaagc

SEQ ID NO: 2618 - RNA, 18 nt, artificial
  Chemically synthesized
gaggacuuucuucagggc

SEQ ID NO: 2619 - RNA, 18 nt, artificial
  Chemically synthesized
gagcagcugaagcugcug

SEQ ID NO: 2620 - RNA, 18 nt, artificial
  Chemically synthesized
cugcaccaggacuacagc

SEQ ID NO: 2621 - RNA, 18 nt, artificial
  Chemically synthesized
acugcggaagccgguggu

SEQ ID NO: 2622 - RNA, 18 nt, artificial
  Chemically synthesized
uggcggcccuggugaccc

SEQ ID NO: 2623 - RNA, 18 nt, artificial
  Chemically synthesized
agcagcugaagcugcugc

SEQ ID NO: 2624 - RNA, 18 nt, artificial
  Chemically synthesized
aaaaaccgacugcggaag

SEQ ID NO: 2625 - RNA, 18 nt, artificial
  Chemically synthesized
aagcacagcaaagccuuc

SEQ ID NO: 2626 - RNA, 18 nt, artificial
  Chemically synthesized
ugauccuuaaaggauucc

SEQ ID NO: 2627 - RNA, 18 nt, artificial
  Chemically synthesized
aagagccugcaccaggac

SEQ ID NO: 2628 - RNA, 18 nt, artificial
  Chemically synthesized
accagcccaacuccaagc

SEQ ID NO: 2629 - RNA, 18 nt, artificial
  Chemically synthesized
gacuuucuucagggcccg

SEQ ID NO: 2630 - RNA, 18 nt, artificial
  Chemically synthesized
guaccacuuccagcggcc

SEQ ID NO: 2631 - RNA, 18 nt, artificial
  Chemically synthesized
cuggcggcccuggugacc

SEQ ID NO: 2632 - RNA, 18 nt, artificial
  Chemically synthesized
auuugccuuuugugaagg

SEQ ID NO: 2633 - RNA, 18 nt, artificial
  Chemically synthesized
aagcugcugcuggagcag

SEQ ID NO: 2634 - RNA, 18 nt, artificial
  Chemically synthesized
guggugccugcaggaggc

SEQ ID NO: 2635 - RNA, 18 nt, artificial
  Chemically synthesized
augauccuuaaaggauuc

SEQ ID NO: 2636 - RNA, 18 nt, artificial
  Chemically synthesized
ucuggcggcccuggugac

SEQ ID NO: 2637 - RNA, 18 nt, artificial
  Chemically synthesized
uuugccuuuugugaaggc

SEQ ID NO: 2638 - RNA, 18 nt, artificial
  Chemically synthesized
uaccacuuccagcggccc

SEQ ID NO: 2639 - RNA, 18 nt, artificial
  Chemically synthesized
gugccgcgcgaacuccug

SEQ ID NO: 2640 - RNA, 18 nt, artificial
  Chemically synthesized
uccuggugcaggcucuug

SEQ ID NO: 2641 - RNA, 18 nt, artificial
  Chemically synthesized
caccggcuuccgcagucg

SEQ ID NO: 2642 - RNA, 18 nt, artificial
  Chemically synthesized
cccugaagaaaguccucu

SEQ ID NO: 2643 - RNA, 18 nt, artificial
  Chemically synthesized
agcuucaucugcgugucg

SEQ ID NO: 2644 - RNA, 18 nt, artificial
  Chemically synthesized
cgaaggcuuugcugugcu

SEQ ID NO: 2645 - RNA, 18 nt, artificial
  Chemically synthesized
ccaccggcuuccgcaguc

SEQ ID NO: 2646 - RNA, 18 nt, artificial
  Chemically synthesized
agcagcuucaucugcgug

SEQ ID NO: 2647 - RNA, 18 nt, artificial
  Chemically synthesized
agcuuggaguugggcugg

SEQ ID NO: 2648 - RNA, 18 nt, artificial
  Chemically synthesized
acuccugcuccagcagca

SEQ ID NO: 2649 - RNA, 18 nt, artificial
  Chemically synthesized
uucuccagcuuggaguug

SEQ ID NO: 2650 - RNA, 18 nt, artificial
  Chemically synthesized
cuguaguccuggugcagg

SEQ ID NO: 2651 - RNA, 18 nt, artificial
  Chemically synthesized
ggcuuugcugugcuucag

SEQ ID NO: 2652 - RNA, 18 nt, artificial
  Chemically synthesized
caccaccggcuuccgcag

SEQ ID NO: 2653 - RNA, 18 nt, artificial
  Chemically synthesized
uccagcagcagcuucagc

SEQ ID NO: 2654 - RNA, 18 nt, artificial
  Chemically synthesized
accagggccgccagaggc

SEQ ID NO: 2655 - RNA, 18 nt, artificial
  Chemically synthesized
gcagcuucaucugcgugu

SEQ ID NO: 2656 - RNA, 18 nt, artificial
  Chemically synthesized
gccaucuccaggaugucg

SEQ ID NO: 2657 - RNA, 18 nt, artificial
  Chemically synthesized
gaacuccugcuccagcag

SEQ ID NO: 2658 - RNA, 18 nt, artificial
  Chemically synthesized
gcgaacuccugcuccagc

SEQ ID NO: 2659 - RNA, 18 nt, artificial
  Chemically synthesized
ugcuccagcagcagcuuc

SEQ ID NO: 2660 - RNA, 18 nt, artificial
  Chemically synthesized
agcagcuucagcugcucg

SEQ ID NO: 2661 - RNA, 18 nt, artificial
  Chemically synthesized
gcuggugccgcgcgaacu

SEQ ID NO: 2662 - RNA, 18 nt, artificial
  Chemically synthesized
cuucuccagcuuggaguu

SEQ ID NO: 2663 - RNA, 18 nt, artificial
  Chemically synthesized
cugugcuucagguagcug

SEQ ID NO: 2664 - RNA, 18 nt, artificial
  Chemically synthesized
agcagcagcuucagcugc

SEQ ID NO: 2665 - RNA, 18 nt, artificial
  Chemically synthesized
uccaggaugucggccuuc

SEQ ID NO: 2666 - RNA, 18 nt, artificial
  Chemically synthesized
cugcuguugaugcggucg

SEQ ID NO: 2667 - RNA, 18 nt, artificial
  Chemically synthesized
cuccagcagcagcuucag

SEQ ID NO: 2668 - RNA, 18 nt, artificial
  Chemically synthesized
uccugcuccagcagcagc

SEQ ID NO: 2669 - RNA, 18 nt, artificial
  Chemically synthesized
ugcuucagguagcugaca

SEQ ID NO: 2670 - RNA, 18 nt, artificial
  Chemically synthesized
cgcgaacuccugcuccag

SEQ ID NO: 2671 - RNA, 18 nt, artificial
  Chemically synthesized
cagcagcagcuucagcug

SEQ ID NO: 2672 - RNA, 18 nt, artificial
  Chemically synthesized
gugucgcuggcggcgugg

SEQ ID NO: 2673 - RNA, 18 nt, artificial
  Chemically synthesized
gcgcgaacuccugcucca

SEQ ID NO: 2674 - RNA, 18 nt, artificial
  Chemically synthesized
cuccugcuccagcagcag

SEQ ID NO: 2675 - RNA, 18 nt, artificial
  Chemically synthesized
ugcugcuguugaugcggu

SEQ ID NO: 2676 - RNA, 18 nt, artificial
  Chemically synthesized
ggcuuccgcagucgguuu

SEQ ID NO: 2677 - RNA, 18 nt, artificial
  Chemically synthesized
ggcuggugccgcgcgaac

SEQ ID NO: 2678 - RNA, 18 nt, artificial
  Chemically synthesized
ggccuucuccagcuugga

SEQ ID NO: 2679 - RNA, 18 nt, artificial
  Chemically synthesized
ccugaagaaaguccucua

SEQ ID NO: 2680 - RNA, 18 nt, artificial
  Chemically synthesized
cuucacaaaaggcaaaug

SEQ ID NO: 2681 - RNA, 18 nt, artificial
  Chemically synthesized
gcuuccgcagucgguuuu

SEQ ID NO: 2682 - RNA, 18 nt, artificial
  Chemically synthesized
gcccugaagaaaguccuc

SEQ ID NO: 2683 - RNA, 18 nt, artificial
  Chemically synthesized
cagcagcuucagcugcuc

SEQ ID NO: 2684 - RNA, 18 nt, artificial
  Chemically synthesized
gcuguaguccuggugcag

SEQ ID NO: 2685 - RNA, 18 nt, artificial
  Chemically synthesized
accaccggcuuccgcagu

SEQ ID NO: 2686 - RNA, 18 nt, artificial
  Chemically synthesized
gggucaccagggccgcca

SEQ ID NO: 2687 - RNA, 18 nt, artificial
  Chemically synthesized
gcagcagcuucagcugcu

SEQ ID NO: 2688 - RNA, 18 nt, artificial
  Chemically synthesized
cuuccgcagucgguuuuu

SEQ ID NO: 2689 - RNA, 18 nt, artificial
  Chemically synthesized
gaaggcuuugcugugcuu

SEQ ID NO: 2690 - RNA, 18 nt, artificial
  Chemically synthesized
ggaauccuuuaaggauca

SEQ ID NO: 2691 - RNA, 18 nt, artificial
  Chemically synthesized
guccuggugcaggcucuu

SEQ ID NO: 2692 - RNA, 18 nt, artificial
  Chemically synthesized
gcuuggaguugggcuggu

SEQ ID NO: 2693 - RNA, 18 nt, artificial
  Chemically synthesized
cgggcccugaagaaaguc

SEQ ID NO: 2694 - RNA, 18 nt, artificial
  Chemically synthesized
ggccgcuggaagugguac

SEQ ID NO: 2695 - RNA, 18 nt, artificial
  Chemically synthesized
ggucaccagggccgccag

SEQ ID NO: 2696 - RNA, 18 nt, artificial
  Chemically synthesized
ccuucacaaaaggcaaau

SEQ ID NO: 2697 - RNA, 18 nt, artificial
  Chemically synthesized
cugcuccagcagcagcuu

SEQ ID NO: 2698 - RNA, 18 nt, artificial
  Chemically synthesized
gccuccugcaggcaccac

SEQ ID NO: 2699 - RNA, 18 nt, artificial
  Chemically synthesized
gaauccuuuaaggaucau

SEQ ID NO: 2700 - RNA, 18 nt, artificial
  Chemically synthesized
gucaccagggccgccaga

SEQ ID NO: 2701 - RNA, 18 nt, artificial
  Chemically synthesized
gccuucacaaaaggcaaa

SEQ ID NO: 2702 - RNA, 18 nt, Artificial Sequence
  Chemically synthesized
gggccgcuggaaguggua

SEQ ID NO: 2703 - RNA, 19 nt, artificial
  Chemically synthesized
guucuuaacuguuccauuu

SEQ ID NO: 2704 - RNA, 19 nt, artificial
  Chemically synthesized
cggaucugagggagaacaa

SEQ ID NO: 2705 - RNA, 19 nt, artificial
  Chemically synthesized
cgccggaucugagggagaa

SEQ ID NO: 2706 - RNA, 19 nt, artificial
  Chemically synthesized
gaucugagggagaacaaga

SEQ ID NO: 2707 - RNA, 19 nt, artificial
  Chemically synthesized
cguucuuaacuguuccauu

SEQ ID NO: 2708 - RNA, 19 nt, artificial
  Chemically synthesized
agccagucgccaagaauca

SEQ ID NO: 2709 - RNA, 19 nt, artificial
  Chemically synthesized
agguaaacgugcugcucua

SEQ ID NO: 2710 - RNA, 19 nt, artificial
  Chemically synthesized
gcuuccaccucauuuuuuu

SEQ ID NO: 2711 - RNA, 19 nt, artificial
  Chemically synthesized
ccggaucugagggagaaca

SEQ ID NO: 2712 - RNA, 19 nt, artificial
  Chemically synthesized
gcugaacucggaauccgaa

SEQ ID NO: 2713 - RNA, 19 nt, artificial
  Chemically synthesized
gggagaacaagaccgaucg

SEQ ID NO: 2714 - RNA, 19 nt, artificial
  Chemically synthesized
agcugaacucggaauccga

SEQ ID NO: 2715 - RNA, 19 nt, artificial
  Chemically synthesized
gggcuuccaccucauuuuu

SEQ ID NO: 2716 - RNA, 19 nt, artificial
  Chemically synthesized
aguuggagcugaacucgga

SEQ ID NO: 2717 - RNA, 19 nt, artificial
  Chemically synthesized
guuuggugcuucucagauu

SEQ ID NO: 2718 - RNA, 19 nt, artificial
  Chemically synthesized
cgggcuuccaccucauuuu

SEQ ID NO: 2719 - RNA, 19 nt, artificial
  Chemically synthesized
caaugaucaccgacugaaa

SEQ ID NO: 2720 - RNA, 19 nt, artificial
  Chemically synthesized
cagucgccaagaaucauga

SEQ ID NO: 2721 - RNA, 19 nt, artificial
  Chemically synthesized
ggcuguuacucacgccuca

SEQ ID NO: 2722 - RNA, 19 nt, artificial
  Chemically synthesized
gggcuguuuuuuuguuauu

SEQ ID NO: 2723 - RNA, 19 nt, artificial
  Chemically synthesized
accuucaguuggagcugaa

SEQ ID NO: 2724 - RNA, 19 nt, artificial
  Chemically synthesized
gaccuucaguuggagcuga

SEQ ID NO: 2725 - RNA, 19 nt, artificial
  Chemically synthesized
cuagucaccagagacuuua

SEQ ID NO: 2726 - RNA, 19 nt, artificial
  Chemically synthesized
ccauucuguuucagccagu

SEQ ID NO: 2727 - RNA, 19 nt, artificial
  Chemically synthesized
aggugagcaagguggagau

SEQ ID NO: 2728 - RNA, 19 nt, artificial
  Chemically synthesized
gcccauucuguuucagcca

SEQ ID NO: 2729 - RNA, 19 nt, artificial
  Chemically synthesized
ggaucugagggagaacaag

SEQ ID NO: 2730 - RNA, 19 nt, artificial
  Chemically synthesized
ggcuuccaccucauuuuuu

SEQ ID NO: 2731 - RNA, 19 nt, artificial
  Chemically synthesized
acuagucaccagagacuuu

SEQ ID NO: 2732 - RNA, 19 nt, artificial
  Chemically synthesized
ggaaauugcuuuguauugu

SEQ ID NO: 2733 - RNA, 19 nt, artificial
  Chemically synthesized
agcacgucaucgacuacau

SEQ ID NO: 2734 - RNA, 19 nt, artificial
  Chemically synthesized
gagggagaacaagaccgau

SEQ ID NO: 2735 - RNA, 19 nt, artificial
  Chemically synthesized
uguuucagccagucgccaa

SEQ ID NO: 2736 - RNA, 19 nt, artificial
  Chemically synthesized
gcuucgggcuuccaccuca

SEQ ID NO: 2737 - RNA, 19 nt, artificial
  Chemically synthesized
cucggaauccgaaguugga

SEQ ID NO: 2738 - RNA, 19 nt, artificial
  Chemically synthesized
agguggagauucuccagca

SEQ ID NO: 2739 - RNA, 19 nt, artificial
  Chemically synthesized
ggugagcaagguggagauu

SEQ ID NO: 2740 - RNA, 19 nt, artificial
  Chemically synthesized
gucgccaagaaucaugaaa

SEQ ID NO: 2741 - RNA, 19 nt, artificial
  Chemically synthesized
cagccagucgccaagaauc

SEQ ID NO: 2742 - RNA, 19 nt, artificial
  Chemically synthesized
cgcuuugcccauucuguuu

SEQ ID NO: 2743 - RNA, 19 nt, artificial
  Chemically synthesized
agaaccgcaaggugagcaa

SEQ ID NO: 2744 - RNA, 19 nt, artificial
  Chemically synthesized
gcugaaggccggcaagaca

SEQ ID NO: 2745 - RNA, 19 nt, artificial
  Chemically synthesized
gcaagguggagauucucca

SEQ ID NO: 2746 - RNA, 19 nt, artificial
  Chemically synthesized
guuggagcugaacucggaa

SEQ ID NO: 2747 - RNA, 19 nt, artificial
  Chemically synthesized
gccagucgccaagaaucau

SEQ ID NO: 2748 - RNA, 19 nt, artificial
  Chemically synthesized
acaucagggaccuucaguu

SEQ ID NO: 2749 - RNA, 19 nt, artificial
  Chemically synthesized
gggcgcuccucucugcaca

SEQ ID NO: 2750 - RNA, 19 nt, artificial
  Chemically synthesized
cggcaugcguuccugcgga

SEQ ID NO: 2751 - RNA, 19 nt, artificial
  Chemically synthesized
accucauuuuuuucgcuuu

SEQ ID NO: 2752 - RNA, 19 nt, artificial
  Chemically synthesized
gcaaggugagcaaggugga

SEQ ID NO: 2753 - RNA, 19 nt, artificial
  Chemically synthesized
ugcugcucuacgacaugaa

SEQ ID NO: 2754 - RNA, 19 nt, artificial
  Chemically synthesized
ccgacugaaaauauuguuu

SEQ ID NO: 2755 - RNA, 19 nt, artificial
  Chemically synthesized
gggaccuucaguuggagcu

SEQ ID NO: 2756 - RNA, 19 nt, artificial
  Chemically synthesized
ugagggagaacaagaccga

SEQ ID NO: 2757 - RNA, 19 nt, artificial
  Chemically synthesized
gggcugaggcugaggcacu

SEQ ID NO: 2758 - RNA, 19 nt, artificial
  Chemically synthesized
cccagaaccgcaaggugag

SEQ ID NO: 2759 - RNA, 19 nt, artificial
  Chemically synthesized
acgugcugcucuacgacau

SEQ ID NO: 2760 - RNA, 19 nt, artificial
  Chemically synthesized
cgcaucuugugucgcugaa

SEQ ID NO: 2761 - RNA, 19 nt, artificial
  Chemically synthesized
ggacgaucgcaucuugugu

SEQ ID NO: 2762 - RNA, 19 nt, artificial
  Chemically synthesized
cgcugucugucugagcaga

SEQ ID NO: 2763 - RNA, 19 nt, artificial
  Chemically synthesized
cuacuagucaccagagacu

SEQ ID NO: 2764 - RNA, 19 nt, artificial
  Chemically synthesized
ccauuuuccguaucugcuu

SEQ ID NO: 2765 - RNA, 19 nt, artificial
  Chemically synthesized
agucgccaagaaucaugaa

SEQ ID NO: 2766 - RNA, 19 nt, artificial
  Chemically synthesized
ggccgaggcggcaugcguu

SEQ ID NO: 2767 - RNA, 19 nt, artificial
  Chemically synthesized
cacgucaucgacuacauca

SEQ ID NO: 2768 - RNA, 19 nt, artificial
  Chemically synthesized
ugaggaaauugcuuuguau

SEQ ID NO: 2769 - RNA, 19 nt, artificial
  Chemically synthesized
gccaguggcagcaccgcca

SEQ ID NO: 2770 - RNA, 19 nt, artificial
  Chemically synthesized
cacucguguguuucuauuu

SEQ ID NO: 2771 - RNA, 19 nt, artificial
  Chemically synthesized
cucagauuucugaggaaau

SEQ ID NO: 2772 - RNA, 19 nt, artificial
  Chemically synthesized
ggcgagaucagcgcccuga

SEQ ID NO: 2773 - RNA, 19 nt, artificial
  Chemically synthesized
gguggugcgcugucugucu

SEQ ID NO: 2774 - RNA, 19 nt, artificial
  Chemically synthesized
cucguguguuucuauuuuu

SEQ ID NO: 2775 - RNA, 19 nt, artificial
  Chemically synthesized
acuacaucagggaccuuca

SEQ ID NO: 2776 - RNA, 19 nt, artificial
  Chemically synthesized
cuucgggcuuccaccucau

SEQ ID NO: 2777 - RNA, 19 nt, artificial
  Chemically synthesized
gccggaucugagggagaac

SEQ ID NO: 2778 - RNA, 19 nt, artificial
  Chemically synthesized
gagauucuccagcacguca

SEQ ID NO: 2779 - RNA, 19 nt, artificial
  Chemically synthesized
ccagucgccaagaaucaug

SEQ ID NO: 2780 - RNA, 19 nt, artificial
  Chemically synthesized
cuuugcccauucuguuuca

SEQ ID NO: 2781 - RNA, 19 nt, artificial
  Chemically synthesized
ggcggccacugcgcccuua

SEQ ID NO: 2782 - RNA, 19 nt, artificial
  Chemically synthesized
ugaucaccgacugaaaaua

SEQ ID NO: 2783 - RNA, 19 nt, artificial
  Chemically synthesized
ggagaacaagaccgaucgg

SEQ ID NO: 2784 - RNA, 19 nt, artificial
  Chemically synthesized
uggagauucuccagcacgu

SEQ ID NO: 2785 - RNA, 19 nt, artificial
  Chemically synthesized
cacguucuuaacuguucca

SEQ ID NO: 2786 - RNA, 19 nt, artificial
  Chemically synthesized
gaacucggaauccgaaguu

SEQ ID NO: 2787 - RNA, 19 nt, artificial
  Chemically synthesized
gcggccacugcgcccuuaa

SEQ ID NO: 2788 - RNA, 19 nt, artificial
  Chemically synthesized
ggauuccacucguguguuu

SEQ ID NO: 2789 - RNA, 19 nt, artificial
  Chemically synthesized
ggaauuacgugcucugugg

SEQ ID NO: 2790 - RNA, 19 nt, artificial
  Chemically synthesized
cuucaguuggagcugaacu

SEQ ID NO: 2791 - RNA, 19 nt, artificial
  Chemically synthesized
ggugcuucucagauuucug

SEQ ID NO: 2792 - RNA, 19 nt, artificial
  Chemically synthesized
gcuccgcucagcacccuca

SEQ ID NO: 2793 - RNA, 19 nt, artificial
  Chemically synthesized
ggagagggcgcuccucucu

SEQ ID NO: 2794 - RNA, 19 nt, artificial
  Chemically synthesized
ccuacuagucaccagagac

SEQ ID NO: 2795 - RNA, 19 nt, artificial
  Chemically synthesized
ucagccagucgccaagaau

SEQ ID NO: 2796 - RNA, 19 nt, artificial
  Chemically synthesized
ccaagaaucaugaaagucg

SEQ ID NO: 2797 - RNA, 19 nt, artificial
  Chemically synthesized
gugcuucucagauuucuga

SEQ ID NO: 2798 - RNA, 19 nt, artificial
  Chemically synthesized
gcggacgaucgcaucuugu

SEQ ID NO: 2799 - RNA, 19 nt, artificial
  Chemically synthesized
guuccugcggacgaucgca

SEQ ID NO: 2800 - RNA, 19 nt, artificial
  Chemically synthesized
caugcguuccugcggacga

SEQ ID NO: 2801 - RNA, 19 nt, artificial
  Chemically synthesized
augcguuccugcggacgau

SEQ ID NO: 2802 - RNA, 19 nt, artificial
  Chemically synthesized
gguggagauucuccagcac

SEQ ID NO: 2803 - RNA, 19 nt, artificial
  Chemically synthesized
accuacuagucaccagaga

SEQ ID NO: 2804 - RNA, 19 nt, artificial
  Chemically synthesized
ggaccuucaguuggagcug

SEQ ID NO: 2805 - RNA, 19 nt, artificial
  Chemically synthesized
cccauucuguuucagccag

SEQ ID NO: 2806 - RNA, 19 nt, artificial
  Chemically synthesized
guuucagccagucgccaag

SEQ ID NO: 2807 - RNA, 19 nt, artificial
  Chemically synthesized
gcgcgcugaaggccggcaa

SEQ ID NO: 2808 - RNA, 19 nt, artificial
  Chemically synthesized
uucagccagucgccaagaa

SEQ ID NO: 2809 - RNA, 19 nt, artificial
  Chemically synthesized
ggcaugcguuccugcggac

SEQ ID NO: 2810 - RNA, 19 nt, artificial
  Chemically synthesized
cacugcgcccuuaacugca

SEQ ID NO: 2811 - RNA, 19 nt, artificial
  Chemically synthesized
cccucaacggcgagaucag

SEQ ID NO: 2812 - RNA, 19 nt, artificial
  Chemically synthesized
gaucaccgacugaaaauau

SEQ ID NO: 2813 - RNA, 19 nt, artificial
  Chemically synthesized
agauucuccagcacgucau

SEQ ID NO: 2814 - RNA, 19 nt, artificial
  Chemically synthesized
aucaccgacugaaaauauu

SEQ ID NO: 2815 - RNA, 19 nt, artificial
  Chemically synthesized
uggacgagcagcagguaaa

SEQ ID NO: 2816 - RNA, 19 nt, artificial
  Chemically synthesized
uuuggugcuucucagauuu

SEQ ID NO: 2817 - RNA, 19 nt, artificial
  Chemically synthesized
cuggacgagcagcagguaa

SEQ ID NO: 2818 - RNA, 19 nt, artificial
  Chemically synthesized
cugcggacgaucgcaucuu

SEQ ID NO: 2819 - RNA, 19 nt, artificial
  Chemically synthesized
auuccacguucuuaacugu

SEQ ID NO: 2820 - RNA, 19 nt, artificial
  Chemically synthesized
uacuagucaccagagacuu

SEQ ID NO: 2821 - RNA, 19 nt, artificial
  Chemically synthesized
ggcugaggcugaggcacug

SEQ ID NO: 2822 - RNA, 19 nt, artificial
  Chemically synthesized
aaauggaacaguuaagaac

SEQ ID NO: 2823 - RNA, 19 nt, artificial
  Chemically synthesized
uuguucucccucagauccg

SEQ ID NO: 2824 - RNA, 19 nt, artificial
  Chemically synthesized
uucucccucagauccggcg

SEQ ID NO: 2825 - RNA, 19 nt, artificial
  Chemically synthesized
ucuuguucucccucagauc

SEQ ID NO: 2826 - RNA, 19 nt, artificial
  Chemically synthesized
aauggaacaguuaagaacg

SEQ ID NO: 2827 - RNA, 19 nt, artificial
  Chemically synthesized
ugauucuuggcgacuggcu

SEQ ID NO: 2828 - RNA, 19 nt, artificial
  Chemically synthesized
uagagcagcacguuuaccu

SEQ ID NO: 2829 - RNA, 19 nt, artificial
  Chemically synthesized
aaaaaaaugagguggaagc

SEQ ID NO: 2830 - RNA, 19 nt, artificial
  Chemically synthesized
uguucucccucagauccgg

SEQ ID NO: 2831 - RNA, 19 nt, artificial
  Chemically synthesized
uucggauuccgaguucagc

SEQ ID NO: 2832 - RNA, 19 nt, artificial
  Chemically synthesized
cgaucggucuuguucuccc

SEQ ID NO: 2833 - RNA, 19 nt, artificial
  Chemically synthesized
ucggauuccgaguucagcu

SEQ ID NO: 2834 - RNA, 19 nt, artificial
  Chemically synthesized
aaaaaugagguggaagccc

SEQ ID NO: 2835 - RNA, 19 nt, artificial
  Chemically synthesized
uccgaguucagcuccaacu

SEQ ID NO: 2836 - RNA, 19 nt, artificial
  Chemically synthesized
aaucugagaagcaccaaac

SEQ ID NO: 2837 - RNA, 19 nt, artificial
  Chemically synthesized
aaaaugagguggaagcccg

SEQ ID NO: 2838 - RNA, 19 nt, artificial
  Chemically synthesized
uuucagucggugaucauug

SEQ ID NO: 2839 - RNA, 19 nt, artificial
  Chemically synthesized
ucaugauucuuggcgacug

SEQ ID NO: 2840 - RNA, 19 nt, artificial
  Chemically synthesized
ugaggcgugaguaacagcc

SEQ ID NO: 2841 - RNA, 19 nt, artificial
  Chemically synthesized
aauaacaaaaaaacagccc

SEQ ID NO: 2842 - RNA, 19 nt, artificial
  Chemically synthesized
uucagcuccaacugaaggu

SEQ ID NO: 2843 - RNA, 19 nt, artificial
  Chemically synthesized
ucagcuccaacugaagguc

SEQ ID NO: 2844 - RNA, 19 nt, artificial
  Chemically synthesized
uaaagucucuggugacuag

SEQ ID NO: 2845 - RNA, 19 nt, artificial
  Chemically synthesized
acuggcugaaacagaaugg

SEQ ID NO: 2846 - RNA, 19 nt, artificial
  Chemically synthesized
aucuccaccuugcucaccu

SEQ ID NO: 2847 - RNA, 19 nt, artificial
  Chemically synthesized
uggcugaaacagaaugggc

SEQ ID NO: 2848 - RNA, 19 nt, artificial
  Chemically synthesized
cuuguucucccucagaucc

SEQ ID NO: 2849 - RNA, 19 nt, artificial
  Chemically synthesized
aaaaaaugagguggaagcc

SEQ ID NO: 2850 - RNA, 19 nt, artificial
  Chemically synthesized
aaagucucuggugacuagu

SEQ ID NO: 2851 - RNA, 19 nt, artificial
  Chemically synthesized
acaauacaaagcaauuucc

SEQ ID NO: 2852 - RNA, 19 nt, artificial
  Chemically synthesized
auguagucgaugacgugcu

SEQ ID NO: 2853 - RNA, 19 nt, artificial
  Chemically synthesized
aucggucuuguucucccuc

SEQ ID NO: 2854 - RNA, 19 nt, artificial
  Chemically synthesized
uuggcgacuggcugaaaca

SEQ ID NO: 2855 - RNA, 19 nt, artificial
  Chemically synthesized
ugagguggaagcccgaagc

SEQ ID NO: 2856 - RNA, 19 nt, artificial
  Chemically synthesized
uccaacuucggauuccgag

SEQ ID NO: 2857 - RNA, 19 nt, artificial
  Chemically synthesized
ugcuggagaaucuccaccu

SEQ ID NO: 2858 - RNA, 19 nt, artificial
  Chemically synthesized
aaucuccaccuugcucacc

SEQ ID NO: 2859 - RNA, 19 nt, artificial
  Chemically synthesized
uuucaugauucuuggcgac

SEQ ID NO: 2860 - RNA, 19 nt, artificial
  Chemically synthesized
gauucuuggcgacuggcug

SEQ ID NO: 2861 - RNA, 19 nt, artificial
  Chemically synthesized
aaacagaaugggcaaagcg

SEQ ID NO: 2862 - RNA, 19 nt, artificial
  Chemically synthesized
uugcucaccuugcgguucu

SEQ ID NO: 2863 - RNA, 19 nt, artificial
  Chemically synthesized
ugucuugccggccuucagc

SEQ ID NO: 2864 - RNA, 19 nt, artificial
  Chemically synthesized
uggagaaucuccaccuugc

SEQ ID NO: 2865 - RNA, 19 nt, artificial
  Chemically synthesized
uuccgaguucagcuccaac

SEQ ID NO: 2866 - RNA, 19 nt, artificial
  Chemically synthesized
augauucuuggcgacuggc

SEQ ID NO: 2867 - RNA, 19 nt, artificial
  Chemically synthesized
aacugaaggucccugaugu

SEQ ID NO: 2868 - RNA, 19 nt, artificial
  Chemically synthesized
ugugcagagaggagcgccc

SEQ ID NO: 2869 - RNA, 19 nt, artificial
  Chemically synthesized
uccgcaggaacgcaugccg

SEQ ID NO: 2870 - RNA, 19 nt, artificial
  Chemically synthesized
aaagcgaaaaaaaugaggu

SEQ ID NO: 2871 - RNA, 19 nt, artificial
  Chemically synthesized
uccaccuugcucaccuugc

SEQ ID NO: 2872 - RNA, 19 nt, artificial
  Chemically synthesized
uucaugucguagagcagca

SEQ ID NO: 2873 - RNA, 19 nt, artificial
  Chemically synthesized
aaacaauauuuucagucgg

SEQ ID NO: 2874 - RNA, 19 nt, artificial
  Chemically synthesized
agcuccaacugaagguccc

SEQ ID NO: 2875 - RNA, 19 nt, artificial
  Chemically synthesized
ucggucuuguucucccuca

SEQ ID NO: 2876 - RNA, 19 nt, artificial
  Chemically synthesized
agugccucagccucagccc

SEQ ID NO: 2877 - RNA, 19 nt, artificial
  Chemically synthesized
cucaccuugcgguucuggg

SEQ ID NO: 2878 - RNA, 19 nt, artificial
  Chemically synthesized
augucguagagcagcacgu

SEQ ID NO: 2879 - RNA, 19 nt, artificial
  Chemically synthesized
uucagcgacacaagaugcg

SEQ ID NO: 2880 - RNA, 19 nt, artificial
  Chemically synthesized
acacaagaugcgaucgucc

SEQ ID NO: 2881 - RNA, 19 nt, artificial
  Chemically synthesized
ucugcucagacagacagcg

SEQ ID NO: 2882 - RNA, 19 nt, artificial
  Chemically synthesized
agucucuggugacuaguag

SEQ ID NO: 2883 - RNA, 19 nt, artificial
  Chemically synthesized
aagcagauacggaaaaugg

SEQ ID NO: 2884 - RNA, 19 nt, artificial
  Chemically synthesized
uucaugauucuuggcgacu

SEQ ID NO: 2885 - RNA, 19 nt, artificial
  Chemically synthesized
aacgcaugccgccucggcc

SEQ ID NO: 2886 - RNA, 19 nt, artificial
  Chemically synthesized
ugauguagucgaugacgug

SEQ ID NO: 2887 - RNA, 19 nt, artificial
  Chemically synthesized
auacaaagcaauuuccuca

SEQ ID NO: 2888 - RNA, 19 nt, artificial
  Chemically synthesized
uggcggugcugccacuggc

SEQ ID NO: 2889 - RNA, 19 nt, artificial
  Chemically synthesized
aaauagaaacacacgagug

SEQ ID NO: 2890 - RNA, 19 nt, artificial
  Chemically synthesized
auuuccucagaaaucugag

SEQ ID NO: 2891 - RNA, 19 nt, artificial
  Chemically synthesized
ucagggcgcugaucucgcc

SEQ ID NO: 2892 - RNA, 19 nt, artificial
  Chemically synthesized
agacagacagcgcaccacc

SEQ ID NO: 2893 - RNA, 19 nt, artificial
  Chemically synthesized
aaaaauagaaacacacgag

SEQ ID NO: 2894 - RNA, 19 nt, artificial
  Chemically synthesized
ugaaggucccugauguagu

SEQ ID NO: 2895 - RNA, 19 nt, artificial
  Chemically synthesized
augagguggaagcccgaag

SEQ ID NO: 2896 - RNA, 19 nt, artificial
  Chemically synthesized
guucucccucagauccggc

SEQ ID NO: 2897 - RNA, 19 nt, artificial
  Chemically synthesized
ugacgugcuggagaaucuc

SEQ ID NO: 2898 - RNA, 19 nt, artificial
  Chemically synthesized
caugauucuuggcgacugg

SEQ ID NO: 2899 - RNA, 19 nt, artificial
  Chemically synthesized
ugaaacagaaugggcaaag

SEQ ID NO: 2900 - RNA, 19 nt, artificial
  Chemically synthesized
uaagggcgcaguggccgcc

SEQ ID NO: 2901 - RNA, 19 nt, artificial
  Chemically synthesized
uauuuucagucggugauca

SEQ ID NO: 2902 - RNA, 19 nt, artificial
  Chemically synthesized
ccgaucggucuuguucucc

SEQ ID NO: 2903 - RNA, 19 nt, artificial
  Chemically synthesized
acgugcuggagaaucucca

SEQ ID NO: 2904 - RNA, 19 nt, artificial
  Chemically synthesized
uggaacaguuaagaacgug

SEQ ID NO: 2905 - RNA, 19 nt, artificial
  Chemically synthesized
aacuucggauuccgaguuc

SEQ ID NO: 2906 - RNA, 19 nt, artificial
  Chemically synthesized
uuaagggcgcaguggccgc

SEQ ID NO: 2907 - RNA, 19 nt, artificial
  Chemically synthesized
aaacacacgaguggaaucc

SEQ ID NO: 2908 - RNA, 19 nt, artificial
  Chemically synthesized
ccacagagcacguaauucc

SEQ ID NO: 2909 - RNA, 19 nt, artificial
  Chemically synthesized
aguucagcuccaacugaag

SEQ ID NO: 2910 - RNA, 19 nt, artificial
  Chemically synthesized
cagaaaucugagaagcacc

SEQ ID NO: 2911 - RNA, 19 nt, artificial
  Chemically synthesized
ugagggugcugagcggagc

SEQ ID NO: 2912 - RNA, 19 nt, artificial
  Chemically synthesized
agagaggagcgcccucucc

SEQ ID NO: 2913 - RNA, 19 nt, artificial
  Chemically synthesized
gucucuggugacuaguagg

SEQ ID NO: 2914 - RNA, 19 nt, artificial
  Chemically synthesized
auucuuggcgacuggcuga

SEQ ID NO: 2915 - RNA, 19 nt, artificial
  Chemically synthesized
cgacuuucaugauucuugg

SEQ ID NO: 2916 - RNA, 19 nt, artificial
  Chemically synthesized
ucagaaaucugagaagcac

SEQ ID NO: 2917 - RNA, 19 nt, artificial
  Chemically synthesized
acaagaugcgaucguccgc

SEQ ID NO: 2918 - RNA, 19 nt, artificial
  Chemically synthesized
ugcgaucguccgcaggaac

SEQ ID NO: 2919 - RNA, 19 nt, artificial
  Chemically synthesized
ucguccgcaggaacgcaug

SEQ ID NO: 2920 - RNA, 19 nt, artificial
  Chemically synthesized
aucguccgcaggaacgcau

SEQ ID NO: 2921 - RNA, 19 nt, artificial
  Chemically synthesized
gugcuggagaaucuccacc

SEQ ID NO: 2922 - RNA, 19 nt, artificial
  Chemically synthesized
ucucuggugacuaguaggu

SEQ ID NO: 2923 - RNA, 19 nt, artificial
  Chemically synthesized
cagcuccaacugaaggucc

SEQ ID NO: 2924 - RNA, 19 nt, artificial
  Chemically synthesized
cuggcugaaacagaauggg

SEQ ID NO: 2925 - RNA, 19 nt, artificial
  Chemically synthesized
cuuggcgacuggcugaaac

SEQ ID NO: 2926 - RNA, 19 nt, artificial
  Chemically synthesized
uugccggccuucagcgcgc

SEQ ID NO: 2927 - RNA, 19 nt, artificial
  Chemically synthesized
uucuuggcgacuggcugaa

SEQ ID NO: 2928 - RNA, 19 nt, artificial
  Chemically synthesized
guccgcaggaacgcaugcc

SEQ ID NO: 2929 - RNA, 19 nt, artificial
  Chemically synthesized
ugcaguuaagggcgcagug

SEQ ID NO: 2930 - RNA, 19 nt, artificial
  Chemically synthesized
cugaucucgccguugaggg

SEQ ID NO: 2931 - RNA, 19 nt, artificial
  Chemically synthesized
auauuuucagucggugauc

SEQ ID NO: 2932 - RNA, 19 nt, artificial
  Chemically synthesized
augacgugcuggagaaucu

SEQ ID NO: 2933 - RNA, 19 nt, artificial
  Chemically synthesized
aauauuuucagucggugau

SEQ ID NO: 2934 - RNA, 19 nt, artificial
  Chemically synthesized
uuuaccugcugcucgucca

SEQ ID NO: 2935 - RNA, 19 nt, artificial
  Chemically synthesized
aaaucugagaagcaccaaa

SEQ ID NO: 2936 - RNA, 19 nt, artificial
  Chemically synthesized
uuaccugcugcucguccag

SEQ ID NO: 2937 - RNA, 19 nt, artificial
  Chemically synthesized
aagaugcgaucguccgcag

SEQ ID NO: 2938 - RNA, 19 nt, artificial
  Chemically synthesized
acaguuaagaacguggaau

SEQ ID NO: 2939 - RNA, 19 nt, artificial
  Chemically synthesized
aagucucuggugacuagua

SEQ ID NO: 2940 - RNA, 19 nt, Artificial Sequence
  Chemically synthesized
cagugccucagccucagcc

SEQ ID NO: 2941 - RNA, 19 nt, artificial
  Chemically synthesized
gcugcucuacgacaugaac

SEQ ID NO: 2942 - RNA, 19 nt, artificial
  Chemically synthesized
gaucgcaucuugugucgcu

SEQ ID NO: 2943 - RNA, 19 nt, artificial
  Chemically synthesized
cgacuacaucagggaccuu

SEQ ID NO: 2944 - RNA, 19 nt, artificial
  Chemically synthesized
cugcucuacgacaugaacg

SEQ ID NO: 2945 - RNA, 19 nt, artificial
  Chemically synthesized
ucgcaucuugugucgcuga

SEQ ID NO: 2946 - RNA, 19 nt, artificial
  Chemically synthesized
acucacgccucaaggagcu

SEQ ID NO: 2947 - RNA, 19 nt, artificial
  Chemically synthesized
cucuacgacaugaacggcu

SEQ ID NO: 2948 - RNA, 19 nt, artificial
  Chemically synthesized
ggagcuggugcccacccug

SEQ ID NO: 2949 - RNA, 19 nt, artificial
  Chemically synthesized
cacgccucaaggagcuggu

SEQ ID NO: 2950 - RNA, 19 nt, artificial
  Chemically synthesized
gacgaucgcaucuuguguc

SEQ ID NO: 2951 - RNA, 19 nt, artificial
  Chemically synthesized
gccucaaggagcuggugcc

SEQ ID NO: 2952 - RNA, 19 nt, artificial
  Chemically synthesized
ucgacuacaucagggaccu

SEQ ID NO: 2953 - RNA, 19 nt, artificial
  Chemically synthesized
cuacgacaugaacggcugu

SEQ ID NO: 2954 - RNA, 19 nt, artificial
  Chemically synthesized
ugcucuacgacaugaacgg

SEQ ID NO: 2955 - RNA, 19 nt, artificial
  Chemically synthesized
caucgacuacaucagggac

SEQ ID NO: 2956 - RNA, 19 nt, artificial
  Chemically synthesized
guauauuacaaugaucacc

SEQ ID NO: 2957 - RNA, 19 nt, artificial
  Chemically synthesized
ucuacgacaugaacggcug

SEQ ID NO: 2958 - RNA, 19 nt, artificial
  Chemically synthesized
cucaaggagcuggugccca

SEQ ID NO: 2959 - RNA, 19 nt, artificial
  Chemically synthesized
acgaucgcaucuugugucg

SEQ ID NO: 2960 - RNA, 19 nt, artificial
  Chemically synthesized
aggagcuggugcccacccu

SEQ ID NO: 2961 - RNA, 19 nt, artificial
  Chemically synthesized
ucaaggagcuggugcccac

SEQ ID NO: 2962 - RNA, 19 nt, artificial
  Chemically synthesized
agcguggccaucucgcgcu

SEQ ID NO: 2963 - RNA, 19 nt, artificial
  Chemically synthesized
gcucuacgacaugaacggc

SEQ ID NO: 2964 - RNA, 19 nt, artificial
  Chemically synthesized
uacucacgccucaaggagc

SEQ ID NO: 2965 - RNA, 19 nt, artificial
  Chemically synthesized
gcguggccaucucgcgcug

SEQ ID NO: 2966 - RNA, 19 nt, artificial
  Chemically synthesized
aucgcaucuugugucgcug

SEQ ID NO: 2967 - RNA, 19 nt, artificial
  Chemically synthesized
cgccucaaggagcuggugc

SEQ ID NO: 2968 - RNA, 19 nt, artificial
  Chemically synthesized
gagcuggugcccacccugc

SEQ ID NO: 2969 - RNA, 19 nt, artificial
  Chemically synthesized
cucacgccucaaggagcug

SEQ ID NO: 2970 - RNA, 19 nt, artificial
  Chemically synthesized
cgaucgcaucuugugucgc

SEQ ID NO: 2971 - RNA, 19 nt, artificial
  Chemically synthesized
caaggagcuggugcccacc

SEQ ID NO: 2972 - RNA, 19 nt, artificial
  Chemically synthesized
aucgacuacaucagggacc

SEQ ID NO: 2973 - RNA, 19 nt, artificial
  Chemically synthesized
agcuggugcccacccugcc

SEQ ID NO: 2974 - RNA, 19 nt, artificial
  Chemically synthesized
acgccucaaggagcuggug

SEQ ID NO: 2975 - RNA, 19 nt, artificial
  Chemically synthesized
guggccaucucgcgcugcg

SEQ ID NO: 2976 - RNA, 19 nt, artificial
  Chemically synthesized
ccucaaggagcuggugccc

SEQ ID NO: 2977 - RNA, 19 nt, artificial
  Chemically synthesized
uuacucacgccucaaggag

SEQ ID NO: 2978 - RNA, 19 nt, artificial
  Chemically synthesized
gagcguggccaucucgcgc

SEQ ID NO: 2979 - RNA, 19 nt, artificial
  Chemically synthesized
ucacgccucaaggagcugg

SEQ ID NO: 2980 - RNA, 19 nt, artificial
  Chemically synthesized
uggccaucucgcgcugcgc

SEQ ID NO: 2981 - RNA, 19 nt, artificial
  Chemically synthesized
aaggagcuggugcccaccc

SEQ ID NO: 2982 - RNA, 19 nt, artificial
  Chemically synthesized
cguggccaucucgcgcugc

SEQ ID NO: 2983 - RNA, 19 nt, artificial
  Chemically synthesized
guucaugucguagagcagc

SEQ ID NO: 2984 - RNA, 19 nt, artificial
  Chemically synthesized
agcgacacaagaugcgauc

SEQ ID NO: 2985 - RNA, 19 nt, artificial
  Chemically synthesized
aaggucccugauguagucg

SEQ ID NO: 2986 - RNA, 19 nt, artificial
  Chemically synthesized
cguucaugucguagagcag

SEQ ID NO: 2987 - RNA, 19 nt, artificial
  Chemically synthesized
ucagcgacacaagaugcga

SEQ ID NO: 2988 - RNA, 19 nt, artificial
  Chemically synthesized
agcuccuugaggcgugagu

SEQ ID NO: 2989 - RNA, 19 nt, artificial
  Chemically synthesized
agccguucaugucguagag

SEQ ID NO: 2990 - RNA, 19 nt, artificial
  Chemically synthesized
cagggugggcaccagcucc

SEQ ID NO: 2991 - RNA, 19 nt, artificial
  Chemically synthesized
accagcuccuugaggcgug

SEQ ID NO: 2992 - RNA, 19 nt, artificial
  Chemically synthesized
gacacaagaugcgaucguc

SEQ ID NO: 2993 - RNA, 19 nt, artificial
  Chemically synthesized
ggcaccagcuccuugaggc

SEQ ID NO: 2994 - RNA, 19 nt, artificial
  Chemically synthesized
aggucccugauguagucga

SEQ ID NO: 2995 - RNA, 19 nt, artificial
  Chemically synthesized
acagccguucaugucguag

SEQ ID NO: 2996 - RNA, 19 nt, artificial
  Chemically synthesized
ccguucaugucguagagca

SEQ ID NO: 2997 - RNA, 19 nt, artificial
  Chemically synthesized
gucccugauguagucgaug

SEQ ID NO: 2998 - RNA, 19 nt, artificial
  Chemically synthesized
ggugaucauuguaauauac

SEQ ID NO: 2999 - RNA, 19 nt, artificial
  Chemically synthesized
cagccguucaugucguaga

SEQ ID NO: 3000 - RNA, 19 nt, artificial
  Chemically synthesized
ugggcaccagcuccuugag

SEQ ID NO: 3001 - RNA, 19 nt, artificial
  Chemically synthesized
cgacacaagaugcgaucgu

SEQ ID NO: 3002 - RNA, 19 nt, artificial
  Chemically synthesized
agggugggcaccagcuccu

SEQ ID NO: 3003 - RNA, 19 nt, artificial
  Chemically synthesized
gugggcaccagcuccuuga

SEQ ID NO: 3004 - RNA, 19 nt, artificial
  Chemically synthesized
agcgcgagauggccacgcu

SEQ ID NO: 3005 - RNA, 19 nt, artificial
  Chemically synthesized
gccguucaugucguagagc

SEQ ID NO: 3006 - RNA, 19 nt, artificial
  Chemically synthesized
gcuccuugaggcgugagua

SEQ ID NO: 3007 - RNA, 19 nt, artificial
  Chemically synthesized
cagcgcgagauggccacgc

SEQ ID NO: 3008 - RNA, 19 nt, artificial
  Chemically synthesized
cagcgacacaagaugcgau

SEQ ID NO: 3009 - RNA, 19 nt, artificial
  Chemically synthesized
gcaccagcuccuugaggcg

SEQ ID NO: 3010 - RNA, 19 nt, artificial
  Chemically synthesized
gcagggugggcaccagcuc

SEQ ID NO: 3011 - RNA, 19 nt, artificial
  Chemically synthesized
cagcuccuugaggcgugag

SEQ ID NO: 3012 - RNA, 19 nt, artificial
  Chemically synthesized
gcgacacaagaugcgaucg

SEQ ID NO: 3013 - RNA, 19 nt, artificial
  Chemically synthesized
ggugggcaccagcuccuug

SEQ ID NO: 3014 - RNA, 19 nt, artificial
  Chemically synthesized
ggucccugauguagucgau

SEQ ID NO: 3015 - RNA, 19 nt, artificial
  Chemically synthesized
ggcagggugggcaccagcu

SEQ ID NO: 3016 - RNA, 19 nt, artificial
  Chemically synthesized
caccagcuccuugaggcgu

SEQ ID NO: 3017 - RNA, 19 nt, artificial
  Chemically synthesized
cgcagcgcgagauggccac

SEQ ID NO: 3018 - RNA, 19 nt, artificial
  Chemically synthesized
gggcaccagcuccuugagg

SEQ ID NO: 3019 - RNA, 19 nt, artificial
  Chemically synthesized
cuccuugaggcgugaguaa

SEQ ID NO: 3020 - RNA, 19 nt, artificial
  Chemically synthesized
gcgcgagauggccacgcuc

SEQ ID NO: 3021 - RNA, 19 nt, artificial
  Chemically synthesized
ccagcuccuugaggcguga

SEQ ID NO: 3022 - RNA, 19 nt, artificial
  Chemically synthesized
gcgcagcgcgagauggcca

SEQ ID NO: 3023 - RNA, 19 nt, artificial
  Chemically synthesized
gggugggcaccagcuccuu

SEQ ID NO: 3024 - RNA, 19 nt, Artificial Sequence
  Chemically synthesized
gcagcgcgagauggccacg

SEQ ID NO: 3025 - RNA, 18 nt, artificial
  Chemically synthesized
ggaucugagggagaacaa

SEQ ID NO: 3026 - RNA, 18 nt, artificial
  Chemically synthesized
gggagaacaagaccgauc

SEQ ID NO: 3027 - RNA, 18 nt, artificial
  Chemically synthesized
cagccagucgccaagaau

SEQ ID NO: 3028 - RNA, 18 nt, artificial
  Chemically synthesized
cccagaaccgcaagguga

SEQ ID NO: 3029 - RNA, 18 nt, artificial
  Chemically synthesized
guucuuaacuguuccauu

SEQ ID NO: 3030 - RNA, 18 nt, artificial
  Chemically synthesized
ggugcuucucagauuucu

SEQ ID NO: 3031 - RNA, 18 nt, artificial
  Chemically synthesized
cgggcuuccaccucauuu

SEQ ID NO: 3032 - RNA, 18 nt, artificial
  Chemically synthesized
cguucuuaacuguuccau

SEQ ID NO: 3033 - RNA, 18 nt, artificial
  Chemically synthesized
aggugagcaagguggaga

SEQ ID NO: 3034 - RNA, 18 nt, artificial
  Chemically synthesized
ccagucgccaagaaucau

SEQ ID NO: 3035 - RNA, 18 nt, artificial
  Chemically synthesized
ggagaacaagaccgaucg

SEQ ID NO: 3036 - RNA, 18 nt, artificial
  Chemically synthesized
gcuuccaccucauuuuuu

SEQ ID NO: 3037 - RNA, 18 nt, artificial
  Chemically synthesized
gccggaucugagggagaa

SEQ ID NO: 3038 - RNA, 18 nt, artificial
  Chemically synthesized
ggaauuacgugcucugug

SEQ ID NO: 3039 - RNA, 18 nt, artificial
  Chemically synthesized
gguggagauucuccagca

SEQ ID NO: 3040 - RNA, 18 nt, artificial
  Chemically synthesized
agggagaacaagaccgau

SEQ ID NO: 3041 - RNA, 18 nt, artificial
  Chemically synthesized
ugagcaagguggagauuc

SEQ ID NO: 3042 - RNA, 18 nt, artificial
  Chemically synthesized
ggcaugcguuccugcgga

SEQ ID NO: 3043 - RNA, 18 nt, artificial
  Chemically synthesized
ccuacuagucaccagaga

SEQ ID NO: 3044 - RNA, 18 nt, artificial
  Chemically synthesized
cccauucuguuucagcca

SEQ ID NO: 3045 - RNA, 18 nt, artificial
  Chemically synthesized
guuucagccagucgccaa

SEQ ID NO: 3046 - RNA, 18 nt, artificial
  Chemically synthesized
cccucaacggcgagauca

SEQ ID NO: 3047 - RNA, 18 nt, artificial
  Chemically synthesized
gggcuuccaccucauuuu

SEQ ID NO: 3048 - RNA, 18 nt, artificial
  Chemically synthesized
guuuggugcuucucagau

SEQ ID NO: 3049 - RNA, 18 nt, artificial
  Chemically synthesized
ggaccuucaguuggagcu

SEQ ID NO: 3050 - RNA, 18 nt, artificial
  Chemically synthesized
cgccaagaaucaugaaag

SEQ ID NO: 3051 - RNA, 18 nt, artificial
  Chemically synthesized
gggcuguuuuuuuguuau

SEQ ID NO: 3052 - RNA, 18 nt, artificial
  Chemically synthesized
agcacgucaucgacuaca

SEQ ID NO: 3053 - RNA, 18 nt, artificial
  Chemically synthesized
gagggagaacaagaccga

SEQ ID NO: 3054 - RNA, 18 nt, artificial
  Chemically synthesized
cacguuuggugcuucuca

SEQ ID NO: 3055 - RNA, 18 nt, artificial
  Chemically synthesized
caagaaucaugaaagucg

SEQ ID NO: 3056 - RNA, 18 nt, artificial
  Chemically synthesized
ggcugaggcugaggcacu

SEQ ID NO: 3057 - RNA, 18 nt, artificial
  Chemically synthesized
ggagauucuccagcacgu

SEQ ID NO: 3058 - RNA, 18 nt, artificial
  Chemically synthesized
gagcaagguggagauucu

SEQ ID NO: 3059 - RNA, 18 nt, artificial
  Chemically synthesized
cauucuguuucagccagu

SEQ ID NO: 3060 - RNA, 18 nt, artificial
  Chemically synthesized
ccaagaaucaugaaaguc

SEQ ID NO: 3061 - RNA, 18 nt, artificial
  Chemically synthesized
ggaaauugcuuuguauug

SEQ ID NO: 3062 - RNA, 18 nt, artificial
  Chemically synthesized
ccacguucuuaacuguuc

SEQ ID NO: 3063 - RNA, 18 nt, artificial
  Chemically synthesized
ggcuuccaccucauuuuu

SEQ ID NO: 3064 - RNA, 18 nt, artificial
  Chemically synthesized
ugcggacgaucgcaucuu

SEQ ID NO: 3065 - RNA, 18 nt, artificial
  Chemically synthesized
uagucaccagagacuuua

SEQ ID NO: 3066 - RNA, 18 nt, artificial
  Chemically synthesized
gccagucgccaagaauca

SEQ ID NO: 3067 - RNA, 18 nt, artificial
  Chemically synthesized
acuagucaccagagacuu

SEQ ID NO: 3068 - RNA, 18 nt, artificial
  Chemically synthesized
gaggcacuggcgaggaga

SEQ ID NO: 3069 - RNA, 18 nt, artificial
  Chemically synthesized
ggagcugaacucggaauc

SEQ ID NO: 3070 - RNA, 18 nt, artificial
  Chemically synthesized
ggucacguuuggugcuuc

SEQ ID NO: 3071 - RNA, 18 nt, artificial
  Chemically synthesized
cggaauccgaaguuggaa

SEQ ID NO: 3072 - RNA, 18 nt, artificial
  Chemically synthesized
gcgagaucagcgcccuga

SEQ ID NO: 3073 - RNA, 18 nt, artificial
  Chemically synthesized
ucgccaagaaucaugaaa

SEQ ID NO: 3074 - RNA, 18 nt, artificial
  Chemically synthesized
cugcacaccuacuaguca

SEQ ID NO: 3075 - RNA, 18 nt, artificial
  Chemically synthesized
cgcugaaggccggcaaga

SEQ ID NO: 3076 - RNA, 18 nt, artificial
  Chemically synthesized
ggugagcaagguggagau

SEQ ID NO: 3077 - RNA, 18 nt, artificial
  Chemically synthesized
ccucauuuuuuucgcuuu

SEQ ID NO: 3078 - RNA, 18 nt, artificial
  Chemically synthesized
gcugcucuacgacaugaa

SEQ ID NO: 3079 - RNA, 18 nt, artificial
  Chemically synthesized
acgugcugcucuacgaca

SEQ ID NO: 3080 - RNA, 18 nt, artificial
  Chemically synthesized
ccuucaguuggagcugaa

SEQ ID NO: 3081 - RNA, 18 nt, artificial
  Chemically synthesized
gaggaaauugcuuuguau

SEQ ID NO: 3082 - RNA, 18 nt, artificial
  Chemically synthesized
ggcgcuccucucugcaca

SEQ ID NO: 3083 - RNA, 18 nt, artificial
  Chemically synthesized
cgugcugcucuacgacau

SEQ ID NO: 3084 - RNA, 18 nt, artificial
  Chemically synthesized
gggaccuucaguuggagc

SEQ ID NO: 3085 - RNA, 18 nt, artificial
  Chemically synthesized
gggcugaggcugaggcac

SEQ ID NO: 3086 - RNA, 18 nt, artificial
  Chemically synthesized
ccauucuguuucagccag

SEQ ID NO: 3087 - RNA, 18 nt, artificial
  Chemically synthesized
agaggaauuacgugcucu

SEQ ID NO: 3088 - RNA, 18 nt, artificial
  Chemically synthesized
cggacgaucgcaucuugu

SEQ ID NO: 3089 - RNA, 18 nt, artificial
  Chemically synthesized
gccucaaggagcuggugc

SEQ ID NO: 3090 - RNA, 18 nt, artificial
  Chemically synthesized
gugagcaagguggagauu

SEQ ID NO: 3091 - RNA, 18 nt, artificial
  Chemically synthesized
aucugagggagaacaaga

SEQ ID NO: 3092 - RNA, 18 nt, artificial
  Chemically synthesized
guuccauuuuccguaucu

SEQ ID NO: 3093 - RNA, 18 nt, artificial
  Chemically synthesized
ugaggaaauugcuuugua

SEQ ID NO: 3094 - RNA, 18 nt, artificial
  Chemically synthesized
gagaacaagaccgaucgg

SEQ ID NO: 3095 - RNA, 18 nt, artificial
  Chemically synthesized
acaucagggaccuucagu

SEQ ID NO: 3096 - RNA, 18 nt, artificial
  Chemically synthesized
gaaucaugaaagucgcca

SEQ ID NO: 3097 - RNA, 18 nt, artificial
  Chemically synthesized
cuacuagucaccagagac

SEQ ID NO: 3098 - RNA, 18 nt, artificial
  Chemically synthesized
ggacgaucgcaucuugug

SEQ ID NO: 3099 - RNA, 18 nt, artificial
  Chemically synthesized
gcccuuaacugcauccag

SEQ ID NO: 3100 - RNA, 18 nt, artificial
  Chemically synthesized
cucagauuucugaggaaa

SEQ ID NO: 3101 - RNA, 18 nt, artificial
  Chemically synthesized
cuucgggcuuccaccuca

SEQ ID NO: 3102 - RNA, 18 nt, artificial
  Chemically synthesized
cugagggagaacaagacc

SEQ ID NO: 3103 - RNA, 18 nt, artificial
  Chemically synthesized
gccacugcgcccuuaacu

SEQ ID NO: 3104 - RNA, 18 nt, artificial
  Chemically synthesized
caccuacuagucaccaga

SEQ ID NO: 3105 - RNA, 18 nt, artificial
  Chemically synthesized
accucauuuuuuucgcuu

SEQ ID NO: 3106 - RNA, 18 nt, artificial
  Chemically synthesized
cugaaggccggcaagaca

SEQ ID NO: 3107 - RNA, 18 nt, artificial
  Chemically synthesized
gcacgucaucgacuacau

SEQ ID NO: 3108 - RNA, 18 nt, artificial
  Chemically synthesized
agaacaagaccgaucggc

SEQ ID NO: 3109 - RNA, 18 nt, artificial
  Chemically synthesized
gcgccucgccggaucuga

SEQ ID NO: 3110 - RNA, 18 nt, artificial
  Chemically synthesized
gguaaacgugcugcucua

SEQ ID NO: 3111 - RNA, 18 nt, artificial
  Chemically synthesized
gcaucuugugucgcugaa

SEQ ID NO: 3112 - RNA, 18 nt, artificial
  Chemically synthesized
gggcaagaggaauuacgu

SEQ ID NO: 3113 - RNA, 18 nt, artificial
  Chemically synthesized
gguggugcgcugucuguc

SEQ ID NO: 3114 - RNA, 18 nt, artificial
  Chemically synthesized
gggugggauuccacucgu

SEQ ID NO: 3115 - RNA, 18 nt, artificial
  Chemically synthesized
cagggaccuucaguugga

SEQ ID NO: 3116 - RNA, 18 nt, artificial
  Chemically synthesized
cuuccaccucauuuuuuu

SEQ ID NO: 3117 - RNA, 18 nt, artificial
  Chemically synthesized
caguuggagcugaacucg

SEQ ID NO: 3118 - RNA, 18 nt, artificial
  Chemically synthesized
cgcccuuaacugcaucca

SEQ ID NO: 3119 - RNA, 18 nt, artificial
  Chemically synthesized
cauuuuccguaucugcuu

SEQ ID NO: 3120 - RNA, 18 nt, artificial
  Chemically synthesized
acgucaucgacuacauca

SEQ ID NO: 3121 - RNA, 18 nt, artificial
  Chemically synthesized
caagguggagauucucca

SEQ ID NO: 3122 - RNA, 18 nt, artificial
  Chemically synthesized
ggugcgcugucugucuga

SEQ ID NO: 3123 - RNA, 18 nt, artificial
  Chemically synthesized
gaaccgcaaggugagcaa

SEQ ID NO: 3124 - RNA, 18 nt, artificial
  Chemically synthesized
gcugucugucugagcaga

SEQ ID NO: 3125 - RNA, 18 nt, artificial
  Chemically synthesized
gcuucucagauuucugag

SEQ ID NO: 3126 - RNA, 18 nt, artificial
  Chemically synthesized
ccauuuuccguaucugcu

SEQ ID NO: 3127 - RNA, 18 nt, artificial
  Chemically synthesized
ccagcacgucaucgacua

SEQ ID NO: 3128 - RNA, 18 nt, artificial
  Chemically synthesized
aggagagggcgcuccucu

SEQ ID NO: 3129 - RNA, 18 nt, artificial
  Chemically synthesized
ggccgaggcggcaugcgu

SEQ ID NO: 3130 - RNA, 18 nt, artificial
  Chemically synthesized
cgcgcugaaggccggcaa

SEQ ID NO: 3131 - RNA, 18 nt, artificial
  Chemically synthesized
gauucuccagcacgucau

SEQ ID NO: 3132 - RNA, 18 nt, artificial
  Chemically synthesized
ccagaaccgcaaggugag

SEQ ID NO: 3133 - RNA, 18 nt, artificial
  Chemically synthesized
cacucguguguuucuauu

SEQ ID NO: 3134 - RNA, 18 nt, artificial
  Chemically synthesized
guaucugcuucgggcuuc

SEQ ID NO: 3135 - RNA, 18 nt, artificial
  Chemically synthesized
cugcggacgaucgcaucu

SEQ ID NO: 3136 - RNA, 18 nt, artificial
  Chemically synthesized
ccgcaaggugagcaaggu

SEQ ID NO: 3137 - RNA, 18 nt, artificial
  Chemically synthesized
ugcucuacgacaugaacg

SEQ ID NO: 3138 - RNA, 18 nt, artificial
  Chemically synthesized
cucguguguuucuauuuu

SEQ ID NO: 3139 - RNA, 18 nt, artificial
  Chemically synthesized
cugaacucggaauccgaa

SEQ ID NO: 3140 - RNA, 18 nt, artificial
  Chemically synthesized
ggacgagcagcagguaaa

SEQ ID NO: 3141 - RNA, 18 nt, artificial
  Chemically synthesized
gccaagaaucaugaaagu

SEQ ID NO: 3142 - RNA, 18 nt, artificial
  Chemically synthesized
gagcugaacucggaaucc

SEQ ID NO: 3143 - RNA, 18 nt, artificial
  Chemically synthesized
uggagauucuccagcacg

SEQ ID NO: 3144 - RNA, 18 nt, artificial
  Chemically synthesized
guggugcgcugucugucu

SEQ ID NO: 3145 - RNA, 18 nt, artificial
  Chemically synthesized
caucagggaccuucaguu

SEQ ID NO: 3146 - RNA, 18 nt, artificial
  Chemically synthesized
cagauuucugaggaaauu

SEQ ID NO: 3147 - RNA, 18 nt, artificial
  Chemically synthesized
cacaccuacuagucacca

SEQ ID NO: 3148 - RNA, 18 nt, artificial
  Chemically synthesized
cuucaguuggagcugaac

SEQ ID NO: 3149 - RNA, 18 nt, artificial
  Chemically synthesized
gaaagucgccaguggcag

SEQ ID NO: 3150 - RNA, 18 nt, artificial
  Chemically synthesized
gcuuugcccauucuguuu

SEQ ID NO: 3151 - RNA, 18 nt, artificial
  Chemically synthesized
acucggaauccgaaguug

SEQ ID NO: 3152 - RNA, 18 nt, artificial
  Chemically synthesized
gcguuccugcggacgauc

SEQ ID NO: 3153 - RNA, 18 nt, artificial
  Chemically synthesized
gacgaucgcaucuugugu

SEQ ID NO: 3154 - RNA, 18 nt, artificial
  Chemically synthesized
ggccggcaagacagcgag

SEQ ID NO: 3155 - RNA, 18 nt, artificial
  Chemically synthesized
ggcaagacagcgagcggu

SEQ ID NO: 3156 - RNA, 18 nt, artificial
  Chemically synthesized
cugcucuacgacaugaac

SEQ ID NO: 3157 - RNA, 18 nt, artificial
  Chemically synthesized
cuacaucagggaccuuca

SEQ ID NO: 3158 - RNA, 18 nt, artificial
  Chemically synthesized
augcguuccugcggacga

SEQ ID NO: 3159 - RNA, 18 nt, artificial
  Chemically synthesized
gcgcugucugucugagca

SEQ ID NO: 3160 - RNA, 18 nt, artificial
  Chemically synthesized
caacgcgccucgccggau

SEQ ID NO: 3161 - RNA, 18 nt, artificial
  Chemically synthesized
cugucugucugagcagag

SEQ ID NO: 3162 - RNA, 18 nt, artificial
  Chemically synthesized
gaacaagaccgaucggcg

SEQ ID NO: 3163 - RNA, 18 nt, artificial
  Chemically synthesized
ggagcuggugcccacccu

SEQ ID NO: 3164 - RNA, 18 nt, artificial
  Chemically synthesized
cucucugcacaccuacua

SEQ ID NO: 3165 - RNA, 18 nt, artificial
  Chemically synthesized
ggagagggcgcuccucuc

SEQ ID NO: 3166 - RNA, 18 nt, artificial
  Chemically synthesized
gaacucggaauccgaagu

SEQ ID NO: 3167 - RNA, 18 nt, artificial
  Chemically synthesized
gagagggcgcuccucucu

SEQ ID NO: 3168 - RNA, 18 nt, artificial
  Chemically synthesized
uggagcugaacucggaau

SEQ ID NO: 3169 - RNA, 18 nt, artificial
  Chemically synthesized
ccacucguguguuucuau

SEQ ID NO: 3170 - RNA, 18 nt, artificial
  Chemically synthesized
ggcaagaggaauuacgug

SEQ ID NO: 3171 - RNA, 18 nt, artificial
  Chemically synthesized
uggucacguuuggugcuu

SEQ ID NO: 3172 - RNA, 18 nt, artificial
  Chemically synthesized
cgggcgagguggugcgcu

SEQ ID NO: 3173 - RNA, 18 nt, artificial
  Chemically synthesized
cgcuuugcccauucuguu

SEQ ID NO: 3174 - RNA, 18 nt, artificial
  Chemically synthesized
gaucaccgacugaaaaua

SEQ ID NO: 3175 - RNA, 18 nt, artificial
  Chemically synthesized
ggcuccgcucagcacccu

SEQ ID NO: 3176 - RNA, 18 nt, artificial
  Chemically synthesized
agauucuccagcacguca

SEQ ID NO: 3177 - RNA, 18 nt, artificial
  Chemically synthesized
gcggacgaucgcaucuug

SEQ ID NO: 3178 - RNA, 18 nt, artificial
  Chemically synthesized
ggaauccgaaguuggaac

SEQ ID NO: 3179 - RNA, 18 nt, artificial
  Chemically synthesized
gacuacaucagggaccuu

SEQ ID NO: 3180 - RNA, 18 nt, artificial
  Chemically synthesized
gcgccugccugcccugcu

SEQ ID NO: 3181 - RNA, 18 nt, artificial
  Chemically synthesized
caucuugugucgcugaag

SEQ ID NO: 3182 - RNA, 18 nt, artificial
  Chemically synthesized
cguaucugcuucgggcuu

SEQ ID NO: 3183 - RNA, 18 nt, artificial
  Chemically synthesized
cgcaaggugagcaaggug

SEQ ID NO: 3184 - RNA, 18 nt, artificial
  Chemically synthesized
cacccucaacggcgagau

SEQ ID NO: 3185 - RNA, 18 nt, artificial
  Chemically synthesized
cgagguggugcgcugucu

SEQ ID NO: 3186 - RNA, 18 nt, artificial
  Chemically synthesized
caucgacuacaucaggga

SEQ ID NO: 3187 - RNA, 18 nt, artificial
  Chemically synthesized
acuguuccauuuuccgua

SEQ ID NO: 3188 - RNA, 18 nt, artificial
  Chemically synthesized
ccaguggcagcaccgcca

SEQ ID NO: 3189 - RNA, 18 nt, artificial
  Chemically synthesized
agcagagcguggccaucu

SEQ ID NO: 3190 - RNA, 18 nt, artificial
  Chemically synthesized
agcaagguggagauucuc

SEQ ID NO: 3191 - RNA, 18 nt, artificial
  Chemically synthesized
cccuuaacugcauccagc

SEQ ID NO: 3192 - RNA, 18 nt, artificial
  Chemically synthesized
uucaguuggagcugaacu

SEQ ID NO: 3193 - RNA, 18 nt, artificial
  Chemically synthesized
auuccacguucuuaacug

SEQ ID NO: 3194 - RNA, 18 nt, artificial
  Chemically synthesized
ggcacuggcgaggagagg

SEQ ID NO: 3195 - RNA, 18 nt, artificial
  Chemically synthesized
gcacccucaacggcgaga

SEQ ID NO: 3196 - RNA, 18 nt, artificial
  Chemically synthesized
gguccgggcuccgcucag

SEQ ID NO: 3197 - RNA, 18 nt, artificial
  Chemically synthesized
ucuguuucagccagucgc

SEQ ID NO: 3198 - RNA, 18 nt, artificial
  Chemically synthesized
ccgacugaaaauauuguu

SEQ ID NO: 3199 - RNA, 18 nt, artificial
  Chemically synthesized
cuuaacuguuccauuuuc

SEQ ID NO: 3200 - RNA, 18 nt, artificial
  Chemically synthesized
ccacugcgcccuuaacug

SEQ ID NO: 3201 - RNA, 18 nt, artificial
  Chemically synthesized
ucagccagucgccaagaa

SEQ ID NO: 3202 - RNA, 18 nt, artificial
  Chemically synthesized
cguuuggugcuucucaga

SEQ ID NO: 3203 - RNA, 18 nt, artificial
  Chemically synthesized
ccaccucauuuuuuucgc

SEQ ID NO: 3204 - RNA, 18 nt, artificial
  Chemically synthesized
cgcucagcacccucaacg

SEQ ID NO: 3205 - RNA, 18 nt, artificial
  Chemically synthesized
guggagauucuccagcac

SEQ ID NO: 3206 - RNA, 18 nt, artificial
  Chemically synthesized
ccagcugcgcgcugaagg

SEQ ID NO: 3207 - RNA, 18 nt, artificial
  Chemically synthesized
agucgccaguggcagcac

SEQ ID NO: 3208 - RNA, 18 nt, artificial
  Chemically synthesized
cgagaucagcgcccugac

SEQ ID NO: 3209 - RNA, 18 nt, artificial
  Chemically synthesized
agauuucugaggaaauug

SEQ ID NO: 3210 - RNA, 18 nt, artificial
  Chemically synthesized
caugaaagucgccagugg

SEQ ID NO: 3211 - RNA, 18 nt, artificial
  Chemically synthesized
cugcgcccuuaacugcau

SEQ ID NO: 3212 - RNA, 18 nt, artificial
  Chemically synthesized
gucacguuuggugcuucu

SEQ ID NO: 3213 - RNA, 18 nt, artificial
  Chemically synthesized
cucugcacaccuacuagu

SEQ ID NO: 3214 - RNA, 18 nt, artificial
  Chemically synthesized
ggcugaggcacuggcgag

SEQ ID NO: 3215 - RNA, 18 nt, artificial
  Chemically synthesized
aucaccgacugaaaauau

SEQ ID NO: 3216 - RNA, 18 nt, artificial
  Chemically synthesized
ggcggcaugcguuccugc

SEQ ID NO: 3217 - RNA, 18 nt, artificial
  Chemically synthesized
uuuggugcuucucagauu

SEQ ID NO: 3218 - RNA, 18 nt, artificial
  Chemically synthesized
cggcgagaucagcgcccu

SEQ ID NO: 3219 - RNA, 18 nt, artificial
  Chemically synthesized
cuguuccauuuuccguau

SEQ ID NO: 3220 - RNA, 18 nt, artificial
  Chemically synthesized
cucgccggaucugaggga

SEQ ID NO: 3221 - RNA, 18 nt, artificial
  Chemically synthesized
cgagcagcagguaaacgu

SEQ ID NO: 3222 - RNA, 18 nt, artificial
  Chemically synthesized
ucaugaaagucgccagug

SEQ ID NO: 3223 - RNA, 18 nt, artificial
  Chemically synthesized
agggaccuucaguuggag

SEQ ID NO: 3224 - RNA, 18 nt, artificial
  Chemically synthesized
cucauuuuuuucgcuuug

SEQ ID NO: 3225 - RNA, 18 nt, artificial
  Chemically synthesized
acucguguguuucuauuu

SEQ ID NO: 3226 - RNA, 18 nt, artificial
  Chemically synthesized
ccggcaagacagcgagcg

SEQ ID NO: 3227 - RNA, 18 nt, artificial
  Chemically synthesized
uacuagucaccagagacu

SEQ ID NO: 3228 - RNA, 18 nt, artificial
  Chemically synthesized
ccguaucugcuucgggcu

SEQ ID NO: 3229 - RNA, 18 nt, artificial
  Chemically synthesized
cgccaguggcagcaccgc

SEQ ID NO: 3230 - RNA, 18 nt, artificial
  Chemically synthesized
gugcgcugucugucugag

SEQ ID NO: 3231 - RNA, 18 nt, artificial
  Chemically synthesized
cuccucucugcacaccua

SEQ ID NO: 3232 - RNA, 18 nt, artificial
  Chemically synthesized
cgccucgccggaucugag

SEQ ID NO: 3233 - RNA, 18 nt, artificial
  Chemically synthesized
cgacaugaacggcuguua

SEQ ID NO: 3234 - RNA, 18 nt, artificial
  Chemically synthesized
ccugcggacgaucgcauc

SEQ ID NO: 3235 - RNA, 18 nt, artificial
  Chemically synthesized
ugcguuccugcggacgau

SEQ ID NO: 3236 - RNA, 18 nt, artificial
  Chemically synthesized
ugcccauucuguuucagc

SEQ ID NO: 3237 - RNA, 18 nt, artificial
  Chemically synthesized
cgucaucgacuacaucag

SEQ ID NO: 3238 - RNA, 18 nt, artificial
  Chemically synthesized
agagggcgcuccucucug

SEQ ID NO: 3239 - RNA, 18 nt, artificial
  Chemically synthesized
uacucacgccucaaggag

SEQ ID NO: 3240 - RNA, 18 nt, artificial
  Chemically synthesized
acugcgcccuuaacugca

SEQ ID NO: 3241 - RNA, 18 nt, artificial
  Chemically synthesized
aggcugaggcacuggcga

SEQ ID NO: 3242 - RNA, 18 nt, artificial
  Chemically synthesized
gcucuacgacaugaacgg

SEQ ID NO: 3243 - RNA, 18 nt, artificial
  Chemically synthesized
gaucgcaucuugugucgc

SEQ ID NO: 3244 - RNA, 18 nt, artificial
  Chemically synthesized
cugucugagcagagcgug

SEQ ID NO: 3245 - RNA, 18 nt, artificial
  Chemically synthesized
ggcgagguggugcgcugu

SEQ ID NO: 3246 - RNA, 18 nt, artificial
  Chemically synthesized
ggccacugcgcccuuaac

SEQ ID NO: 3247 - RNA, 18 nt, artificial
  Chemically synthesized
aggaauuacgugcucugu

SEQ ID NO: 3248 - RNA, 18 nt, artificial
  Chemically synthesized
cggcaagacagcgagcgg

SEQ ID NO: 3249 - RNA, 18 nt, artificial
  Chemically synthesized
gucaccagagacuuuagg

SEQ ID NO: 3250 - RNA, 18 nt, artificial
  Chemically synthesized
uucuguuucagccagucg

SEQ ID NO: 3251 - RNA, 18 nt, artificial
  Chemically synthesized
uccugcggacgaucgcau

SEQ ID NO: 3252 - RNA, 18 nt, artificial
  Chemically synthesized
gcugcgcgcugaaggccg

SEQ ID NO: 3253 - RNA, 18 nt, artificial
  Chemically synthesized
caaggugagcaaggugga

SEQ ID NO: 3254 - RNA, 18 nt, artificial
  Chemically synthesized
ugaacucggaauccgaag

SEQ ID NO: 3255 - RNA, 18 nt, artificial
  Chemically synthesized
ucuacgacaugaacggcu

SEQ ID NO: 3256 - RNA, 18 nt, artificial
  Chemically synthesized
gcggcaugcguuccugcg

SEQ ID NO: 3257 - RNA, 18 nt, artificial
  Chemically synthesized
caccucauuuuuuucgcu

SEQ ID NO: 3258 - RNA, 18 nt, artificial
  Chemically synthesized
cuguuacucacgccucaa

SEQ ID NO: 3259 - RNA, 18 nt, artificial
  Chemically synthesized
cguuccugcggacgaucg

SEQ ID NO: 3260 - RNA, 18 nt, artificial
  Chemically synthesized
ccucaacggcgagaucag

SEQ ID NO: 3261 - RNA, 18 nt, artificial
  Chemically synthesized
ucaccgacugaaaauauu

SEQ ID NO: 3262 - RNA, 18 nt, artificial
  Chemically synthesized
gcaugcguuccugcggac

SEQ ID NO: 3263 - RNA, 18 nt, artificial
  Chemically synthesized
cuugugucgcugaagcgc

SEQ ID NO: 3264 - RNA, 18 nt, artificial
  Chemically synthesized
caccgacugaaaauauug

SEQ ID NO: 3265 - RNA, 18 nt, artificial
  Chemically synthesized
agaucagcgcccugacgg

SEQ ID NO: 3266 - RNA, 18 nt, artificial
  Chemically synthesized
gggcgagguggugcgcug

SEQ ID NO: 3267 - RNA, 18 nt, artificial
  Chemically synthesized
uccacguucuuaacuguu

SEQ ID NO: 3268 - RNA, 18 nt, artificial
  Chemically synthesized
uggugcuucucagauuuc

SEQ ID NO: 3269 - RNA, 18 nt, artificial
  Chemically synthesized
aacucggaauccgaaguu

SEQ ID NO: 3270 - RNA, 18 nt, artificial
  Chemically synthesized
cgggcuccgcucagcacc

SEQ ID NO: 3271 - RNA, 18 nt, artificial
  Chemically synthesized
aggccggcaagacagcga

SEQ ID NO: 3272 - RNA, 18 nt, artificial
  Chemically synthesized
ggauuccacucguguguu

SEQ ID NO: 3273 - RNA, 18 nt, artificial
  Chemically synthesized
gcgagguggugcgcuguc

SEQ ID NO: 3274 - RNA, 18 nt, artificial
  Chemically synthesized
aaaaaauggucacguuug

SEQ ID NO: 3275 - RNA, 18 nt, artificial
  Chemically synthesized
cgacuacaucagggaccu

SEQ ID NO: 3276 - RNA, 18 nt, artificial
  Chemically synthesized
gaggcggcaugcguuccu

SEQ ID NO: 3277 - RNA, 18 nt, artificial
  Chemically synthesized
aaacgugcugcucuacga

SEQ ID NO: 3278 - RNA, 18 nt, artificial
  Chemically synthesized
caguggcagcaccgccac

SEQ ID NO: 3279 - RNA, 18 nt, artificial
  Chemically synthesized
gugggauuccacucgugu

SEQ ID NO: 3280 - RNA, 18 nt, artificial
  Chemically synthesized
ucaguuggagcugaacuc

SEQ ID NO: 3281 - RNA, 18 nt, artificial
  Chemically synthesized
ucagauuucugaggaaau

SEQ ID NO: 3282 - RNA, 18 nt, artificial
  Chemically synthesized
ucaaggagcuggugccca

SEQ ID NO: 3283 - RNA, 18 nt, artificial
  Chemically synthesized
gccgaggcggcaugcguu

SEQ ID NO: 3284 - RNA, 18 nt, artificial
  Chemically synthesized
cggccacugcgcccuuaa

SEQ ID NO: 3285 - RNA, 18 nt, artificial
  Chemically synthesized
cgugcucugugggucucc

SEQ ID NO: 3286 - RNA, 18 nt, artificial
  Chemically synthesized
gaccgaucggcggccacu

SEQ ID NO: 3287 - RNA, 18 nt, artificial
  Chemically synthesized
ucugagggagaacaagac

SEQ ID NO: 3288 - RNA, 18 nt, artificial
  Chemically synthesized
gucgccaguggcagcacc

SEQ ID NO: 3289 - RNA, 18 nt, artificial
  Chemically synthesized
ccgggcuccgcucagcac

SEQ ID NO: 3290 - RNA, 18 nt, artificial
  Chemically synthesized
agggcgcuccucucugca

SEQ ID NO: 3291 - RNA, 18 nt, artificial
  Chemically synthesized
gcaagaggaauuacgugc

SEQ ID NO: 3292 - RNA, 18 nt, artificial
  Chemically synthesized
ugcuucucagauuucuga

SEQ ID NO: 3293 - RNA, 18 nt, artificial
  Chemically synthesized
cugcuucgggcuuccacc

SEQ ID NO: 3294 - RNA, 18 nt, artificial
  Chemically synthesized
augaucaccgacugaaaa

SEQ ID NO: 3295 - RNA, 18 nt, artificial
  Chemically synthesized
cggcuguuacucacgccu

SEQ ID NO: 3296 - RNA, 18 nt, artificial
  Chemically synthesized
gaauuacgugcucugugg

SEQ ID NO: 3297 - RNA, 18 nt, artificial
  Chemically synthesized
gagaucagcgcccugacg

SEQ ID NO: 3298 - RNA, 18 nt, artificial
  Chemically synthesized
ucugcuucgggcuuccac

SEQ ID NO: 3299 - RNA, 18 nt, artificial
  Chemically synthesized
ugcacaccuacuagucac

SEQ ID NO: 3300 - RNA, 18 nt, artificial
  Chemically synthesized
uuguucucccucagaucc

SEQ ID NO: 3301 - RNA, 18 nt, artificial
  Chemically synthesized
gaucggucuuguucuccc

SEQ ID NO: 3302 - RNA, 18 nt, artificial
  Chemically synthesized
auucuuggcgacuggcug

SEQ ID NO: 3303 - RNA, 18 nt, artificial
  Chemically synthesized
ucaccuugcgguucuggg

SEQ ID NO: 3304 - RNA, 18 nt, artificial
  Chemically synthesized
aauggaacaguuaagaac

SEQ ID NO: 3305 - RNA, 18 nt, artificial
  Chemically synthesized
agaaaucugagaagcacc

SEQ ID NO: 3306 - RNA, 18 nt, artificial
  Chemically synthesized
aaaugagguggaagcccg

SEQ ID NO: 3307 - RNA, 18 nt, artificial
  Chemically synthesized
auggaacaguuaagaacg

SEQ ID NO: 3308 - RNA, 18 nt, artificial
  Chemically synthesized
ucuccaccuugcucaccu

SEQ ID NO: 3309 - RNA, 18 nt, artificial
  Chemically synthesized
augauucuuggcgacugg

SEQ ID NO: 3310 - RNA, 18 nt, artificial
  Chemically synthesized
cgaucggucuuguucucc

SEQ ID NO: 3311 - RNA, 18 nt, artificial
  Chemically synthesized
aaaaaaugagguggaagc

SEQ ID NO: 3312 - RNA, 18 nt, artificial
  Chemically synthesized
uucucccucagauccggc

SEQ ID NO: 3313 - RNA, 18 nt, artificial
  Chemically synthesized
cacagagcacguaauucc

SEQ ID NO: 3314 - RNA, 18 nt, artificial
  Chemically synthesized
ugcuggagaaucuccacc

SEQ ID NO: 3315 - RNA, 18 nt, artificial
  Chemically synthesized
aucggucuuguucucccu

SEQ ID NO: 3316 - RNA, 18 nt, artificial
  Chemically synthesized
gaaucuccaccuugcuca

SEQ ID NO: 3317 - RNA, 18 nt, artificial
  Chemically synthesized
uccgcaggaacgcaugcc

SEQ ID NO: 3318 - RNA, 18 nt, artificial
  Chemically synthesized
ucucuggugacuaguagg

SEQ ID NO: 3319 - RNA, 18 nt, artificial
  Chemically synthesized
uggcugaaacagaauggg

SEQ ID NO: 3320 - RNA, 18 nt, artificial
  Chemically synthesized
uuggcgacuggcugaaac

SEQ ID NO: 3321 - RNA, 18 nt, artificial
  Chemically synthesized
ugaucucgccguugaggg

SEQ ID NO: 3322 - RNA, 18 nt, artificial
  Chemically synthesized
aaaaugagguggaagccc

SEQ ID NO: 3323 - RNA, 18 nt, artificial
  Chemically synthesized
aucugagaagcaccaaac

SEQ ID NO: 3324 - RNA, 18 nt, artificial
  Chemically synthesized
agcuccaacugaaggucc

SEQ ID NO: 3325 - RNA, 18 nt, artificial
  Chemically synthesized
cuuucaugauucuuggcg

SEQ ID NO: 3326 - RNA, 18 nt, artificial
  Chemically synthesized
auaacaaaaaaacagccc

SEQ ID NO: 3327 - RNA, 18 nt, artificial
  Chemically synthesized
uguagucgaugacgugcu

SEQ ID NO: 3328 - RNA, 18 nt, artificial
  Chemically synthesized
ucggucuuguucucccuc

SEQ ID NO: 3329 - RNA, 18 nt, artificial
  Chemically synthesized
ugagaagcaccaaacgug

SEQ ID NO: 3330 - RNA, 18 nt, artificial
  Chemically synthesized
cgacuuucaugauucuug

SEQ ID NO: 3331 - RNA, 18 nt, artificial
  Chemically synthesized
agugccucagccucagcc

SEQ ID NO: 3332 - RNA, 18 nt, artificial
  Chemically synthesized
acgugcuggagaaucucc

SEQ ID NO: 3333 - RNA, 18 nt, artificial
  Chemically synthesized
agaaucuccaccuugcuc

SEQ ID NO: 3334 - RNA, 18 nt, artificial
  Chemically synthesized
acuggcugaaacagaaug

SEQ ID NO: 3335 - RNA, 18 nt, artificial
  Chemically synthesized
gacuuucaugauucuugg

SEQ ID NO: 3336 - RNA, 18 nt, artificial
  Chemically synthesized
caauacaaagcaauuucc

SEQ ID NO: 3337 - RNA, 18 nt, artificial
  Chemically synthesized
gaacaguuaagaacgugg

SEQ ID NO: 3338 - RNA, 18 nt, artificial
  Chemically synthesized
aaaaaugagguggaagcc

SEQ ID NO: 3339 - RNA, 18 nt, artificial
  Chemically synthesized
aagaugcgaucguccgca

SEQ ID NO: 3340 - RNA, 18 nt, artificial
  Chemically synthesized
uaaagucucuggugacua

SEQ ID NO: 3341 - RNA, 18 nt, artificial
  Chemically synthesized
ugauucuuggcgacuggc

SEQ ID NO: 3342 - RNA, 18 nt, artificial
  Chemically synthesized
aagucucuggugacuagu

SEQ ID NO: 3343 - RNA, 18 nt, artificial
  Chemically synthesized
ucuccucgccagugccuc

SEQ ID NO: 3344 - RNA, 18 nt, artificial
  Chemically synthesized
gauuccgaguucagcucc

SEQ ID NO: 3345 - RNA, 18 nt, artificial
  Chemically synthesized
gaagcaccaaacgugacc

SEQ ID NO: 3346 - RNA, 18 nt, artificial
  Chemically synthesized
uuccaacuucggauuccg

SEQ ID NO: 3347 - RNA, 18 nt, artificial
  Chemically synthesized
ucagggcgcugaucucgc

SEQ ID NO: 3348 - RNA, 18 nt, artificial
  Chemically synthesized
uuucaugauucuuggcga

SEQ ID NO: 3349 - RNA, 18 nt, artificial
  Chemically synthesized
ugacuaguaggugugcag

SEQ ID NO: 3350 - RNA, 18 nt, artificial
  Chemically synthesized
ucuugccggccuucagcg

SEQ ID NO: 3351 - RNA, 18 nt, artificial
  Chemically synthesized
aucuccaccuugcucacc

SEQ ID NO: 3352 - RNA, 18 nt, artificial
  Chemically synthesized
aaagcgaaaaaaaugagg

SEQ ID NO: 3353 - RNA, 18 nt, artificial
  Chemically synthesized
uucaugucguagagcagc

SEQ ID NO: 3354 - RNA, 18 nt, artificial
  Chemically synthesized
ugucguagagcagcacgu

SEQ ID NO: 3355 - RNA, 18 nt, artificial
  Chemically synthesized
uucagcuccaacugaagg

SEQ ID NO: 3356 - RNA, 18 nt, artificial
  Chemically synthesized
auacaaagcaauuuccuc

SEQ ID NO: 3357 - RNA, 18 nt, artificial
  Chemically synthesized
ugugcagagaggagcgcc

SEQ ID NO: 3358 - RNA, 18 nt, artificial
  Chemically synthesized
augucguagagcagcacg

SEQ ID NO: 3359 - RNA, 18 nt, artificial
  Chemically synthesized
gcuccaacugaagguccc

SEQ ID NO: 3360 - RNA, 18 nt, artificial
  Chemically synthesized
gugccucagccucagccc

SEQ ID NO: 3361 - RNA, 18 nt, artificial
  Chemically synthesized
cuggcugaaacagaaugg

SEQ ID NO: 3362 - RNA, 18 nt, artificial
  Chemically synthesized
agagcacguaauuccucu

SEQ ID NO: 3363 - RNA, 18 nt, artificial
  Chemically synthesized
acaagaugcgaucguccg

SEQ ID NO: 3364 - RNA, 18 nt, artificial
  Chemically synthesized
gcaccagcuccuugaggc

SEQ ID NO: 3365 - RNA, 18 nt, artificial
  Chemically synthesized
aaucuccaccuugcucac

SEQ ID NO: 3366 - RNA, 18 nt, artificial
  Chemically synthesized
ucuuguucucccucagau

SEQ ID NO: 3367 - RNA, 18 nt, artificial
  Chemically synthesized
agauacggaaaauggaac

SEQ ID NO: 3368 - RNA, 18 nt, artificial
  Chemically synthesized
uacaaagcaauuuccuca

SEQ ID NO: 3369 - RNA, 18 nt, artificial
  Chemically synthesized
ccgaucggucuuguucuc

SEQ ID NO: 3370 - RNA, 18 nt, artificial
  Chemically synthesized
acugaaggucccugaugu

SEQ ID NO: 3371 - RNA, 18 nt, artificial
  Chemically synthesized
uggcgacuuucaugauuc

SEQ ID NO: 3372 - RNA, 18 nt, artificial
  Chemically synthesized
gucucuggugacuaguag

SEQ ID NO: 3373 - RNA, 18 nt, artificial
  Chemically synthesized
cacaagaugcgaucgucc

SEQ ID NO: 3374 - RNA, 18 nt, artificial
  Chemically synthesized
cuggaugcaguuaagggc

SEQ ID NO: 3375 - RNA, 18 nt, artificial
  Chemically synthesized
uuuccucagaaaucugag

SEQ ID NO: 3376 - RNA, 18 nt, artificial
  Chemically synthesized
ugagguggaagcccgaag

SEQ ID NO: 3377 - RNA, 18 nt, artificial
  Chemically synthesized
ggucuuguucucccucag

SEQ ID NO: 3378 - RNA, 18 nt, artificial
  Chemically synthesized
aguuaagggcgcaguggc

SEQ ID NO: 3379 - RNA, 18 nt, artificial
  Chemically synthesized
ucuggugacuaguaggug

SEQ ID NO: 3380 - RNA, 18 nt, artificial
  Chemically synthesized
aagcgaaaaaaaugaggu

SEQ ID NO: 3381 - RNA, 18 nt, artificial
  Chemically synthesized
ugucuugccggccuucag

SEQ ID NO: 3382 - RNA, 18 nt, artificial
  Chemically synthesized
auguagucgaugacgugc

SEQ ID NO: 3383 - RNA, 18 nt, artificial
  Chemically synthesized
gccgaucggucuuguucu

SEQ ID NO: 3384 - RNA, 18 nt, artificial
  Chemically synthesized
ucagauccggcgaggcgc

SEQ ID NO: 3385 - RNA, 18 nt, artificial
  Chemically synthesized
uagagcagcacguuuacc

SEQ ID NO: 3386 - RNA, 18 nt, artificial
  Chemically synthesized
uucagcgacacaagaugc

SEQ ID NO: 3387 - RNA, 18 nt, artificial
  Chemically synthesized
acguaauuccucuugccc

SEQ ID NO: 3388 - RNA, 18 nt, artificial
  Chemically synthesized
gacagacagcgcaccacc

SEQ ID NO: 3389 - RNA, 18 nt, artificial
  Chemically synthesized
acgaguggaaucccaccc

SEQ ID NO: 3390 - RNA, 18 nt, artificial
  Chemically synthesized
uccaacugaaggucccug

SEQ ID NO: 3391 - RNA, 18 nt, artificial
  Chemically synthesized
aaaaaaaugagguggaag

SEQ ID NO: 3392 - RNA, 18 nt, artificial
  Chemically synthesized
cgaguucagcuccaacug

SEQ ID NO: 3393 - RNA, 18 nt, artificial
  Chemically synthesized
uggaugcaguuaagggcg

SEQ ID NO: 3394 - RNA, 18 nt, artificial
  Chemically synthesized
aagcagauacggaaaaug

SEQ ID NO: 3395 - RNA, 18 nt, artificial
  Chemically synthesized
ugauguagucgaugacgu

SEQ ID NO: 3396 - RNA, 18 nt, artificial
  Chemically synthesized
uggagaaucuccaccuug

SEQ ID NO: 3397 - RNA, 18 nt, artificial
  Chemically synthesized
ucagacagacagcgcacc

SEQ ID NO: 3398 - RNA, 18 nt, artificial
  Chemically synthesized
uugcucaccuugcgguuc

SEQ ID NO: 3399 - RNA, 18 nt, artificial
  Chemically synthesized
ucugcucagacagacagc

SEQ ID NO: 3400 - RNA, 18 nt, artificial
  Chemically synthesized
cucagaaaucugagaagc

SEQ ID NO: 3401 - RNA, 18 nt, artificial
  Chemically synthesized
agcagauacggaaaaugg

SEQ ID NO: 3402 - RNA, 18 nt, artificial
  Chemically synthesized
uagucgaugacgugcugg

SEQ ID NO: 3403 - RNA, 18 nt, artificial
  Chemically synthesized
agaggagcgcccucuccu

SEQ ID NO: 3404 - RNA, 18 nt, artificial
  Chemically synthesized
acgcaugccgccucggcc

SEQ ID NO: 3405 - RNA, 18 nt, artificial
  Chemically synthesized
uugccggccuucagcgcg

SEQ ID NO: 3406 - RNA, 18 nt, artificial
  Chemically synthesized
augacgugcuggagaauc

SEQ ID NO: 3407 - RNA, 18 nt, artificial
  Chemically synthesized
cucaccuugcgguucugg

SEQ ID NO: 3408 - RNA, 18 nt, artificial
  Chemically synthesized
aauagaaacacacgagug

SEQ ID NO: 3409 - RNA, 18 nt, artificial
  Chemically synthesized
gaagcccgaagcagauac

SEQ ID NO: 3410 - RNA, 18 nt, artificial
  Chemically synthesized
agaugcgaucguccgcag

SEQ ID NO: 3411 - RNA, 18 nt, artificial
  Chemically synthesized
accuugcucaccuugcgg

SEQ ID NO: 3412 - RNA, 18 nt, artificial
  Chemically synthesized
cguucaugucguagagca

SEQ ID NO: 3413 - RNA, 18 nt, artificial
  Chemically synthesized
aaaauagaaacacacgag

SEQ ID NO: 3414 - RNA, 18 nt, artificial
  Chemically synthesized
uucggauuccgaguucag

SEQ ID NO: 3415 - RNA, 18 nt, artificial
  Chemically synthesized
uuuaccugcugcucgucc

SEQ ID NO: 3416 - RNA, 18 nt, artificial
  Chemically synthesized
acuuucaugauucuuggc

SEQ ID NO: 3417 - RNA, 18 nt, artificial
  Chemically synthesized
ggauuccgaguucagcuc

SEQ ID NO: 3418 - RNA, 18 nt, artificial
  Chemically synthesized
cgugcuggagaaucucca

SEQ ID NO: 3419 - RNA, 18 nt, artificial
  Chemically synthesized
agacagacagcgcaccac

SEQ ID NO: 3420 - RNA, 18 nt, artificial
  Chemically synthesized
aacugaaggucccugaug

SEQ ID NO: 3421 - RNA, 18 nt, artificial
  Chemically synthesized
aauuuccucagaaaucug

SEQ ID NO: 3422 - RNA, 18 nt, artificial
  Chemically synthesized
uggugacuaguaggugug

SEQ ID NO: 3423 - RNA, 18 nt, artificial
  Chemically synthesized
guucagcuccaacugaag

SEQ ID NO: 3424 - RNA, 18 nt, artificial
  Chemically synthesized
cugccacuggcgacuuuc

SEQ ID NO: 3425 - RNA, 18 nt, artificial
  Chemically synthesized
aaacagaaugggcaaagc

SEQ ID NO: 3426 - RNA, 18 nt, artificial
  Chemically synthesized
caacuucggauuccgagu

SEQ ID NO: 3427 - RNA, 18 nt, artificial
  Chemically synthesized
gaucguccgcaggaacgc

SEQ ID NO: 3428 - RNA, 18 nt, artificial
  Chemically synthesized
acacaagaugcgaucguc

SEQ ID NO: 3429 - RNA, 18 nt, artificial
  Chemically synthesized
cucgcugucuugccggcc

SEQ ID NO: 3430 - RNA, 18 nt, artificial
  Chemically synthesized
accgcucgcugucuugcc

SEQ ID NO: 3431 - RNA, 18 nt, artificial
  Chemically synthesized
guucaugucguagagcag

SEQ ID NO: 3432 - RNA, 18 nt, artificial
  Chemically synthesized
ugaaggucccugauguag

SEQ ID NO: 3433 - RNA, 18 nt, artificial
  Chemically synthesized
ucguccgcaggaacgcau

SEQ ID NO: 3434 - RNA, 18 nt, artificial
  Chemically synthesized
ugcucagacagacagcgc

SEQ ID NO: 3435 - RNA, 18 nt, artificial
  Chemically synthesized
auccggcgaggcgcguug

SEQ ID NO: 3436 - RNA, 18 nt, artificial
  Chemically synthesized
cucugcucagacagacag

SEQ ID NO: 3437 - RNA, 18 nt, artificial
  Chemically synthesized
cgccgaucggucuuguuc

SEQ ID NO: 3438 - RNA, 18 nt, artificial
  Chemically synthesized
agggugggcaccagcucc

SEQ ID NO: 3439 - RNA, 18 nt, artificial
  Chemically synthesized
uaguaggugugcagagag

SEQ ID NO: 3440 - RNA, 18 nt, artificial
  Chemically synthesized
gagaggagcgcccucucc

SEQ ID NO: 3441 - RNA, 18 nt, artificial
  Chemically synthesized
acuucggauuccgaguuc

SEQ ID NO: 3442 - RNA, 18 nt, artificial
  Chemically synthesized
agagaggagcgcccucuc

SEQ ID NO: 3443 - RNA, 18 nt, artificial
  Chemically synthesized
auuccgaguucagcucca

SEQ ID NO: 3444 - RNA, 18 nt, artificial
  Chemically synthesized
auagaaacacacgagugg

SEQ ID NO: 3445 - RNA, 18 nt, artificial
  Chemically synthesized
cacguaauuccucuugcc

SEQ ID NO: 3446 - RNA, 18 nt, artificial
  Chemically synthesized
aagcaccaaacgugacca

SEQ ID NO: 3447 - RNA, 18 nt, artificial
  Chemically synthesized
agcgcaccaccucgcccg

SEQ ID NO: 3448 - RNA, 18 nt, artificial
  Chemically synthesized
aacagaaugggcaaagcg

SEQ ID NO: 3449 - RNA, 18 nt, artificial
  Chemically synthesized
uauuuucagucggugauc

SEQ ID NO: 3450 - RNA, 18 nt, artificial
  Chemically synthesized
agggugcugagcggagcc

SEQ ID NO: 3451 - RNA, 18 nt, artificial
  Chemically synthesized
ugacgugcuggagaaucu

SEQ ID NO: 3452 - RNA, 18 nt, artificial
  Chemically synthesized
caagaugcgaucguccgc

SEQ ID NO: 3453 - RNA, 18 nt, artificial
  Chemically synthesized
guuccaacuucggauucc

SEQ ID NO: 3454 - RNA, 18 nt, artificial
  Chemically synthesized
aaggucccugauguaguc

SEQ ID NO: 3455 - RNA, 18 nt, artificial
  Chemically synthesized
agcagggcaggcaggcgc

SEQ ID NO: 3456 - RNA, 18 nt, artificial
  Chemically synthesized
cuucagcgacacaagaug

SEQ ID NO: 3457 - RNA, 18 nt, artificial
  Chemically synthesized
aagcccgaagcagauacg

SEQ ID NO: 3458 - RNA, 18 nt, artificial
  Chemically synthesized
caccuugcucaccuugcg

SEQ ID NO: 3459 - RNA, 18 nt, artificial
  Chemically synthesized
aucucgccguugagggug

SEQ ID NO: 3460 - RNA, 18 nt, artificial
  Chemically synthesized
agacagcgcaccaccucg

SEQ ID NO: 3461 - RNA, 18 nt, artificial
  Chemically synthesized
ucccugauguagucgaug

SEQ ID NO: 3462 - RNA, 18 nt, artificial
  Chemically synthesized
uacggaaaauggaacagu

SEQ ID NO: 3463 - RNA, 18 nt, artificial
  Chemically synthesized
uggcggugcugccacugg

SEQ ID NO: 3464 - RNA, 18 nt, artificial
  Chemically synthesized
agauggccacgcucugcu

SEQ ID NO: 3465 - RNA, 18 nt, artificial
  Chemically synthesized
gagaaucuccaccuugcu

SEQ ID NO: 3466 - RNA, 18 nt, artificial
  Chemically synthesized
gcuggaugcaguuaaggg

SEQ ID NO: 3467 - RNA, 18 nt, artificial
  Chemically synthesized
aguucagcuccaacugaa

SEQ ID NO: 3468 - RNA, 18 nt, artificial
  Chemically synthesized
caguuaagaacguggaau

SEQ ID NO: 3469 - RNA, 18 nt, artificial
  Chemically synthesized
ccucuccucgccagugcc

SEQ ID NO: 3470 - RNA, 18 nt, artificial
  Chemically synthesized
ucucgccguugagggugc

SEQ ID NO: 3471 - RNA, 18 nt, artificial
  Chemically synthesized
cugagcggagcccggacc

SEQ ID NO: 3472 - RNA, 18 nt, artificial
  Chemically synthesized
gcgacuggcugaaacaga

SEQ ID NO: 3473 - RNA, 18 nt, artificial
  Chemically synthesized
aacaauauuuucagucgg

SEQ ID NO: 3474 - RNA, 18 nt, artificial
  Chemically synthesized
gaaaauggaacaguuaag

SEQ ID NO: 3475 - RNA, 18 nt, artificial
  Chemically synthesized
caguuaagggcgcagugg

SEQ ID NO: 3476 - RNA, 18 nt, artificial
  Chemically synthesized
uucuuggcgacuggcuga

SEQ ID NO: 3477 - RNA, 18 nt, artificial
  Chemically synthesized
ucugagaagcaccaaacg

SEQ ID NO: 3478 - RNA, 18 nt, artificial
  Chemically synthesized
gcgaaaaaaaugaggugg

SEQ ID NO: 3479 - RNA, 18 nt, artificial
  Chemically synthesized
cguugagggugcugagcg

SEQ ID NO: 3480 - RNA, 18 nt, artificial
  Chemically synthesized
gugcuggagaaucuccac

SEQ ID NO: 3481 - RNA, 18 nt, artificial
  Chemically synthesized
ccuucagcgcgcagcugg

SEQ ID NO: 3482 - RNA, 18 nt, artificial
  Chemically synthesized
gugcugccacuggcgacu

SEQ ID NO: 3483 - RNA, 18 nt, artificial
  Chemically synthesized
gucagggcgcugaucucg

SEQ ID NO: 3484 - RNA, 18 nt, artificial
  Chemically synthesized
caauuuccucagaaaucu

SEQ ID NO: 3485 - RNA, 18 nt, artificial
  Chemically synthesized
ccacuggcgacuuucaug

SEQ ID NO: 3486 - RNA, 18 nt, artificial
  Chemically synthesized
augcaguuaagggcgcag

SEQ ID NO: 3487 - RNA, 18 nt, artificial
  Chemically synthesized
agaagcaccaaacgugac

SEQ ID NO: 3488 - RNA, 18 nt, artificial
  Chemically synthesized
acuaguaggugugcagag

SEQ ID NO: 3489 - RNA, 18 nt, artificial
  Chemically synthesized
cucgccagugccucagcc

SEQ ID NO: 3490 - RNA, 18 nt, artificial
  Chemically synthesized
auauuuucagucggugau

SEQ ID NO: 3491 - RNA, 18 nt, artificial
  Chemically synthesized
gcaggaacgcaugccgcc

SEQ ID NO: 3492 - RNA, 18 nt, artificial
  Chemically synthesized
aaucugagaagcaccaaa

SEQ ID NO: 3493 - RNA, 18 nt, artificial
  Chemically synthesized
agggcgcugaucucgccg

SEQ ID NO: 3494 - RNA, 18 nt, artificial
  Chemically synthesized
auacggaaaauggaacag

SEQ ID NO: 3495 - RNA, 18 nt, artificial
  Chemically synthesized
ucccucagauccggcgag

SEQ ID NO: 3496 - RNA, 18 nt, artificial
  Chemically synthesized
acguuuaccugcugcucg

SEQ ID NO: 3497 - RNA, 18 nt, artificial
  Chemically synthesized
cacuggcgacuuucauga

SEQ ID NO: 3498 - RNA, 18 nt, artificial
  Chemically synthesized
cuccaacugaaggucccu

SEQ ID NO: 3499 - RNA, 18 nt, artificial
  Chemically synthesized
caaagcgaaaaaaaugag

SEQ ID NO: 3500 - RNA, 18 nt, artificial
  Chemically synthesized
aaauagaaacacacgagu

SEQ ID NO: 3501 - RNA, 18 nt, artificial
  Chemically synthesized
cgcucgcugucuugccgg

SEQ ID NO: 3502 - RNA, 18 nt, artificial
  Chemically synthesized
agucucuggugacuagua

SEQ ID NO: 3503 - RNA, 18 nt, artificial
  Chemically synthesized
agcccgaagcagauacgg

SEQ ID NO: 3504 - RNA, 18 nt, artificial
  Chemically synthesized
gcggugcugccacuggcg

SEQ ID NO: 3505 - RNA, 18 nt, artificial
  Chemically synthesized
cucagacagacagcgcac

SEQ ID NO: 3506 - RNA, 18 nt, artificial
  Chemically synthesized
uaggugugcagagaggag

SEQ ID NO: 3507 - RNA, 18 nt, artificial
  Chemically synthesized
cucagauccggcgaggcg

SEQ ID NO: 3508 - RNA, 18 nt, artificial
  Chemically synthesized
uaacagccguucaugucg

SEQ ID NO: 3509 - RNA, 18 nt, artificial
  Chemically synthesized
gaugcgaucguccgcagg

SEQ ID NO: 3510 - RNA, 18 nt, artificial
  Chemically synthesized
aucguccgcaggaacgca

SEQ ID NO: 3511 - RNA, 18 nt, artificial
  Chemically synthesized
gcugaaacagaaugggca

SEQ ID NO: 3512 - RNA, 18 nt, artificial
  Chemically synthesized
cugauguagucgaugacg

SEQ ID NO: 3513 - RNA, 18 nt, artificial
  Chemically synthesized
cagagaggagcgcccucu

SEQ ID NO: 3514 - RNA, 18 nt, artificial
  Chemically synthesized
cuccuugaggcgugagua

SEQ ID NO: 3515 - RNA, 18 nt, artificial
  Chemically synthesized
ugcaguuaagggcgcagu

SEQ ID NO: 3516 - RNA, 18 nt, artificial
  Chemically synthesized
ucgccagugccucagccu

SEQ ID NO: 3517 - RNA, 18 nt, artificial
  Chemically synthesized
ccguucaugucguagagc

SEQ ID NO: 3518 - RNA, 18 nt, artificial
  Chemically synthesized
gcgacacaagaugcgauc

SEQ ID NO: 3519 - RNA, 18 nt, artificial
  Chemically synthesized
cacgcucugcucagacag

SEQ ID NO: 3520 - RNA, 18 nt, artificial
  Chemically synthesized
acagcgcaccaccucgcc

SEQ ID NO: 3521 - RNA, 18 nt, artificial
  Chemically synthesized
guuaagggcgcaguggcc

SEQ ID NO: 3522 - RNA, 18 nt, artificial
  Chemically synthesized
acagagcacguaauuccu

SEQ ID NO: 3523 - RNA, 18 nt, artificial
  Chemically synthesized
ccgcucgcugucuugccg

SEQ ID NO: 3524 - RNA, 18 nt, artificial
  Chemically synthesized
ccuaaagucucuggugac

SEQ ID NO: 3525 - RNA, 18 nt, artificial
  Chemically synthesized
cgacuggcugaaacagaa

SEQ ID NO: 3526 - RNA, 18 nt, artificial
  Chemically synthesized
augcgaucguccgcagga

SEQ ID NO: 3527 - RNA, 18 nt, artificial
  Chemically synthesized
cggccuucagcgcgcagc

SEQ ID NO: 3528 - RNA, 18 nt, artificial
  Chemically synthesized
uccaccuugcucaccuug

SEQ ID NO: 3529 - RNA, 18 nt, artificial
  Chemically synthesized
cuucggauuccgaguuca

SEQ ID NO: 3530 - RNA, 18 nt, artificial
  Chemically synthesized
agccguucaugucguaga

SEQ ID NO: 3531 - RNA, 18 nt, artificial
  Chemically synthesized
cgcaggaacgcaugccgc

SEQ ID NO: 3532 - RNA, 18 nt, artificial
  Chemically synthesized
agcgaaaaaaaugaggug

SEQ ID NO: 3533 - RNA, 18 nt, artificial
  Chemically synthesized
uugaggcgugaguaacag

SEQ ID NO: 3534 - RNA, 18 nt, artificial
  Chemically synthesized
cgaucguccgcaggaacg

SEQ ID NO: 3535 - RNA, 18 nt, artificial
  Chemically synthesized
cugaucucgccguugagg

SEQ ID NO: 3536 - RNA, 18 nt, artificial
  Chemically synthesized
aauauuuucagucgguga

SEQ ID NO: 3537 - RNA, 18 nt, artificial
  Chemically synthesized
guccgcaggaacgcaugc

SEQ ID NO: 3538 - RNA, 18 nt, artificial
  Chemically synthesized
gcgcuucagcgacacaag

SEQ ID NO: 3539 - RNA, 18 nt, artificial
  Chemically synthesized
caauauuuucagucggug

SEQ ID NO: 3540 - RNA, 18 nt, artificial
  Chemically synthesized
ccgucagggcgcugaucu

SEQ ID NO: 3541 - RNA, 18 nt, artificial
  Chemically synthesized
cagcgcaccaccucgccc

SEQ ID NO: 3542 - RNA, 18 nt, artificial
  Chemically synthesized
aacaguuaagaacgugga

SEQ ID NO: 3543 - RNA, 18 nt, artificial
  Chemically synthesized
gaaaucugagaagcacca

SEQ ID NO: 3544 - RNA, 18 nt, artificial
  Chemically synthesized
aacuucggauuccgaguu

SEQ ID NO: 3545 - RNA, 18 nt, artificial
  Chemically synthesized
ggugcugagcggagcccg

SEQ ID NO: 3546 - RNA, 18 nt, artificial
  Chemically synthesized
ucgcugucuugccggccu

SEQ ID NO: 3547 - RNA, 18 nt, artificial
  Chemically synthesized
aacacacgaguggaaucc

SEQ ID NO: 3548 - RNA, 18 nt, artificial
  Chemically synthesized
gacagcgcaccaccucgc

SEQ ID NO: 3549 - RNA, 18 nt, artificial
  Chemically synthesized
caaacgugaccauuuuuu

SEQ ID NO: 3550 - RNA, 18 nt, artificial
  Chemically synthesized
aggucccugauguagucg

SEQ ID NO: 3551 - RNA, 18 nt, artificial
  Chemically synthesized
aggaacgcaugccgccuc

SEQ ID NO: 3552 - RNA, 18 nt, artificial
  Chemically synthesized
ucguagagcagcacguuu

SEQ ID NO: 3553 - RNA, 18 nt, artificial
  Chemically synthesized
guggcggugcugccacug

SEQ ID NO: 3554 - RNA, 18 nt, artificial
  Chemically synthesized
acacgaguggaaucccac

SEQ ID NO: 3555 - RNA, 18 nt, artificial
  Chemically synthesized
gaguucagcuccaacuga

SEQ ID NO: 3556 - RNA, 18 nt, artificial
  Chemically synthesized
auuuccucagaaaucuga

SEQ ID NO: 3557 - RNA, 18 nt, artificial
  Chemically synthesized
ugggcaccagcuccuuga

SEQ ID NO: 3558 - RNA, 18 nt, artificial
  Chemically synthesized
aacgcaugccgccucggc

SEQ ID NO: 3559 - RNA, 18 nt, artificial
  Chemically synthesized
uuaagggcgcaguggccg

SEQ ID NO: 3560 - RNA, 18 nt, artificial
  Chemically synthesized
ggagacccacagagcacg

SEQ ID NO: 3561 - RNA, 18 nt, artificial
  Chemically synthesized
aguggccgccgaucgguc

SEQ ID NO: 3562 - RNA, 18 nt, artificial
  Chemically synthesized
gucuuguucucccucaga

SEQ ID NO: 3563 - RNA, 18 nt, artificial
  Chemically synthesized
ggugcugccacuggcgac

SEQ ID NO: 3564 - RNA, 18 nt, artificial
  Chemically synthesized
gugcugagcggagcccgg

SEQ ID NO: 3565 - RNA, 18 nt, artificial
  Chemically synthesized
ugcagagaggagcgcccu

SEQ ID NO: 3566 - RNA, 18 nt, artificial
  Chemically synthesized
gcacguaauuccucuugc

SEQ ID NO: 3567 - RNA, 18 nt, artificial
  Chemically synthesized
ucagaaaucugagaagca

SEQ ID NO: 3568 - RNA, 18 nt, artificial
  Chemically synthesized
gguggaagcccgaagcag

SEQ ID NO: 3569 - RNA, 18 nt, artificial
  Chemically synthesized
uuuucagucggugaucau

SEQ ID NO: 3570 - RNA, 18 nt, artificial
  Chemically synthesized
aggcgugaguaacagccg

SEQ ID NO: 3571 - RNA, 18 nt, artificial
  Chemically synthesized
ccacagagcacguaauuc

SEQ ID NO: 3572 - RNA, 18 nt, artificial
  Chemically synthesized
cgucagggcgcugaucuc

SEQ ID NO: 3573 - RNA, 18 nt, artificial
  Chemically synthesized
guggaagcccgaagcaga

SEQ ID NO: 3574 - RNA, 18 nt, Artificial Sequence
  Chemically synthesized
gugacuaguaggugugca

SEQ ID NO: 3575 - RNA, 18 nt, artificial
  Chemically synthesized
acgaucgcaucuuguguc

SEQ ID NO: 3576 - RNA, 18 nt, artificial
  Chemically synthesized
acucacgccucaaggagc

SEQ ID NO: 3577 - RNA, 18 nt, artificial
  Chemically synthesized
gcguggccaucucgcgcu

SEQ ID NO: 3578 - RNA, 18 nt, artificial
  Chemically synthesized
cucuacgacaugaacggc

SEQ ID NO: 3579 - RNA, 18 nt, artificial
  Chemically synthesized
cgccucaaggagcuggug

SEQ ID NO: 3580 - RNA, 18 nt, artificial
  Chemically synthesized
aucgcaucuugugucgcu

SEQ ID NO: 3581 - RNA, 18 nt, artificial
  Chemically synthesized
gagcuggugcccacccug

SEQ ID NO: 3582 - RNA, 18 nt, artificial
  Chemically synthesized
cacgccucaaggagcugg

SEQ ID NO: 3583 - RNA, 18 nt, artificial
  Chemically synthesized
ucgacuacaucagggacc

SEQ ID NO: 3584 - RNA, 18 nt, artificial
  Chemically synthesized
cuacgacaugaacggcug

SEQ ID NO: 3585 - RNA, 18 nt, artificial
  Chemically synthesized
caaggagcuggugcccac

SEQ ID NO: 3586 - RNA, 18 nt, artificial
  Chemically synthesized
gcuggugcccacccugcc

SEQ ID NO: 3587 - RNA, 18 nt, artificial
  Chemically synthesized
ggccaucucgcgcugcgc

SEQ ID NO: 3588 - RNA, 18 nt, artificial
  Chemically synthesized
cgaucgcaucuugugucg

SEQ ID NO: 3589 - RNA, 18 nt, artificial
  Chemically synthesized
aucgacuacaucagggac

SEQ ID NO: 3590 - RNA, 18 nt, artificial
  Chemically synthesized
agcuggugcccacccugc

SEQ ID NO: 3591 - RNA, 18 nt, artificial
  Chemically synthesized
cucacgccucaaggagcu

SEQ ID NO: 3592 - RNA, 18 nt, artificial
  Chemically synthesized
ccucaaggagcuggugcc

SEQ ID NO: 3593 - RNA, 18 nt, artificial
  Chemically synthesized
acgccucaaggagcuggu

SEQ ID NO: 3594 - RNA, 18 nt, artificial
  Chemically synthesized
aggagcuggugcccaccc

SEQ ID NO: 3595 - RNA, 18 nt, artificial
  Chemically synthesized
uuacucacgccucaagga

SEQ ID NO: 3596 - RNA, 18 nt, artificial
  Chemically synthesized
guggccaucucgcgcugc

SEQ ID NO: 3597 - RNA, 18 nt, artificial
  Chemically synthesized
agcguggccaucucgcgc

SEQ ID NO: 3598 - RNA, 18 nt, artificial
  Chemically synthesized
gagcguggccaucucgcg

SEQ ID NO: 3599 - RNA, 18 nt, artificial
  Chemically synthesized
cuggugcccacccugccc

SEQ ID NO: 3600 - RNA, 18 nt, artificial
  Chemically synthesized
ucacgccucaaggagcug

SEQ ID NO: 3601 - RNA, 18 nt, artificial
  Chemically synthesized
uggccaucucgcgcugcg

SEQ ID NO: 3602 - RNA, 18 nt, artificial
  Chemically synthesized
aaggagcuggugcccacc

SEQ ID NO: 3603 - RNA, 18 nt, artificial
  Chemically synthesized
cguggccaucucgcgcug

SEQ ID NO: 3604 - RNA, 18 nt, artificial
  Chemically synthesized
gacacaagaugcgaucgu

SEQ ID NO: 3605 - RNA, 18 nt, artificial
  Chemically synthesized
gcuccuugaggcgugagu

SEQ ID NO: 3606 - RNA, 18 nt, artificial
  Chemically synthesized
agcgcgagauggccacgc

SEQ ID NO: 3607 - RNA, 18 nt, artificial
  Chemically synthesized
gccguucaugucguagag

SEQ ID NO: 3608 - RNA, 18 nt, artificial
  Chemically synthesized
caccagcuccuugaggcg

SEQ ID NO: 3609 - RNA, 18 nt, artificial
  Chemically synthesized
agcgacacaagaugcgau

SEQ ID NO: 3610 - RNA, 18 nt, artificial
  Chemically synthesized
cagggugggcaccagcuc

SEQ ID NO: 3611 - RNA, 18 nt, artificial
  Chemically synthesized
ccagcuccuugaggcgug

SEQ ID NO: 3612 - RNA, 18 nt, artificial
  Chemically synthesized
ggucccugauguagucga

SEQ ID NO: 3613 - RNA, 18 nt, artificial
  Chemically synthesized
cagccguucaugucguag

SEQ ID NO: 3614 - RNA, 18 nt, artificial
  Chemically synthesized
gugggcaccagcuccuug

SEQ ID NO: 3615 - RNA, 18 nt, artificial
  Chemically synthesized
ggcagggugggcaccagc

SEQ ID NO: 3616 - RNA, 18 nt, artificial
  Chemically synthesized
gcgcagcgcgagauggcc

SEQ ID NO: 3617 - RNA, 18 nt, artificial
  Chemically synthesized
cgacacaagaugcgaucg

SEQ ID NO: 3618 - RNA, 18 nt, artificial
  Chemically synthesized
gucccugauguagucgau

SEQ ID NO: 3619 - RNA, 18 nt, artificial
  Chemically synthesized
gcagggugggcaccagcu

SEQ ID NO: 3620 - RNA, 18 nt, artificial
  Chemically synthesized
agcuccuugaggcgugag

SEQ ID NO: 3621 - RNA, 18 nt, artificial
  Chemically synthesized
ggcaccagcuccuugagg

SEQ ID NO: 3622 - RNA, 18 nt, artificial
  Chemically synthesized
accagcuccuugaggcgu

SEQ ID NO: 3623 - RNA, 18 nt, artificial
  Chemically synthesized
gggugggcaccagcuccu

SEQ ID NO: 3624 - RNA, 18 nt, artificial
  Chemically synthesized
uccuugaggcgugaguaa

SEQ ID NO: 3625 - RNA, 18 nt, artificial
  Chemically synthesized
gcagcgcgagauggccac

SEQ ID NO: 3626 - RNA, 18 nt, artificial
  Chemically synthesized
gcgcgagauggccacgcu

SEQ ID NO: 3627 - RNA, 18 nt, artificial
  Chemically synthesized
cgcgagauggccacgcuc

SEQ ID NO: 3628 - RNA, 18 nt, artificial
  Chemically synthesized
gggcagggugggcaccag

SEQ ID NO: 3629 - RNA, 18 nt, artificial
  Chemically synthesized
cagcuccuugaggcguga

SEQ ID NO: 3630 - RNA, 18 nt, artificial
  Chemically synthesized
cgcagcgcgagauggcca

SEQ ID NO: 3631 - RNA, 18 nt, artificial
  Chemically synthesized
ggugggcaccagcuccuu

SEQ ID NO: 3632 - RNA, 18 nt, Artificial Sequence
  Chemically synthesized
cagcgcgagauggccacg

SEQ ID NO: 3633 - RNA, 19 nt, artificial
  Chemically synthesized
gucuauuucugcauucaaa

SEQ ID NO: 3634 - RNA, 19 nt, artificial
  Chemically synthesized
ggcagagaugucuauuucu

SEQ ID NO: 3635 - RNA, 19 nt, artificial
  Chemically synthesized
gcccaaucuaagcagacuu

SEQ ID NO: 3636 - RNA, 19 nt, artificial
  Chemically synthesized
ccaguauucagucacuuaa

SEQ ID NO: 3637 - RNA, 19 nt, artificial
  Chemically synthesized
ggaaaacuaagaaugauca

SEQ ID NO: 3638 - RNA, 19 nt, artificial
  Chemically synthesized
ggguguucucuuacuugga

SEQ ID NO: 3639 - RNA, 19 nt, artificial
  Chemically synthesized
guggcagagaugucuauuu

SEQ ID NO: 3640 - RNA, 19 nt, artificial
  Chemically synthesized
cccaaucuaagcagacuuu

SEQ ID NO: 3641 - RNA, 19 nt, artificial
  Chemically synthesized
cgguguucaugauuucuuu

SEQ ID NO: 3642 - RNA, 19 nt, artificial
  Chemically synthesized
guuggaagguuuucuuuau

SEQ ID NO: 3643 - RNA, 19 nt, artificial
  Chemically synthesized
caguauucagucacuuaaa

SEQ ID NO: 3644 - RNA, 19 nt, artificial
  Chemically synthesized
ggcaucucccggagcaaaa

SEQ ID NO: 3645 - RNA, 19 nt, artificial
  Chemically synthesized
gucuuuuggucagaaauua

SEQ ID NO: 3646 - RNA, 19 nt, artificial
  Chemically synthesized
gaaggaaaacuaagaauga

SEQ ID NO: 3647 - RNA, 19 nt, artificial
  Chemically synthesized
ggaccagugcuuugauuuu

SEQ ID NO: 3648 - RNA, 19 nt, artificial
  Chemically synthesized
gaguuaaugucaaaugaca

SEQ ID NO: 3649 - RNA, 19 nt, artificial
  Chemically synthesized
ggaaaaacagccugucgga

SEQ ID NO: 3650 - RNA, 19 nt, artificial
  Chemically synthesized
ccuugugaacucuuuaauu

SEQ ID NO: 3651 - RNA, 19 nt, artificial
  Chemically synthesized
ccuuuuugacacaagccua

SEQ ID NO: 3652 - RNA, 19 nt, artificial
  Chemically synthesized
ccggcgagugcggauaaaa

SEQ ID NO: 3653 - RNA, 19 nt, artificial
  Chemically synthesized
ccuacugaaugcuguguau

SEQ ID NO: 3654 - RNA, 19 nt, artificial
  Chemically synthesized
ugcacaacaacaacaacaa

SEQ ID NO: 3655 - RNA, 19 nt, artificial
  Chemically synthesized
accagaaggauccaguauu

SEQ ID NO: 3656 - RNA, 19 nt, artificial
  Chemically synthesized
ggcucgggcuucauucuga

SEQ ID NO: 3657 - RNA, 19 nt, artificial
  Chemically synthesized
gggcaucucccggagcaaa

SEQ ID NO: 3658 - RNA, 19 nt, artificial
  Chemically synthesized
ggugauugccugcuuuauu

SEQ ID NO: 3659 - RNA, 19 nt, artificial
  Chemically synthesized
acaaauucacggaaucuuu

SEQ ID NO: 3660 - RNA, 19 nt, artificial
  Chemically synthesized
cuuguauaguggcagagau

SEQ ID NO: 3661 - RNA, 19 nt, artificial
  Chemically synthesized
uguuauaacugaacccaaa

SEQ ID NO: 3662 - RNA, 19 nt, artificial
  Chemically synthesized
gacuuugccuuuuuucaaa

SEQ ID NO: 3663 - RNA, 19 nt, artificial
  Chemically synthesized
agaugucuauuucugcauu

SEQ ID NO: 3664 - RNA, 19 nt, artificial
  Chemically synthesized
gccugcuauacaacaugaa

SEQ ID NO: 3665 - RNA, 19 nt, artificial
  Chemically synthesized
caaggaauugcccaaucua

SEQ ID NO: 3666 - RNA, 19 nt, artificial
  Chemically synthesized
agccugcuauacaacauga

SEQ ID NO: 3667 - RNA, 19 nt, artificial
  Chemically synthesized
ggucagaaauuaccuuuuu

SEQ ID NO: 3668 - RNA, 19 nt, artificial
  Chemically synthesized
gcccuuucugcaguuggaa

SEQ ID NO: 3669 - RNA, 19 nt, artificial
  Chemically synthesized
gacugcuacuccaagcuca

SEQ ID NO: 3670 - RNA, 19 nt, artificial
  Chemically synthesized
aaggaauugcccaaucuaa

SEQ ID NO: 3671 - RNA, 19 nt, artificial
  Chemically synthesized
gugauugccugcuuuauuu

SEQ ID NO: 3672 - RNA, 19 nt, artificial
  Chemically synthesized
ccagaaggauccaguauuc

SEQ ID NO: 3673 - RNA, 19 nt, artificial
  Chemically synthesized
agcacgucaucgacuacau

SEQ ID NO: 3674 - RNA, 19 nt, artificial
  Chemically synthesized
gaaucuuuuaagugcugaa

SEQ ID NO: 3675 - RNA, 19 nt, artificial
  Chemically synthesized
ugucuauuucugcauucaa

SEQ ID NO: 3676 - RNA, 19 nt, artificial
  Chemically synthesized
agagaugucuauuucugca

SEQ ID NO: 3677 - RNA, 19 nt, artificial
  Chemically synthesized
gaagucuuuuggucagaaa

SEQ ID NO: 3678 - RNA, 19 nt, artificial
  Chemically synthesized
aguuggaagguuuucuuua

SEQ ID NO: 3679 - RNA, 19 nt, artificial
  Chemically synthesized
gggcuucauucugagccga

SEQ ID NO: 3680 - RNA, 19 nt, artificial
  Chemically synthesized
cggucagcaugaaagccuu

SEQ ID NO: 3681 - RNA, 19 nt, artificial
  Chemically synthesized
accagugcuuugauuuuua

SEQ ID NO: 3682 - RNA, 19 nt, artificial
  Chemically synthesized
cuuugcacaacaacaacaa

SEQ ID NO: 3683 - RNA, 19 nt, artificial
  Chemically synthesized
ggaaggaaaacuaagaaug

SEQ ID NO: 3684 - RNA, 19 nt, artificial
  Chemically synthesized
guuguaaacuuaacccuuu

SEQ ID NO: 3685 - RNA, 19 nt, artificial
  Chemically synthesized
caaagguggagcgugaaua

SEQ ID NO: 3686 - RNA, 19 nt, artificial
  Chemically synthesized
gggacgaagggaagcucca

SEQ ID NO: 3687 - RNA, 19 nt, artificial
  Chemically synthesized
acugaaugcuguguauaua

SEQ ID NO: 3688 - RNA, 19 nt, artificial
  Chemically synthesized
gcgugaauaccagaaggau

SEQ ID NO: 3689 - RNA, 19 nt, artificial
  Chemically synthesized
cauuucacaaggaggacaa

SEQ ID NO: 3690 - RNA, 19 nt, artificial
  Chemically synthesized
cugaaugcuguguauauau

SEQ ID NO: 3691 - RNA, 19 nt, artificial
  Chemically synthesized
gaccagugcuuugauuuuu

SEQ ID NO: 3692 - RNA, 19 nt, artificial
  Chemically synthesized
gguguucaugauuucuuuu

SEQ ID NO: 3693 - RNA, 19 nt, artificial
  Chemically synthesized
auucuuugcacaacaacaa

SEQ ID NO: 3694 - RNA, 19 nt, artificial
  Chemically synthesized
gcaguuggaagguuuucuu

SEQ ID NO: 3695 - RNA, 19 nt, artificial
  Chemically synthesized
ccaggguguucucuuacuu

SEQ ID NO: 3696 - RNA, 19 nt, artificial
  Chemically synthesized
uucugcaguuggaagguuu

SEQ ID NO: 3697 - RNA, 19 nt, artificial
  Chemically synthesized
gaaggauccaguauucagu

SEQ ID NO: 3698 - RNA, 19 nt, artificial
  Chemically synthesized
cacaacaacaacaacaaca

SEQ ID NO: 3699 - RNA, 19 nt, artificial
  Chemically synthesized
gauccaguauucagucacu

SEQ ID NO: 3700 - RNA, 19 nt, artificial
  Chemically synthesized
uauucuuugcacaacaaca

SEQ ID NO: 3701 - RNA, 19 nt, artificial
  Chemically synthesized
gcuuuauuucagaggacca

SEQ ID NO: 3702 - RNA, 19 nt, artificial
  Chemically synthesized
cccggcgagugcggauaaa

SEQ ID NO: 3703 - RNA, 19 nt, artificial
  Chemically synthesized
ugcccuuucugcaguugga

SEQ ID NO: 3704 - RNA, 19 nt, artificial
  Chemically synthesized
agacuuugccuuuuuucaa

SEQ ID NO: 3705 - RNA, 19 nt, artificial
  Chemically synthesized
gagaugucuauuucugcau

SEQ ID NO: 3706 - RNA, 19 nt, artificial
  Chemically synthesized
cuauugucagccugcauca

SEQ ID NO: 3707 - RNA, 19 nt, artificial
  Chemically synthesized
guguuuauugaauggugau

SEQ ID NO: 3708 - RNA, 19 nt, artificial
  Chemically synthesized
ccugcuuuauuucagagga

SEQ ID NO: 3709 - RNA, 19 nt, artificial
  Chemically synthesized
aggugagcaagauggaaau

SEQ ID NO: 3710 - RNA, 19 nt, artificial
  Chemically synthesized
uguguuuauugaaugguga

SEQ ID NO: 3711 - RNA, 19 nt, artificial
  Chemically synthesized
ccagugcuuugauuuuuau

SEQ ID NO: 3712 - RNA, 19 nt, artificial
  Chemically synthesized
gccuuuuuucaaaggugga

SEQ ID NO: 3713 - RNA, 19 nt, artificial
  Chemically synthesized
uccaguauucagucacuua

SEQ ID NO: 3714 - RNA, 19 nt, artificial
  Chemically synthesized
gugcugaacuuauuuuuca

SEQ ID NO: 3715 - RNA, 19 nt, artificial
  Chemically synthesized
ucugcauucaaaaguguaa

SEQ ID NO: 3716 - RNA, 19 nt, artificial
  Chemically synthesized
augucuauuucugcauuca

SEQ ID NO: 3717 - RNA, 19 nt, artificial
  Chemically synthesized
agaaggugagcaagaugga

SEQ ID NO: 3718 - RNA, 19 nt, artificial
  Chemically synthesized
ucuauuugagugaaaccuu

SEQ ID NO: 3719 - RNA, 19 nt, artificial
  Chemically synthesized
caguuggaagguuuucuuu

SEQ ID NO: 3720 - RNA, 19 nt, artificial
  Chemically synthesized
acuacaucuuggaccugca

SEQ ID NO: 3721 - RNA, 19 nt, artificial
  Chemically synthesized
guccuugcaggcuucugaa

SEQ ID NO: 3722 - RNA, 19 nt, artificial
  Chemically synthesized
ggacugugauauucguuau

SEQ ID NO: 3723 - RNA, 19 nt, artificial
  Chemically synthesized
acccgaugagccugcuaua

SEQ ID NO: 3724 - RNA, 19 nt, artificial
  Chemically synthesized
gaaaccuugugaacucuuu

SEQ ID NO: 3725 - RNA, 19 nt, artificial
  Chemically synthesized
gucacuuaaaugaagucuu

SEQ ID NO: 3726 - RNA, 19 nt, artificial
  Chemically synthesized
agucuuuuggucagaaauu

SEQ ID NO: 3727 - RNA, 19 nt, artificial
  Chemically synthesized
ugcuauacaacaugaacga

SEQ ID NO: 3728 - RNA, 19 nt, artificial
  Chemically synthesized
cagacuuugccuuuuuuca

SEQ ID NO: 3729 - RNA, 19 nt, artificial
  Chemically synthesized
cacaaggaggacaaguuga

SEQ ID NO: 3730 - RNA, 19 nt, artificial
  Chemically synthesized
acgucaucgacuacaucuu

SEQ ID NO: 3731 - RNA, 19 nt, artificial
  Chemically synthesized
cuuuuaagugcugaacuua

SEQ ID NO: 3732 - RNA, 19 nt, artificial
  Chemically synthesized
cugaauucccuucugaguu

SEQ ID NO: 3733 - RNA, 19 nt, artificial
  Chemically synthesized
cugcauucaaaaguguaau

SEQ ID NO: 3734 - RNA, 19 nt, artificial
  Chemically synthesized
ccacuauugucagccugca

SEQ ID NO: 3735 - RNA, 19 nt, artificial
  Chemically synthesized
acaacaugaacgacugcua

SEQ ID NO: 3736 - RNA, 19 nt, artificial
  Chemically synthesized
gccuacugaaugcugugua

SEQ ID NO: 3737 - RNA, 19 nt, artificial
  Chemically synthesized
aaccuugugaacucuuuaa

SEQ ID NO: 3738 - RNA, 19 nt, artificial
  Chemically synthesized
cccagaacaagaaggugag

SEQ ID NO: 3739 - RNA, 19 nt, artificial
  Chemically synthesized
ccuugcaggcuucugaauu

SEQ ID NO: 3740 - RNA, 19 nt, artificial
  Chemically synthesized
caacaacaaauucacggaa

SEQ ID NO: 3741 - RNA, 19 nt, artificial
  Chemically synthesized
cguuaaaaucacaaggaau

SEQ ID NO: 3742 - RNA, 19 nt, artificial
  Chemically synthesized
aggaccagugcuuugauuu

SEQ ID NO: 3743 - RNA, 19 nt, artificial
  Chemically synthesized
cuauuugagugaaaccuug

SEQ ID NO: 3744 - RNA, 19 nt, artificial
  Chemically synthesized
cccaggguguucucuuacu

SEQ ID NO: 3745 - RNA, 19 nt, artificial
  Chemically synthesized
agaguuuucuuguauagug

SEQ ID NO: 3746 - RNA, 19 nt, artificial
  Chemically synthesized
gcagagaugucuauuucug

SEQ ID NO: 3747 - RNA, 19 nt, artificial
  Chemically synthesized
ccauuucacaaggaggaca

SEQ ID NO: 3748 - RNA, 19 nt, artificial
  Chemically synthesized
uacugaaugcuguguauau

SEQ ID NO: 3749 - RNA, 19 nt, artificial
  Chemically synthesized
gauguacuuauucaugcua

SEQ ID NO: 3750 - RNA, 19 nt, artificial
  Chemically synthesized
acaucuuggaccugcagau

SEQ ID NO: 3751 - RNA, 19 nt, artificial
  Chemically synthesized
gaggaccagugcuuugauu

SEQ ID NO: 3752 - RNA, 19 nt, artificial
  Chemically synthesized
cuacugaaugcuguguaua

SEQ ID NO: 3753 - RNA, 19 nt, artificial
  Chemically synthesized
agcagacuuugccuuuuuu

SEQ ID NO: 3754 - RNA, 19 nt, artificial
  Chemically synthesized
caagccuacugaaugcugu

SEQ ID NO: 3755 - RNA, 19 nt, artificial
  Chemically synthesized
cgugaauaccagaaggauc

SEQ ID NO: 3756 - RNA, 19 nt, artificial
  Chemically synthesized
auaccagaaggauccagua

SEQ ID NO: 3757 - RNA, 19 nt, artificial
  Chemically synthesized
uucccaggguguucucuua

SEQ ID NO: 3758 - RNA, 19 nt, artificial
  Chemically synthesized
gccaagcgcagcuagcuca

SEQ ID NO: 3759 - RNA, 19 nt, artificial
  Chemically synthesized
guguguuuauugaauggug

SEQ ID NO: 3760 - RNA, 19 nt, artificial
  Chemically synthesized
ggagcgaaaacguuaaaau

SEQ ID NO: 3761 - RNA, 19 nt, artificial
  Chemically synthesized
cuuacuuggacugugauau

SEQ ID NO: 3762 - RNA, 19 nt, artificial
  Chemically synthesized
acugcuacuccaagcucaa

SEQ ID NO: 3763 - RNA, 19 nt, artificial
  Chemically synthesized
ugaacgacugcuacuccaa

SEQ ID NO: 3764 - RNA, 19 nt, artificial
  Chemically synthesized
caaauucacggaaucuuuu

SEQ ID NO: 3765 - RNA, 19 nt, artificial
  Chemically synthesized
gcuacuccaagcucaagga

SEQ ID NO: 3766 - RNA, 19 nt, artificial
  Chemically synthesized
ugagccugcuauacaacau

SEQ ID NO: 3767 - RNA, 19 nt, artificial
  Chemically synthesized
cccuuucugcaguuggaag

SEQ ID NO: 3768 - RNA, 19 nt, artificial
  Chemically synthesized
uuucaaagguggagcguga

SEQ ID NO: 3769 - RNA, 19 nt, artificial
  Chemically synthesized
ugauguacuuauucaugcu

SEQ ID NO: 3770 - RNA, 19 nt, artificial
  Chemically synthesized
agguggagcgugaauacca

SEQ ID NO: 3771 - RNA, 19 nt, artificial
  Chemically synthesized
ccacccucaacacggauau

SEQ ID NO: 3772 - RNA, 19 nt, artificial
  Chemically synthesized
auaguggcagagaugucua

SEQ ID NO: 3773 - RNA, 19 nt, artificial
  Chemically synthesized
ucugcaguuggaagguuuu

SEQ ID NO: 3774 - RNA, 19 nt, artificial
  Chemically synthesized
guguucucuuacuuggacu

SEQ ID NO: 3775 - RNA, 19 nt, artificial
  Chemically synthesized
guuauaacugaacccaaau

SEQ ID NO: 3776 - RNA, 19 nt, artificial
  Chemically synthesized
caaguguguuuauugaaug

SEQ ID NO: 3777 - RNA, 19 nt, artificial
  Chemically synthesized
ugcccaaucuaagcagacu

SEQ ID NO: 3778 - RNA, 19 nt, artificial
  Chemically synthesized
accagagacccgggcagaa

SEQ ID NO: 3779 - RNA, 19 nt, artificial
  Chemically synthesized
aguggcagagaugucuauu

SEQ ID NO: 3780 - RNA, 19 nt, artificial
  Chemically synthesized
cccucgcggucagcaugaa

SEQ ID NO: 3781 - RNA, 19 nt, artificial
  Chemically synthesized
agauggaaauccugcagca

SEQ ID NO: 3782 - RNA, 19 nt, artificial
  Chemically synthesized
cagaaggauccaguauuca

SEQ ID NO: 3783 - RNA, 19 nt, artificial
  Chemically synthesized
gguggagcgugaauaccag

SEQ ID NO: 3784 - RNA, 19 nt, artificial
  Chemically synthesized
aaaccuugugaacucuuua

SEQ ID NO: 3785 - RNA, 19 nt, artificial
  Chemically synthesized
agcgugaauaccagaagga

SEQ ID NO: 3786 - RNA, 19 nt, artificial
  Chemically synthesized
ucucuuacuuggacuguga

SEQ ID NO: 3787 - RNA, 19 nt, artificial
  Chemically synthesized
gacacaagccuacugaaug

SEQ ID NO: 3788 - RNA, 19 nt, artificial
  Chemically synthesized
uggaaggaaaacuaagaau

SEQ ID NO: 3789 - RNA, 19 nt, artificial
  Chemically synthesized
caaucuaagcagacuuugc

SEQ ID NO: 3790 - RNA, 19 nt, artificial
  Chemically synthesized
gggcagaaccaggcgucca

SEQ ID NO: 3791 - RNA, 19 nt, artificial
  Chemically synthesized
gcauucaaaaguguaauga

SEQ ID NO: 3792 - RNA, 19 nt, artificial
  Chemically synthesized
cacuauugucagccugcau

SEQ ID NO: 3793 - RNA, 19 nt, artificial
  Chemically synthesized
ggaaucuuuuaagugcuga

SEQ ID NO: 3794 - RNA, 19 nt, artificial
  Chemically synthesized
ugaccacccucaacacgga

SEQ ID NO: 3795 - RNA, 19 nt, artificial
  Chemically synthesized
caacaaauucacggaaucu

SEQ ID NO: 3796 - RNA, 19 nt, artificial
  Chemically synthesized
aagggaagcuccagcgugu

SEQ ID NO: 3797 - RNA, 19 nt, artificial
  Chemically synthesized
gcaugaaagccuucagucc

SEQ ID NO: 3798 - RNA, 19 nt, artificial
  Chemically synthesized
gaugucuauuucugcauuc

SEQ ID NO: 3799 - RNA, 19 nt, artificial
  Chemically synthesized
gcaagauggaaauccugca

SEQ ID NO: 3800 - RNA, 19 nt, artificial
  Chemically synthesized
uggagcgugaauaccagaa

SEQ ID NO: 3801 - RNA, 19 nt, artificial
  Chemically synthesized
cuauuucugcauucaaaag

SEQ ID NO: 3802 - RNA, 19 nt, artificial
  Chemically synthesized
ggacgaagggaagcuccag

SEQ ID NO: 3803 - RNA, 19 nt, artificial
  Chemically synthesized
gcgguguucaugauuucuu

SEQ ID NO: 3804 - RNA, 19 nt, artificial
  Chemically synthesized
gagcgugaauaccagaagg

SEQ ID NO: 3805 - RNA, 19 nt, artificial
  Chemically synthesized
aacaacaaauucacggaau

SEQ ID NO: 3806 - RNA, 19 nt, artificial
  Chemically synthesized
cucuuacuuggacugugau

SEQ ID NO: 3807 - RNA, 19 nt, artificial
  Chemically synthesized
auaucagcauccuguccuu

SEQ ID NO: 3808 - RNA, 19 nt, artificial
  Chemically synthesized
ugagcaagauggaaauccu

SEQ ID NO: 3809 - RNA, 19 nt, artificial
  Chemically synthesized
agaaggauccaguauucag

SEQ ID NO: 3810 - RNA, 19 nt, artificial
  Chemically synthesized
gaguuuucuuguauagugg

SEQ ID NO: 3811 - RNA, 19 nt, artificial
  Chemically synthesized
acaacaacaaauucacgga

SEQ ID NO: 3812 - RNA, 19 nt, artificial
  Chemically synthesized
ugacacaagccuacugaau

SEQ ID NO: 3813 - RNA, 19 nt, artificial
  Chemically synthesized
gagugaaaccuugugaacu

SEQ ID NO: 3814 - RNA, 19 nt, artificial
  Chemically synthesized
aguuguaaacuuaacccuu

SEQ ID NO: 3815 - RNA, 19 nt, artificial
  Chemically synthesized
auguuauaacugaacccaa

SEQ ID NO: 3816 - RNA, 19 nt, artificial
  Chemically synthesized
uaguggcagagaugucuau

SEQ ID NO: 3817 - RNA, 19 nt, artificial
  Chemically synthesized
ccgcugaccacccucaaca

SEQ ID NO: 3818 - RNA, 19 nt, artificial
  Chemically synthesized
gccugucggaccacagccu

SEQ ID NO: 3819 - RNA, 19 nt, artificial
  Chemically synthesized
ggagcgugaauaccagaag

SEQ ID NO: 3820 - RNA, 19 nt, artificial
  Chemically synthesized
agcgaaaacguuaaaauca

SEQ ID NO: 3821 - RNA, 19 nt, artificial
  Chemically synthesized
cgaaaacguuaaaaucaca

SEQ ID NO: 3822 - RNA, 19 nt, artificial
  Chemically synthesized
aaugucaaaugacagcaaa

SEQ ID NO: 3823 - RNA, 19 nt, artificial
  Chemically synthesized
accuugugaacucuuuaau

SEQ ID NO: 3824 - RNA, 19 nt, artificial
  Chemically synthesized
agagacccgggcagaacca

SEQ ID NO: 3825 - RNA, 19 nt, artificial
  Chemically synthesized
caggcuucugaauucccuu

SEQ ID NO: 3826 - RNA, 19 nt, artificial
  Chemically synthesized
caccagagacccgggcaga

SEQ ID NO: 3827 - RNA, 19 nt, artificial
  Chemically synthesized
cggaccacagccugggcau

SEQ ID NO: 3828 - RNA, 19 nt, artificial
  Chemically synthesized
cccucaacacggauaucag

SEQ ID NO: 3829 - RNA, 19 nt, artificial
  Chemically synthesized
uggaaauccugcagcacgu

SEQ ID NO: 3830 - RNA, 19 nt, artificial
  Chemically synthesized
cggcgagugcggauaaaag

SEQ ID NO: 3831 - RNA, 19 nt, artificial
  Chemically synthesized
ucuuugcacaacaacaaca

SEQ ID NO: 3832 - RNA, 19 nt, artificial
  Chemically synthesized
gaauggugauugccugcuu

SEQ ID NO: 3833 - RNA, 19 nt, artificial
  Chemically synthesized
gaacaagaaggugagcaag

SEQ ID NO: 3834 - RNA, 19 nt, artificial
  Chemically synthesized
ugaagucuuuuggucagaa

SEQ ID NO: 3835 - RNA, 19 nt, artificial
  Chemically synthesized
cuauacaacaugaacgacu

SEQ ID NO: 3836 - RNA, 19 nt, artificial
  Chemically synthesized
aggauccaguauucaguca

SEQ ID NO: 3837 - RNA, 19 nt, artificial
  Chemically synthesized
gcugaauaagcgguguuca

SEQ ID NO: 3838 - RNA, 19 nt, artificial
  Chemically synthesized
agaucgcccuggacucgca

SEQ ID NO: 3839 - RNA, 19 nt, artificial
  Chemically synthesized
cacgucaucgacuacaucu

SEQ ID NO: 3840 - RNA, 19 nt, artificial
  Chemically synthesized
ggcuucugaauucccuucu

SEQ ID NO: 3841 - RNA, 19 nt, artificial
  Chemically synthesized
guggagcgugaauaccaga

SEQ ID NO: 3842 - RNA, 19 nt, artificial
  Chemically synthesized
ccuuucugcaguuggaagg

SEQ ID NO: 3843 - RNA, 19 nt, artificial
  Chemically synthesized
ucuuuuaagugcugaacuu

SEQ ID NO: 3844 - RNA, 19 nt, artificial
  Chemically synthesized
uggcagagaugucuauuuc

SEQ ID NO: 3845 - RNA, 19 nt, artificial
  Chemically synthesized
acguuaaaaucacaaggaa

SEQ ID NO: 3846 - RNA, 19 nt, artificial
  Chemically synthesized
ccugcuauacaacaugaac

SEQ ID NO: 3847 - RNA, 19 nt, artificial
  Chemically synthesized
aggaaaacuaagaaugauc

SEQ ID NO: 3848 - RNA, 19 nt, artificial
  Chemically synthesized
cuaagcagacuuugccuuu

SEQ ID NO: 3849 - RNA, 19 nt, artificial
  Chemically synthesized
gucaaaugacagcaaagca

SEQ ID NO: 3850 - RNA, 19 nt, artificial
  Chemically synthesized
uugacacaagccuacugaa

SEQ ID NO: 3851 - RNA, 19 nt, artificial
  Chemically synthesized
gaucaucuucccagggugu

SEQ ID NO: 3852 - RNA, 19 nt, artificial
  Chemically synthesized
cccuucugaguuaauguca

SEQ ID NO: 3853 - RNA, 19 nt, artificial
  Chemically synthesized
cuuucugcaguuggaaggu

SEQ ID NO: 3854 - RNA, 19 nt, artificial
  Chemically synthesized
acaacaaauucacggaauc

SEQ ID NO: 3855 - RNA, 19 nt, artificial
  Chemically synthesized
ggcgagugcggauaaaagc

SEQ ID NO: 3856 - RNA, 19 nt, artificial
  Chemically synthesized
aucacaaggaauugcccaa

SEQ ID NO: 3857 - RNA, 19 nt, artificial
  Chemically synthesized
gcacaacaacaacaacaac

SEQ ID NO: 3858 - RNA, 19 nt, artificial
  Chemically synthesized
acuccaagcucaaggagcu

SEQ ID NO: 3859 - RNA, 19 nt, artificial
  Chemically synthesized
ccucgcggucagcaugaaa

SEQ ID NO: 3860 - RNA, 19 nt, artificial
  Chemically synthesized
cugcuauacaacaugaacg

SEQ ID NO: 3861 - RNA, 19 nt, artificial
  Chemically synthesized
uggucagaaauuaccuuuu

SEQ ID NO: 3862 - RNA, 19 nt, artificial
  Chemically synthesized
gggagcgaaaacguuaaaa

SEQ ID NO: 3863 - RNA, 19 nt, artificial
  Chemically synthesized
gauugccugcuuuauuuca

SEQ ID NO: 3864 - RNA, 19 nt, artificial
  Chemically synthesized
ucuuacuuggacugugaua

SEQ ID NO: 3865 - RNA, 19 nt, artificial
  Chemically synthesized
ggcagaaccaggcguccag

SEQ ID NO: 3866 - RNA, 19 nt, artificial
  Chemically synthesized
ccaaucuaagcagacuuug

SEQ ID NO: 3867 - RNA, 19 nt, artificial
  Chemically synthesized
ggaauugcccaaucuaagc

SEQ ID NO: 3868 - RNA, 19 nt, artificial
  Chemically synthesized
caagaaggugagcaagaug

SEQ ID NO: 3869 - RNA, 19 nt, artificial
  Chemically synthesized
gaaugaucaucuucccagg

SEQ ID NO: 3870 - RNA, 19 nt, artificial
  Chemically synthesized
uuugaaugcagaaauagac

SEQ ID NO: 3871 - RNA, 19 nt, artificial
  Chemically synthesized
agaaauagacaucucugcc

SEQ ID NO: 3872 - RNA, 19 nt, artificial
  Chemically synthesized
aagucugcuuagauugggc

SEQ ID NO: 3873 - RNA, 19 nt, artificial
  Chemically synthesized
uuaagugacugaauacugg

SEQ ID NO: 3874 - RNA, 19 nt, artificial
  Chemically synthesized
ugaucauucuuaguuuucc

SEQ ID NO: 3875 - RNA, 19 nt, artificial
  Chemically synthesized
uccaaguaagagaacaccc

SEQ ID NO: 3876 - RNA, 19 nt, artificial
  Chemically synthesized
aaauagacaucucugccac

SEQ ID NO: 3877 - RNA, 19 nt, artificial
  Chemically synthesized
aaagucugcuuagauuggg

SEQ ID NO: 3878 - RNA, 19 nt, artificial
  Chemically synthesized
aaagaaaucaugaacaccg

SEQ ID NO: 3879 - RNA, 19 nt, artificial
  Chemically synthesized
auaaagaaaaccuuccaac

SEQ ID NO: 3880 - RNA, 19 nt, artificial
  Chemically synthesized
uuuaagugacugaauacug

SEQ ID NO: 3881 - RNA, 19 nt, artificial
  Chemically synthesized
uuuugcuccgggagaugcc

SEQ ID NO: 3882 - RNA, 19 nt, artificial
  Chemically synthesized
uaauuucugaccaaaagac

SEQ ID NO: 3883 - RNA, 19 nt, artificial
  Chemically synthesized
ucauucuuaguuuuccuuc

SEQ ID NO: 3884 - RNA, 19 nt, artificial
  Chemically synthesized
aaaaucaaagcacuggucc

SEQ ID NO: 3885 - RNA, 19 nt, artificial
  Chemically synthesized
ugucauuugacauuaacuc

SEQ ID NO: 3886 - RNA, 19 nt, artificial
  Chemically synthesized
uccgacaggcuguuuuucc

SEQ ID NO: 3887 - RNA, 19 nt, artificial
  Chemically synthesized
aauuaaagaguucacaagg

SEQ ID NO: 3888 - RNA, 19 nt, artificial
  Chemically synthesized
uaggcuugugucaaaaagg

SEQ ID NO: 3889 - RNA, 19 nt, artificial
  Chemically synthesized
uuuuauccgcacucgccgg

SEQ ID NO: 3890 - RNA, 19 nt, artificial
  Chemically synthesized
auacacagcauucaguagg

SEQ ID NO: 3891 - RNA, 19 nt, artificial
  Chemically synthesized
uuguuguuguuguugugca

SEQ ID NO: 3892 - RNA, 19 nt, artificial
  Chemically synthesized
aauacuggauccuucuggu

SEQ ID NO: 3893 - RNA, 19 nt, artificial
  Chemically synthesized
ucagaaugaagcccgagcc

SEQ ID NO: 3894 - RNA, 19 nt, artificial
  Chemically synthesized
uuugcuccgggagaugccc

SEQ ID NO: 3895 - RNA, 19 nt, artificial
  Chemically synthesized
aauaaagcaggcaaucacc

SEQ ID NO: 3896 - RNA, 19 nt, artificial
  Chemically synthesized
aaagauuccgugaauuugu

SEQ ID NO: 3897 - RNA, 19 nt, artificial
  Chemically synthesized
aucucugccacuauacaag

SEQ ID NO: 3898 - RNA, 19 nt, artificial
  Chemically synthesized
uuuggguucaguuauaaca

SEQ ID NO: 3899 - RNA, 19 nt, artificial
  Chemically synthesized
uuugaaaaaaggcaaaguc

SEQ ID NO: 3900 - RNA, 19 nt, artificial
  Chemically synthesized
aaugcagaaauagacaucu

SEQ ID NO: 3901 - RNA, 19 nt, artificial
  Chemically synthesized
uucauguuguauagcaggc

SEQ ID NO: 3902 - RNA, 19 nt, artificial
  Chemically synthesized
uagauugggcaauuccuug

SEQ ID NO: 3903 - RNA, 19 nt, artificial
  Chemically synthesized
ucauguuguauagcaggcu

SEQ ID NO: 3904 - RNA, 19 nt, artificial
  Chemically synthesized
aaaaagguaauuucugacc

SEQ ID NO: 3905 - RNA, 19 nt, artificial
  Chemically synthesized
uuccaacugcagaaagggc

SEQ ID NO: 3906 - RNA, 19 nt, artificial
  Chemically synthesized
ugagcuuggaguagcaguc

SEQ ID NO: 3907 - RNA, 19 nt, artificial
  Chemically synthesized
uuagauugggcaauuccuu

SEQ ID NO: 3908 - RNA, 19 nt, artificial
  Chemically synthesized
aaauaaagcaggcaaucac

SEQ ID NO: 3909 - RNA, 19 nt, artificial
  Chemically synthesized
gaauacuggauccuucugg

SEQ ID NO: 3910 - RNA, 19 nt, artificial
  Chemically synthesized
auguagucgaugacgugcu

SEQ ID NO: 3911 - RNA, 19 nt, artificial
  Chemically synthesized
uucagcacuuaaaagauuc

SEQ ID NO: 3912 - RNA, 19 nt, artificial
  Chemically synthesized
uugaaugcagaaauagaca

SEQ ID NO: 3913 - RNA, 19 nt, artificial
  Chemically synthesized
ugcagaaauagacaucucu

SEQ ID NO: 3914 - RNA, 19 nt, artificial
  Chemically synthesized
uuucugaccaaaagacuuc

SEQ ID NO: 3915 - RNA, 19 nt, artificial
  Chemically synthesized
uaaagaaaaccuuccaacu

SEQ ID NO: 3916 - RNA, 19 nt, artificial
  Chemically synthesized
ucggcucagaaugaagccc

SEQ ID NO: 3917 - RNA, 19 nt, artificial
  Chemically synthesized
aaggcuuucaugcugaccg

SEQ ID NO: 3918 - RNA, 19 nt, artificial
  Chemically synthesized
uaaaaaucaaagcacuggu

SEQ ID NO: 3919 - RNA, 19 nt, artificial
  Chemically synthesized
uuguuguuguugugcaaag

SEQ ID NO: 3920 - RNA, 19 nt, artificial
  Chemically synthesized
cauucuuaguuuuccuucc

SEQ ID NO: 3921 - RNA, 19 nt, artificial
  Chemically synthesized
aaaggguuaaguuuacaac

SEQ ID NO: 3922 - RNA, 19 nt, artificial
  Chemically synthesized
uauucacgcuccaccuuug

SEQ ID NO: 3923 - RNA, 19 nt, artificial
  Chemically synthesized
uggagcuucccuucguccc

SEQ ID NO: 3924 - RNA, 19 nt, artificial
  Chemically synthesized
uauauacacagcauucagu

SEQ ID NO: 3925 - RNA, 19 nt, artificial
  Chemically synthesized
auccuucugguauucacgc

SEQ ID NO: 3926 - RNA, 19 nt, artificial
  Chemically synthesized
uuguccuccuugugaaaug

SEQ ID NO: 3927 - RNA, 19 nt, artificial
  Chemically synthesized
auauauacacagcauucag

SEQ ID NO: 3928 - RNA, 19 nt, artificial
  Chemically synthesized
aaaaaucaaagcacugguc

SEQ ID NO: 3929 - RNA, 19 nt, artificial
  Chemically synthesized
aaaagaaaucaugaacacc

SEQ ID NO: 3930 - RNA, 19 nt, artificial
  Chemically synthesized
uuguuguugugcaaagaau

SEQ ID NO: 3931 - RNA, 19 nt, artificial
  Chemically synthesized
aagaaaaccuuccaacugc

SEQ ID NO: 3932 - RNA, 19 nt, artificial
  Chemically synthesized
aaguaagagaacacccugg

SEQ ID NO: 3933 - RNA, 19 nt, artificial
  Chemically synthesized
aaaccuuccaacugcagaa

SEQ ID NO: 3934 - RNA, 19 nt, artificial
  Chemically synthesized
acugaauacuggauccuuc

SEQ ID NO: 3935 - RNA, 19 nt, artificial
  Chemically synthesized
uguuguuguuguuguugug

SEQ ID NO: 3936 - RNA, 19 nt, artificial
  Chemically synthesized
agugacugaauacuggauc

SEQ ID NO: 3937 - RNA, 19 nt, artificial
  Chemically synthesized
uguuguugugcaaagaaua

SEQ ID NO: 3938 - RNA, 19 nt, artificial
  Chemically synthesized
ugguccucugaaauaaagc

SEQ ID NO: 3939 - RNA, 19 nt, artificial
  Chemically synthesized
uuuauccgcacucgccggg

SEQ ID NO: 3940 - RNA, 19 nt, artificial
  Chemically synthesized
uccaacugcagaaagggca

SEQ ID NO: 3941 - RNA, 19 nt, artificial
  Chemically synthesized
uugaaaaaaggcaaagucu

SEQ ID NO: 3942 - RNA, 19 nt, artificial
  Chemically synthesized
augcagaaauagacaucuc

SEQ ID NO: 3943 - RNA, 19 nt, artificial
  Chemically synthesized
ugaugcaggcugacaauag

SEQ ID NO: 3944 - RNA, 19 nt, artificial
  Chemically synthesized
aucaccauucaauaaacac

SEQ ID NO: 3945 - RNA, 19 nt, artificial
  Chemically synthesized
uccucugaaauaaagcagg

SEQ ID NO: 3946 - RNA, 19 nt, artificial
  Chemically synthesized
auuuccaucuugcucaccu

SEQ ID NO: 3947 - RNA, 19 nt, artificial
  Chemically synthesized
ucaccauucaauaaacaca

SEQ ID NO: 3948 - RNA, 19 nt, artificial
  Chemically synthesized
auaaaaaucaaagcacugg

SEQ ID NO: 3949 - RNA, 19 nt, artificial
  Chemically synthesized
uccaccuuugaaaaaaggc

SEQ ID NO: 3950 - RNA, 19 nt, artificial
  Chemically synthesized
uaagugacugaauacugga

SEQ ID NO: 3951 - RNA, 19 nt, artificial
  Chemically synthesized
ugaaaaauaaguucagcac

SEQ ID NO: 3952 - RNA, 19 nt, artificial
  Chemically synthesized
uuacacuuuugaaugcaga

SEQ ID NO: 3953 - RNA, 19 nt, artificial
  Chemically synthesized
ugaaugcagaaauagacau

SEQ ID NO: 3954 - RNA, 19 nt, artificial
  Chemically synthesized
uccaucuugcucaccuucu

SEQ ID NO: 3955 - RNA, 19 nt, artificial
  Chemically synthesized
aagguuucacucaaauaga

SEQ ID NO: 3956 - RNA, 19 nt, artificial
  Chemically synthesized
aaagaaaaccuuccaacug

SEQ ID NO: 3957 - RNA, 19 nt, artificial
  Chemically synthesized
ugcagguccaagauguagu

SEQ ID NO: 3958 - RNA, 19 nt, artificial
  Chemically synthesized
uucagaagccugcaaggac

SEQ ID NO: 3959 - RNA, 19 nt, artificial
  Chemically synthesized
auaacgaauaucacagucc

SEQ ID NO: 3960 - RNA, 19 nt, artificial
  Chemically synthesized
uauagcaggcucaucgggu

SEQ ID NO: 3961 - RNA, 19 nt, artificial
  Chemically synthesized
aaagaguucacaagguuuc

SEQ ID NO: 3962 - RNA, 19 nt, artificial
  Chemically synthesized
aagacuucauuuaagugac

SEQ ID NO: 3963 - RNA, 19 nt, artificial
  Chemically synthesized
aauuucugaccaaaagacu

SEQ ID NO: 3964 - RNA, 19 nt, artificial
  Chemically synthesized
ucguucauguuguauagca

SEQ ID NO: 3965 - RNA, 19 nt, artificial
  Chemically synthesized
ugaaaaaaggcaaagucug

SEQ ID NO: 3966 - RNA, 19 nt, artificial
  Chemically synthesized
ucaacuuguccuccuugug

SEQ ID NO: 3967 - RNA, 19 nt, artificial
  Chemically synthesized
aagauguagucgaugacgu

SEQ ID NO: 3968 - RNA, 19 nt, artificial
  Chemically synthesized
uaaguucagcacuuaaaag

SEQ ID NO: 3969 - RNA, 19 nt, artificial
  Chemically synthesized
aacucagaagggaauucag

SEQ ID NO: 3970 - RNA, 19 nt, artificial
  Chemically synthesized
auuacacuuuugaaugcag

SEQ ID NO: 3971 - RNA, 19 nt, artificial
  Chemically synthesized
ugcaggcugacaauagugg

SEQ ID NO: 3972 - RNA, 19 nt, artificial
  Chemically synthesized
uagcagucguucauguugu

SEQ ID NO: 3973 - RNA, 19 nt, artificial
  Chemically synthesized
uacacagcauucaguaggc

SEQ ID NO: 3974 - RNA, 19 nt, artificial
  Chemically synthesized
uuaaagaguucacaagguu

SEQ ID NO: 3975 - RNA, 19 nt, artificial
  Chemically synthesized
cucaccuucuuguucuggg

SEQ ID NO: 3976 - RNA, 19 nt, artificial
  Chemically synthesized
aauucagaagccugcaagg

SEQ ID NO: 3977 - RNA, 19 nt, artificial
  Chemically synthesized
uuccgugaauuuguuguug

SEQ ID NO: 3978 - RNA, 19 nt, artificial
  Chemically synthesized
auuccuugugauuuuaacg

SEQ ID NO: 3979 - RNA, 19 nt, artificial
  Chemically synthesized
aaaucaaagcacugguccu

SEQ ID NO: 3980 - RNA, 19 nt, artificial
  Chemically synthesized
caagguuucacucaaauag

SEQ ID NO: 3981 - RNA, 19 nt, artificial
  Chemically synthesized
aguaagagaacacccuggg

SEQ ID NO: 3982 - RNA, 19 nt, artificial
  Chemically synthesized
cacuauacaagaaaacucu

SEQ ID NO: 3983 - RNA, 19 nt, artificial
  Chemically synthesized
cagaaauagacaucucugc

SEQ ID NO: 3984 - RNA, 19 nt, artificial
  Chemically synthesized
uguccuccuugugaaaugg

SEQ ID NO: 3985 - RNA, 19 nt, artificial
  Chemically synthesized
auauacacagcauucagua

SEQ ID NO: 3986 - RNA, 19 nt, artificial
  Chemically synthesized
uagcaugaauaaguacauc

SEQ ID NO: 3987 - RNA, 19 nt, artificial
  Chemically synthesized
aucugcagguccaagaugu

SEQ ID NO: 3988 - RNA, 19 nt, artificial
  Chemically synthesized
aaucaaagcacugguccuc

SEQ ID NO: 3989 - RNA, 19 nt, artificial
  Chemically synthesized
uauacacagcauucaguag

SEQ ID NO: 3990 - RNA, 19 nt, artificial
  Chemically synthesized
aaaaaaggcaaagucugcu

SEQ ID NO: 3991 - RNA, 19 nt, artificial
  Chemically synthesized
acagcauucaguaggcuug

SEQ ID NO: 3992 - RNA, 19 nt, artificial
  Chemically synthesized
gauccuucugguauucacg

SEQ ID NO: 3993 - RNA, 19 nt, artificial
  Chemically synthesized
uacuggauccuucugguau

SEQ ID NO: 3994 - RNA, 19 nt, artificial
  Chemically synthesized
uaagagaacacccugggaa

SEQ ID NO: 3995 - RNA, 19 nt, artificial
  Chemically synthesized
ugagcuagcugcgcuuggc

SEQ ID NO: 3996 - RNA, 19 nt, artificial
  Chemically synthesized
caccauucaauaaacacac

SEQ ID NO: 3997 - RNA, 19 nt, artificial
  Chemically synthesized
auuuuaacguuuucgcucc

SEQ ID NO: 3998 - RNA, 19 nt, artificial
  Chemically synthesized
auaucacaguccaaguaag

SEQ ID NO: 3999 - RNA, 19 nt, artificial
  Chemically synthesized
uugagcuuggaguagcagu

SEQ ID NO: 4000 - RNA, 19 nt, artificial
  Chemically synthesized
uuggaguagcagucguuca

SEQ ID NO: 4001 - RNA, 19 nt, artificial
  Chemically synthesized
aaaagauuccgugaauuug

SEQ ID NO: 4002 - RNA, 19 nt, artificial
  Chemically synthesized
uccuugagcuuggaguagc

SEQ ID NO: 4003 - RNA, 19 nt, artificial
  Chemically synthesized
auguuguauagcaggcuca

SEQ ID NO: 4004 - RNA, 19 nt, artificial
  Chemically synthesized
cuuccaacugcagaaaggg

SEQ ID NO: 4005 - RNA, 19 nt, artificial
  Chemically synthesized
ucacgcuccaccuuugaaa

SEQ ID NO: 4006 - RNA, 19 nt, artificial
  Chemically synthesized
agcaugaauaaguacauca

SEQ ID NO: 4007 - RNA, 19 nt, artificial
  Chemically synthesized
ugguauucacgcuccaccu

SEQ ID NO: 4008 - RNA, 19 nt, artificial
  Chemically synthesized
auauccguguugagggugg

SEQ ID NO: 4009 - RNA, 19 nt, artificial
  Chemically synthesized
uagacaucucugccacuau

SEQ ID NO: 4010 - RNA, 19 nt, artificial
  Chemically synthesized
aaaaccuuccaacugcaga

SEQ ID NO: 4011 - RNA, 19 nt, artificial
  Chemically synthesized
aguccaaguaagagaacac

SEQ ID NO: 4012 - RNA, 19 nt, artificial
  Chemically synthesized
auuuggguucaguuauaac

SEQ ID NO: 4013 - RNA, 19 nt, artificial
  Chemically synthesized
cauucaauaaacacacuug

SEQ ID NO: 4014 - RNA, 19 nt, artificial
  Chemically synthesized
agucugcuuagauugggca

SEQ ID NO: 4015 - RNA, 19 nt, artificial
  Chemically synthesized
uucugcccgggucucuggu

SEQ ID NO: 4016 - RNA, 19 nt, artificial
  Chemically synthesized
aauagacaucucugccacu

SEQ ID NO: 4017 - RNA, 19 nt, artificial
  Chemically synthesized
uucaugcugaccgcgaggg

SEQ ID NO: 4018 - RNA, 19 nt, artificial
  Chemically synthesized
ugcugcaggauuuccaucu

SEQ ID NO: 4019 - RNA, 19 nt, artificial
  Chemically synthesized
ugaauacuggauccuucug

SEQ ID NO: 4020 - RNA, 19 nt, artificial
  Chemically synthesized
cugguauucacgcuccacc

SEQ ID NO: 4021 - RNA, 19 nt, artificial
  Chemically synthesized
uaaagaguucacaagguuu

SEQ ID NO: 4022 - RNA, 19 nt, artificial
  Chemically synthesized
uccuucugguauucacgcu

SEQ ID NO: 4023 - RNA, 19 nt, artificial
  Chemically synthesized
ucacaguccaaguaagaga

SEQ ID NO: 4024 - RNA, 19 nt, artificial
  Chemically synthesized
cauucaguaggcuuguguc

SEQ ID NO: 4025 - RNA, 19 nt, artificial
  Chemically synthesized
auucuuaguuuuccuucca

SEQ ID NO: 4026 - RNA, 19 nt, artificial
  Chemically synthesized
gcaaagucugcuuagauug

SEQ ID NO: 4027 - RNA, 19 nt, artificial
  Chemically synthesized
uggacgccugguucugccc

SEQ ID NO: 4028 - RNA, 19 nt, artificial
  Chemically synthesized
ucauuacacuuuugaaugc

SEQ ID NO: 4029 - RNA, 19 nt, artificial
  Chemically synthesized
augcaggcugacaauagug

SEQ ID NO: 4030 - RNA, 19 nt, artificial
  Chemically synthesized
ucagcacuuaaaagauucc

SEQ ID NO: 4031 - RNA, 19 nt, artificial
  Chemically synthesized
uccguguugagggugguca

SEQ ID NO: 4032 - RNA, 19 nt, artificial
  Chemically synthesized
agauuccgugaauuuguug

SEQ ID NO: 4033 - RNA, 19 nt, artificial
  Chemically synthesized
acacgcuggagcuucccuu

SEQ ID NO: 4034 - RNA, 19 nt, artificial
  Chemically synthesized
ggacugaaggcuuucaugc

SEQ ID NO: 4035 - RNA, 19 nt, artificial
  Chemically synthesized
gaaugcagaaauagacauc

SEQ ID NO: 4036 - RNA, 19 nt, artificial
  Chemically synthesized
ugcaggauuuccaucuugc

SEQ ID NO: 4037 - RNA, 19 nt, artificial
  Chemically synthesized
uucugguauucacgcucca

SEQ ID NO: 4038 - RNA, 19 nt, artificial
  Chemically synthesized
cuuuugaaugcagaaauag

SEQ ID NO: 4039 - RNA, 19 nt, artificial
  Chemically synthesized
cuggagcuucccuucgucc

SEQ ID NO: 4040 - RNA, 19 nt, artificial
  Chemically synthesized
aagaaaucaugaacaccgc

SEQ ID NO: 4041 - RNA, 19 nt, artificial
  Chemically synthesized
ccuucugguauucacgcuc

SEQ ID NO: 4042 - RNA, 19 nt, artificial
  Chemically synthesized
auuccgugaauuuguuguu

SEQ ID NO: 4043 - RNA, 19 nt, artificial
  Chemically synthesized
aucacaguccaaguaagag

SEQ ID NO: 4044 - RNA, 19 nt, artificial
  Chemically synthesized
aaggacaggaugcugauau

SEQ ID NO: 4045 - RNA, 19 nt, artificial
  Chemically synthesized
aggauuuccaucuugcuca

SEQ ID NO: 4046 - RNA, 19 nt, artificial
  Chemically synthesized
cugaauacuggauccuucu

SEQ ID NO: 4047 - RNA, 19 nt, artificial
  Chemically synthesized
ccacuauacaagaaaacuc

SEQ ID NO: 4048 - RNA, 19 nt, artificial
  Chemically synthesized
uccgugaauuuguuguugu

SEQ ID NO: 4049 - RNA, 19 nt, artificial
  Chemically synthesized
auucaguaggcuuguguca

SEQ ID NO: 4050 - RNA, 19 nt, artificial
  Chemically synthesized
aguucacaagguuucacuc

SEQ ID NO: 4051 - RNA, 19 nt, artificial
  Chemically synthesized
aaggguuaaguuuacaacu

SEQ ID NO: 4052 - RNA, 19 nt, artificial
  Chemically synthesized
uuggguucaguuauaacau

SEQ ID NO: 4053 - RNA, 19 nt, artificial
  Chemically synthesized
auagacaucucugccacua

SEQ ID NO: 4054 - RNA, 19 nt, artificial
  Chemically synthesized
uguugaggguggucagcgg

SEQ ID NO: 4055 - RNA, 19 nt, artificial
  Chemically synthesized
aggcugugguccgacaggc

SEQ ID NO: 4056 - RNA, 19 nt, artificial
  Chemically synthesized
cuucugguauucacgcucc

SEQ ID NO: 4057 - RNA, 19 nt, artificial
  Chemically synthesized
ugauuuuaacguuuucgcu

SEQ ID NO: 4058 - RNA, 19 nt, artificial
  Chemically synthesized
ugugauuuuaacguuuucg

SEQ ID NO: 4059 - RNA, 19 nt, artificial
  Chemically synthesized
uuugcugucauuugacauu

SEQ ID NO: 4060 - RNA, 19 nt, artificial
  Chemically synthesized
auuaaagaguucacaaggu

SEQ ID NO: 4061 - RNA, 19 nt, artificial
  Chemically synthesized
ugguucugcccgggucucu

SEQ ID NO: 4062 - RNA, 19 nt, artificial
  Chemically synthesized
aagggaauucagaagccug

SEQ ID NO: 4063 - RNA, 19 nt, artificial
  Chemically synthesized
ucugcccgggucucuggug

SEQ ID NO: 4064 - RNA, 19 nt, artificial
  Chemically synthesized
augcccaggcugugguccg

SEQ ID NO: 4065 - RNA, 19 nt, artificial
  Chemically synthesized
cugauauccguguugaggg

SEQ ID NO: 4066 - RNA, 19 nt, artificial
  Chemically synthesized
acgugcugcaggauuucca

SEQ ID NO: 4067 - RNA, 19 nt, artificial
  Chemically synthesized
cuuuuauccgcacucgccg

SEQ ID NO: 4068 - RNA, 19 nt, artificial
  Chemically synthesized
uguuguuguugugcaaaga

SEQ ID NO: 4069 - RNA, 19 nt, artificial
  Chemically synthesized
aagcaggcaaucaccauuc

SEQ ID NO: 4070 - RNA, 19 nt, artificial
  Chemically synthesized
cuugcucaccuucuuguuc

SEQ ID NO: 4071 - RNA, 19 nt, artificial
  Chemically synthesized
uucugaccaaaagacuuca

SEQ ID NO: 4072 - RNA, 19 nt, artificial
  Chemically synthesized
agucguucauguuguauag

SEQ ID NO: 4073 - RNA, 19 nt, artificial
  Chemically synthesized
ugacugaauacuggauccu

SEQ ID NO: 4074 - RNA, 19 nt, artificial
  Chemically synthesized
ugaacaccgcuuauucagc

SEQ ID NO: 4075 - RNA, 19 nt, artificial
  Chemically synthesized
ugcgaguccagggcgaucu

SEQ ID NO: 4076 - RNA, 19 nt, artificial
  Chemically synthesized
agauguagucgaugacgug

SEQ ID NO: 4077 - RNA, 19 nt, artificial
  Chemically synthesized
agaagggaauucagaagcc

SEQ ID NO: 4078 - RNA, 19 nt, artificial
  Chemically synthesized
ucugguauucacgcuccac

SEQ ID NO: 4079 - RNA, 19 nt, artificial
  Chemically synthesized
ccuuccaacugcagaaagg

SEQ ID NO: 4080 - RNA, 19 nt, artificial
  Chemically synthesized
aaguucagcacuuaaaaga

SEQ ID NO: 4081 - RNA, 19 nt, artificial
  Chemically synthesized
gaaauagacaucucugcca

SEQ ID NO: 4082 - RNA, 19 nt, artificial
  Chemically synthesized
uuccuugugauuuuaacgu

SEQ ID NO: 4083 - RNA, 19 nt, artificial
  Chemically synthesized
guucauguuguauagcagg

SEQ ID NO: 4084 - RNA, 19 nt, artificial
  Chemically synthesized
gaucauucuuaguuuuccu

SEQ ID NO: 4085 - RNA, 19 nt, artificial
  Chemically synthesized
aaaggcaaagucugcuuag

SEQ ID NO: 4086 - RNA, 19 nt, artificial
  Chemically synthesized
ugcuuugcugucauuugac

SEQ ID NO: 4087 - RNA, 19 nt, artificial
  Chemically synthesized
uucaguaggcuugugucaa

SEQ ID NO: 4088 - RNA, 19 nt, artificial
  Chemically synthesized
acacccugggaagaugauc

SEQ ID NO: 4089 - RNA, 19 nt, artificial
  Chemically synthesized
ugacauuaacucagaaggg

SEQ ID NO: 4090 - RNA, 19 nt, artificial
  Chemically synthesized
accuuccaacugcagaaag

SEQ ID NO: 4091 - RNA, 19 nt, artificial
  Chemically synthesized
gauuccgugaauuuguugu

SEQ ID NO: 4092 - RNA, 19 nt, artificial
  Chemically synthesized
gcuuuuauccgcacucgcc

SEQ ID NO: 4093 - RNA, 19 nt, artificial
  Chemically synthesized
uugggcaauuccuugugau

SEQ ID NO: 4094 - RNA, 19 nt, artificial
  Chemically synthesized
guuguuguuguuguugugc

SEQ ID NO: 4095 - RNA, 19 nt, artificial
  Chemically synthesized
agcuccuugagcuuggagu

SEQ ID NO: 4096 - RNA, 19 nt, artificial
  Chemically synthesized
uuucaugcugaccgcgagg

SEQ ID NO: 4097 - RNA, 19 nt, artificial
  Chemically synthesized
cguucauguuguauagcag

SEQ ID NO: 4098 - RNA, 19 nt, artificial
  Chemically synthesized
aaaagguaauuucugacca

SEQ ID NO: 4099 - RNA, 19 nt, artificial
  Chemically synthesized
uuuuaacguuuucgcuccc

SEQ ID NO: 4100 - RNA, 19 nt, artificial
  Chemically synthesized
ugaaauaaagcaggcaauc

SEQ ID NO: 4101 - RNA, 19 nt, artificial
  Chemically synthesized
uaucacaguccaaguaaga

SEQ ID NO: 4102 - RNA, 19 nt, artificial
  Chemically synthesized
cuggacgccugguucugcc

SEQ ID NO: 4103 - RNA, 19 nt, artificial
  Chemically synthesized
caaagucugcuuagauugg

SEQ ID NO: 4104 - RNA, 19 nt, artificial
  Chemically synthesized
gcuuagauugggcaauucc

SEQ ID NO: 4105 - RNA, 19 nt, artificial
  Chemically synthesized
caucuugcucaccuucuug

SEQ ID NO: 4106 - RNA, 19 nt, Artificial Sequence
  Chemically synthesized
ccugggaagaugaucauuc

SEQ ID NO: 4107 - RNA, 19 nt, artificial
  Chemically synthesized
gcccuggacucgcauccca

SEQ ID NO: 4108 - RNA, 19 nt, artificial
  Chemically synthesized
cagcaugaaagccuucagu

SEQ ID NO: 4109 - RNA, 19 nt, artificial
  Chemically synthesized
gaauugcccaaucuaagca

SEQ ID NO: 4110 - RNA, 19 nt, artificial
  Chemically synthesized
aaaacagccugucggacca

SEQ ID NO: 4111 - RNA, 19 nt, artificial
  Chemically synthesized
cagaacaagaaggugagca

SEQ ID NO: 4112 - RNA, 19 nt, artificial
  Chemically synthesized
uggugauugccugcuuuau

SEQ ID NO: 4113 - RNA, 19 nt, artificial
  Chemically synthesized
auggugauugccugcuuua

SEQ ID NO: 4114 - RNA, 19 nt, artificial
  Chemically synthesized
aaccauuucacaaggagga

SEQ ID NO: 4115 - RNA, 19 nt, artificial
  Chemically synthesized
aggaauugcccaaucuaag

SEQ ID NO: 4116 - RNA, 19 nt, artificial
  Chemically synthesized
auugcccaaucuaagcaga

SEQ ID NO: 4117 - RNA, 19 nt, artificial
  Chemically synthesized
cuucccaggguguucucuu

SEQ ID NO: 4118 - RNA, 19 nt, artificial
  Chemically synthesized
cgccgcugaccacccucaa

SEQ ID NO: 4119 - RNA, 19 nt, artificial
  Chemically synthesized
aagucuuuuggucagaaau

SEQ ID NO: 4120 - RNA, 19 nt, artificial
  Chemically synthesized
augaacgacugcuacucca

SEQ ID NO: 4121 - RNA, 19 nt, artificial
  Chemically synthesized
uaccagaaggauccaguau

SEQ ID NO: 4122 - RNA, 19 nt, artificial
  Chemically synthesized
ggauccaguauucagucac

SEQ ID NO: 4123 - RNA, 19 nt, artificial
  Chemically synthesized
ggccugagcuucagggcag

SEQ ID NO: 4124 - RNA, 19 nt, artificial
  Chemically synthesized
ucgacuacaucuuggaccu

SEQ ID NO: 4125 - RNA, 19 nt, artificial
  Chemically synthesized
uguccuugcaggcuucuga

SEQ ID NO: 4126 - RNA, 19 nt, artificial
  Chemically synthesized
ugcaguuggaagguuuucu

SEQ ID NO: 4127 - RNA, 19 nt, artificial
  Chemically synthesized
guuuauugaauggugauug

SEQ ID NO: 4128 - RNA, 19 nt, artificial
  Chemically synthesized
cagaggaccagugcuuuga

SEQ ID NO: 4129 - RNA, 19 nt, artificial
  Chemically synthesized
ucagcauccuguccuugca

SEQ ID NO: 4130 - RNA, 19 nt, artificial
  Chemically synthesized
agaggaccagugcuuugau

SEQ ID NO: 4131 - RNA, 19 nt, artificial
  Chemically synthesized
ggucagcaugaaagccuuc

SEQ ID NO: 4132 - RNA, 19 nt, artificial
  Chemically synthesized
ccuggacucgcaucccacu

SEQ ID NO: 4133 - RNA, 19 nt, artificial
  Chemically synthesized
guuuucuuguauaguggca

SEQ ID NO: 4134 - RNA, 19 nt, artificial
  Chemically synthesized
uucacaaggaggacaaguu

SEQ ID NO: 4135 - RNA, 19 nt, artificial
  Chemically synthesized
gcaggcuucugaauucccu

SEQ ID NO: 4136 - RNA, 19 nt, artificial
  Chemically synthesized
aaaugaagucuuuugguca

SEQ ID NO: 4137 - RNA, 19 nt, artificial
  Chemically synthesized
gcuucugaauucccuucug

SEQ ID NO: 4138 - RNA, 19 nt, artificial
  Chemically synthesized
cgucaucgacuacaucuug

SEQ ID NO: 4139 - RNA, 19 nt, artificial
  Chemically synthesized
gucagaaauuaccuuuuug

SEQ ID NO: 4140 - RNA, 19 nt, artificial
  Chemically synthesized
cuggacucgcaucccacua

SEQ ID NO: 4141 - RNA, 19 nt, artificial
  Chemically synthesized
cagcacgucaucgacuaca

SEQ ID NO: 4142 - RNA, 19 nt, artificial
  Chemically synthesized
gucagcaugaaagccuuca

SEQ ID NO: 4143 - RNA, 19 nt, artificial
  Chemically synthesized
gugaacucuuuaauuagag

SEQ ID NO: 4144 - RNA, 19 nt, artificial
  Chemically synthesized
caaaugacagcaaagcacu

SEQ ID NO: 4145 - RNA, 19 nt, artificial
  Chemically synthesized
guauucagucacuuaaaug

SEQ ID NO: 4146 - RNA, 19 nt, artificial
  Chemically synthesized
ucugaauucccuucugagu

SEQ ID NO: 4147 - RNA, 19 nt, artificial
  Chemically synthesized
ugggcaucucccggagcaa

SEQ ID NO: 4148 - RNA, 19 nt, artificial
  Chemically synthesized
cuaagaaugaucaucuucc

SEQ ID NO: 4149 - RNA, 19 nt, artificial
  Chemically synthesized
ugaucaucuucccagggug

SEQ ID NO: 4150 - RNA, 19 nt, artificial
  Chemically synthesized
aagcagacuuugccuuuuu

SEQ ID NO: 4151 - RNA, 19 nt, artificial
  Chemically synthesized
uaaugucaaaugacagcaa

SEQ ID NO: 4152 - RNA, 19 nt, artificial
  Chemically synthesized
gugaauaccagaaggaucc

SEQ ID NO: 4153 - RNA, 19 nt, artificial
  Chemically synthesized
auccaguauucagucacuu

SEQ ID NO: 4154 - RNA, 19 nt, artificial
  Chemically synthesized
ucuuguauaguggcagaga

SEQ ID NO: 4155 - RNA, 19 nt, artificial
  Chemically synthesized
cagagaugucuauuucugc

SEQ ID NO: 4156 - RNA, 19 nt, artificial
  Chemically synthesized
uuucuuguauaguggcaga

SEQ ID NO: 4157 - RNA, 19 nt, artificial
  Chemically synthesized
guauaguggcagagauguc

SEQ ID NO: 4158 - RNA, 19 nt, artificial
  Chemically synthesized
caaagcacuguguggcuga

SEQ ID NO: 4159 - RNA, 19 nt, artificial
  Chemically synthesized
cugaacccaaauaaauaca

SEQ ID NO: 4160 - RNA, 19 nt, artificial
  Chemically synthesized
agcggcggccugagcuuca

SEQ ID NO: 4161 - RNA, 19 nt, artificial
  Chemically synthesized
ucaucgacuacaucuugga

SEQ ID NO: 4162 - RNA, 19 nt, artificial
  Chemically synthesized
gugaaaccuugugaacucu

SEQ ID NO: 4163 - RNA, 19 nt, artificial
  Chemically synthesized
caucuucccaggguguucu

SEQ ID NO: 4164 - RNA, 19 nt, artificial
  Chemically synthesized
accugcagaucgcccugga

SEQ ID NO: 4165 - RNA, 19 nt, artificial
  Chemically synthesized
gaacccaaauaaauacaag

SEQ ID NO: 4166 - RNA, 19 nt, artificial
  Chemically synthesized
cuucccucgcggucagcau

SEQ ID NO: 4167 - RNA, 19 nt, artificial
  Chemically synthesized
gacucgcaucccacuauug

SEQ ID NO: 4168 - RNA, 19 nt, artificial
  Chemically synthesized
agccuacugaaugcugugu

SEQ ID NO: 4169 - RNA, 19 nt, artificial
  Chemically synthesized
agugaaaccuugugaacuc

SEQ ID NO: 4170 - RNA, 19 nt, artificial
  Chemically synthesized
auccuguccuugcaggcuu

SEQ ID NO: 4171 - RNA, 19 nt, artificial
  Chemically synthesized
cgacccgaugagccugcua

SEQ ID NO: 4172 - RNA, 19 nt, artificial
  Chemically synthesized
cucgcaucccacuauuguc

SEQ ID NO: 4173 - RNA, 19 nt, artificial
  Chemically synthesized
cugggcaucucccggagca

SEQ ID NO: 4174 - RNA, 19 nt, artificial
  Chemically synthesized
cugcuuuauuucagaggac

SEQ ID NO: 4175 - RNA, 19 nt, artificial
  Chemically synthesized
caaccauuucacaaggagg

SEQ ID NO: 4176 - RNA, 19 nt, artificial
  Chemically synthesized
gcgaaaacguuaaaaucac

SEQ ID NO: 4177 - RNA, 19 nt, artificial
  Chemically synthesized
uucaaagguggagcgugaa

SEQ ID NO: 4178 - RNA, 19 nt, artificial
  Chemically synthesized
uguauaguggcagagaugu

SEQ ID NO: 4179 - RNA, 19 nt, artificial
  Chemically synthesized
uccuugcaggcuucugaau

SEQ ID NO: 4180 - RNA, 19 nt, artificial
  Chemically synthesized
gcaucucccggagcaaaac

SEQ ID NO: 4181 - RNA, 19 nt, artificial
  Chemically synthesized
cccaaauaaauacaaguuc

SEQ ID NO: 4182 - RNA, 19 nt, artificial
  Chemically synthesized
aaaugcccuuucugcaguu

SEQ ID NO: 4183 - RNA, 19 nt, artificial
  Chemically synthesized
cgcugaccacccucaacac

SEQ ID NO: 4184 - RNA, 19 nt, artificial
  Chemically synthesized
aaagcacuguguggcugaa

SEQ ID NO: 4185 - RNA, 19 nt, artificial
  Chemically synthesized
aauggugauugccugcuuu

SEQ ID NO: 4186 - RNA, 19 nt, artificial
  Chemically synthesized
ugagguccguuaggaaaaa

SEQ ID NO: 4187 - RNA, 19 nt, artificial
  Chemically synthesized
cuguguggcugaauaagcg

SEQ ID NO: 4188 - RNA, 19 nt, artificial
  Chemically synthesized
ggaccacagccugggcauc

SEQ ID NO: 4189 - RNA, 19 nt, artificial
  Chemically synthesized
acaaggaauugcccaaucu

SEQ ID NO: 4190 - RNA, 19 nt, artificial
  Chemically synthesized
agccugggcaucucccgga

SEQ ID NO: 4191 - RNA, 19 nt, artificial
  Chemically synthesized
uggacucgcaucccacuau

SEQ ID NO: 4192 - RNA, 19 nt, artificial
  Chemically synthesized
uugagugaaaccuugugaa

SEQ ID NO: 4193 - RNA, 19 nt, artificial
  Chemically synthesized
uugcacaacaacaacaaca

SEQ ID NO: 4194 - RNA, 19 nt, artificial
  Chemically synthesized
gaacgacugcuacuccaag

SEQ ID NO: 4195 - RNA, 19 nt, artificial
  Chemically synthesized
acacaagccuacugaaugc

SEQ ID NO: 4196 - RNA, 19 nt, artificial
  Chemically synthesized
cugcagaucgcccuggacu

SEQ ID NO: 4197 - RNA, 19 nt, artificial
  Chemically synthesized
ucaaagguggagcgugaau

SEQ ID NO: 4198 - RNA, 19 nt, artificial
  Chemically synthesized
uuucugcaguuggaagguu

SEQ ID NO: 4199 - RNA, 19 nt, artificial
  Chemically synthesized
ggaccugcagaucgcccug

SEQ ID NO: 4200 - RNA, 19 nt, artificial
  Chemically synthesized
cggccugagcuucagggca

SEQ ID NO: 4201 - RNA, 19 nt, artificial
  Chemically synthesized
uccuguccuugcaggcuuc

SEQ ID NO: 4202 - RNA, 19 nt, artificial
  Chemically synthesized
gagcgaaaacguuaaaauc

SEQ ID NO: 4203 - RNA, 19 nt, artificial
  Chemically synthesized
agcaugaaagccuucaguc

SEQ ID NO: 4204 - RNA, 19 nt, artificial
  Chemically synthesized
gcagcacgucaucgacuac

SEQ ID NO: 4205 - RNA, 19 nt, artificial
  Chemically synthesized
ucagucacuuaaaugaagu

SEQ ID NO: 4206 - RNA, 19 nt, artificial
  Chemically synthesized
aucuaagcagacuuugccu

SEQ ID NO: 4207 - RNA, 19 nt, artificial
  Chemically synthesized
ucuaagcagacuuugccuu

SEQ ID NO: 4208 - RNA, 19 nt, artificial
  Chemically synthesized
aaauccugcagcacgucau

SEQ ID NO: 4209 - RNA, 19 nt, artificial
  Chemically synthesized
guggcugaauaagcggugu

SEQ ID NO: 4210 - RNA, 19 nt, artificial
  Chemically synthesized
cugcagcacgucaucgacu

SEQ ID NO: 4211 - RNA, 19 nt, artificial
  Chemically synthesized
aacaugaacgacugcuacu

SEQ ID NO: 4212 - RNA, 19 nt, artificial
  Chemically synthesized
ggucucgccuucccucgcg

SEQ ID NO: 4213 - RNA, 19 nt, artificial
  Chemically synthesized
caacaugaacgacugcuac

SEQ ID NO: 4214 - RNA, 19 nt, artificial
  Chemically synthesized
gcguccaggacgccgcuga

SEQ ID NO: 4215 - RNA, 19 nt, artificial
  Chemically synthesized
ugaauaccagaaggaucca

SEQ ID NO: 4216 - RNA, 19 nt, artificial
  Chemically synthesized
cacuguguggcugaauaag

SEQ ID NO: 4217 - RNA, 19 nt, artificial
  Chemically synthesized
uccugcagcacgucaucga

SEQ ID NO: 4218 - RNA, 19 nt, artificial
  Chemically synthesized
aucccacuauugucagccu

SEQ ID NO: 4219 - RNA, 19 nt, artificial
  Chemically synthesized
agguccguuaggaaaaaca

SEQ ID NO: 4220 - RNA, 19 nt, artificial
  Chemically synthesized
ggacgacccgaugagccug

SEQ ID NO: 4221 - RNA, 19 nt, artificial
  Chemically synthesized
gaaauuaccuuuuugacac

SEQ ID NO: 4222 - RNA, 19 nt, artificial
  Chemically synthesized
caugaaagccuucaguccc

SEQ ID NO: 4223 - RNA, 19 nt, artificial
  Chemically synthesized
gcggucagcaugaaagccu

SEQ ID NO: 4224 - RNA, 19 nt, artificial
  Chemically synthesized
caaaaguguaaugauguac

SEQ ID NO: 4225 - RNA, 19 nt, artificial
  Chemically synthesized
gucaucgacuacaucuugg

SEQ ID NO: 4226 - RNA, 19 nt, artificial
  Chemically synthesized
ccugcagcacgucaucgac

SEQ ID NO: 4227 - RNA, 19 nt, artificial
  Chemically synthesized
gaaauccugcagcacguca

SEQ ID NO: 4228 - RNA, 19 nt, artificial
  Chemically synthesized
gaccacccucaacacggau

SEQ ID NO: 4229 - RNA, 19 nt, artificial
  Chemically synthesized
uugccugcuuuauuucaga

SEQ ID NO: 4230 - RNA, 19 nt, artificial
  Chemically synthesized
cacaagccuacugaaugcu

SEQ ID NO: 4231 - RNA, 19 nt, artificial
  Chemically synthesized
augucaaaugacagcaaag

SEQ ID NO: 4232 - RNA, 19 nt, artificial
  Chemically synthesized
aacagccugucggaccaca

SEQ ID NO: 4233 - RNA, 19 nt, artificial
  Chemically synthesized
ggacgccgcugaccacccu

SEQ ID NO: 4234 - RNA, 19 nt, artificial
  Chemically synthesized
cgccuucccucgcggucag

SEQ ID NO: 4235 - RNA, 19 nt, artificial
  Chemically synthesized
aucuuuuaagugcugaacu

SEQ ID NO: 4236 - RNA, 19 nt, artificial
  Chemically synthesized
aguguguuuauugaauggu

SEQ ID NO: 4237 - RNA, 19 nt, artificial
  Chemically synthesized
cugcaguuggaagguuuuc

SEQ ID NO: 4238 - RNA, 19 nt, artificial
  Chemically synthesized
cagucacuuaaaugaaguc

SEQ ID NO: 4239 - RNA, 19 nt, artificial
  Chemically synthesized
cuuuauauacuauucccac

SEQ ID NO: 4240 - RNA, 19 nt, artificial
  Chemically synthesized
gccgcugaccacccucaac

SEQ ID NO: 4241 - RNA, 19 nt, artificial
  Chemically synthesized
uaagcagacuuugccuuuu

SEQ ID NO: 4242 - RNA, 19 nt, artificial
  Chemically synthesized
guguggcugaauaagcggu

SEQ ID NO: 4243 - RNA, 19 nt, artificial
  Chemically synthesized
agacuuuuaaaugcccuuu

SEQ ID NO: 4244 - RNA, 19 nt, artificial
  Chemically synthesized
cuuuuugacacaagccuac

SEQ ID NO: 4245 - RNA, 19 nt, artificial
  Chemically synthesized
acuaagaaugaucaucuuc

SEQ ID NO: 4246 - RNA, 19 nt, artificial
  Chemically synthesized
gcagacuuugccuuuuuuc

SEQ ID NO: 4247 - RNA, 19 nt, artificial
  Chemically synthesized
uauauacuauucccaccau

SEQ ID NO: 4248 - RNA, 19 nt, artificial
  Chemically synthesized
agaaugaucaucuucccag

SEQ ID NO: 4249 - RNA, 19 nt, artificial
  Chemically synthesized
gagcaagauggaaauccug

SEQ ID NO: 4250 - RNA, 19 nt, artificial
  Chemically synthesized
aaagguggagcgugaauac

SEQ ID NO: 4251 - RNA, 19 nt, artificial
  Chemically synthesized
ugcagaucgcccuggacuc

SEQ ID NO: 4252 - RNA, 19 nt, artificial
  Chemically synthesized
gccugagcuucagggcagc

SEQ ID NO: 4253 - RNA, 19 nt, artificial
  Chemically synthesized
cagaaccaggcguccagga

SEQ ID NO: 4254 - RNA, 19 nt, artificial
  Chemically synthesized
augaagucuuuuggucaga

SEQ ID NO: 4255 - RNA, 19 nt, artificial
  Chemically synthesized
ucgccuucccucgcgguca

SEQ ID NO: 4256 - RNA, 19 nt, artificial
  Chemically synthesized
gcuauguuauaacugaacc

SEQ ID NO: 4257 - RNA, 19 nt, artificial
  Chemically synthesized
aagaaugaucaucuuccca

SEQ ID NO: 4258 - RNA, 19 nt, artificial
  Chemically synthesized
gacuacaucuuggaccugc

SEQ ID NO: 4259 - RNA, 19 nt, artificial
  Chemically synthesized
gcagcuagcucagcaggcg

SEQ ID NO: 4260 - RNA, 19 nt, artificial
  Chemically synthesized
uuggucagaaauuaccuuu

SEQ ID NO: 4261 - RNA, 19 nt, artificial
  Chemically synthesized
aaguguguuuauugaaugg

SEQ ID NO: 4262 - RNA, 19 nt, artificial
  Chemically synthesized
agcgcagcuagcucagcag

SEQ ID NO: 4263 - RNA, 19 nt, artificial
  Chemically synthesized
agcaaagcacuguguggcu

SEQ ID NO: 4264 - RNA, 19 nt, artificial
  Chemically synthesized
agucccgugagguccguua

SEQ ID NO: 4265 - RNA, 19 nt, artificial
  Chemically synthesized
ggaaauccugcagcacguc

SEQ ID NO: 4266 - RNA, 19 nt, artificial
  Chemically synthesized
aauaccagaaggauccagu

SEQ ID NO: 4267 - RNA, 19 nt, artificial
  Chemically synthesized
cacaaggaauugcccaauc

SEQ ID NO: 4268 - RNA, 19 nt, artificial
  Chemically synthesized
ggugagcaagauggaaauc

SEQ ID NO: 4269 - RNA, 19 nt, artificial
  Chemically synthesized
accuuuuugacacaagccu

SEQ ID NO: 4270 - RNA, 19 nt, artificial
  Chemically synthesized
ugccuuuuuucaaaggugg

SEQ ID NO: 4271 - RNA, 19 nt, artificial
  Chemically synthesized
aguuaaugucaaaugacag

SEQ ID NO: 4272 - RNA, 19 nt, artificial
  Chemically synthesized
uuguauaguggcagagaug

SEQ ID NO: 4273 - RNA, 19 nt, artificial
  Chemically synthesized
guuaggaaaaacagccugu

SEQ ID NO: 4274 - RNA, 19 nt, artificial
  Chemically synthesized
ugcuauguuauaacugaac

SEQ ID NO: 4275 - RNA, 19 nt, artificial
  Chemically synthesized
ccuucagucccgugagguc

SEQ ID NO: 4276 - RNA, 19 nt, artificial
  Chemically synthesized
gugccaagcgcagcuagcu

SEQ ID NO: 4277 - RNA, 19 nt, artificial
  Chemically synthesized
ccagaacaagaaggugagc

SEQ ID NO: 4278 - RNA, 19 nt, artificial
  Chemically synthesized
gguccguuaggaaaaacag

SEQ ID NO: 4279 - RNA, 19 nt, artificial
  Chemically synthesized
auuucagaggaccagugcu

SEQ ID NO: 4280 - RNA, 19 nt, artificial
  Chemically synthesized
caucuuggaccugcagauc

SEQ ID NO: 4281 - RNA, 19 nt, artificial
  Chemically synthesized
cugcuacuccaagcucaag

SEQ ID NO: 4282 - RNA, 19 nt, artificial
  Chemically synthesized
cugagcuucagggcagcca

SEQ ID NO: 4283 - RNA, 19 nt, artificial
  Chemically synthesized
ccaagcgcagcuagcucag

SEQ ID NO: 4284 - RNA, 19 nt, artificial
  Chemically synthesized
ugagcuucagggcagccag

SEQ ID NO: 4285 - RNA, 19 nt, artificial
  Chemically synthesized
acgccgcugaccacccuca

SEQ ID NO: 4286 - RNA, 19 nt, artificial
  Chemically synthesized
agccuucagucccgugagg

SEQ ID NO: 4287 - RNA, 19 nt, artificial
  Chemically synthesized
ccguuaggaaaaacagccu

SEQ ID NO: 4288 - RNA, 19 nt, artificial
  Chemically synthesized
aggcuucugaauucccuuc

SEQ ID NO: 4289 - RNA, 19 nt, artificial
  Chemically synthesized
aauucccuucugaguuaau

SEQ ID NO: 4290 - RNA, 19 nt, artificial
  Chemically synthesized
acaugaacgacugcuacuc

SEQ ID NO: 4291 - RNA, 19 nt, artificial
  Chemically synthesized
ugaguuaaugucaaaugac

SEQ ID NO: 4292 - RNA, 19 nt, artificial
  Chemically synthesized
aagccuacugaaugcugug

SEQ ID NO: 4293 - RNA, 19 nt, artificial
  Chemically synthesized
ccuucccucgcggucagca

SEQ ID NO: 4294 - RNA, 19 nt, artificial
  Chemically synthesized
guacuuauucaugcuaaac

SEQ ID NO: 4295 - RNA, 19 nt, artificial
  Chemically synthesized
gccuucagucccgugaggu

SEQ ID NO: 4296 - RNA, 19 nt, artificial
  Chemically synthesized
aagcgcagcuagcucagca

SEQ ID NO: 4297 - RNA, 19 nt, artificial
  Chemically synthesized
uacaucuuggaccugcaga

SEQ ID NO: 4298 - RNA, 19 nt, artificial
  Chemically synthesized
cccuggacucgcaucccac

SEQ ID NO: 4299 - RNA, 19 nt, artificial
  Chemically synthesized
ugaaaccuugugaacucuu

SEQ ID NO: 4300 - RNA, 19 nt, artificial
  Chemically synthesized
cagccagcucccucccggu

SEQ ID NO: 4301 - RNA, 19 nt, artificial
  Chemically synthesized
acgacugcuacuccaagcu

SEQ ID NO: 4302 - RNA, 19 nt, artificial
  Chemically synthesized
uucagucacuuaaaugaag

SEQ ID NO: 4303 - RNA, 19 nt, artificial
  Chemically synthesized
uaagaaugaucaucuuccc

SEQ ID NO: 4304 - RNA, 19 nt, artificial
  Chemically synthesized
acugaacccaaauaaauac

SEQ ID NO: 4305 - RNA, 19 nt, artificial
  Chemically synthesized
ccugcagaucgcccuggac

SEQ ID NO: 4306 - RNA, 19 nt, artificial
  Chemically synthesized
ucacaaggaauugcccaau

SEQ ID NO: 4307 - RNA, 19 nt, artificial
  Chemically synthesized
aaagccuucagucccguga

SEQ ID NO: 4308 - RNA, 19 nt, artificial
  Chemically synthesized
gcuagcucagcaggcggca

SEQ ID NO: 4309 - RNA, 19 nt, artificial
  Chemically synthesized
uggacgacccgaugagccu

SEQ ID NO: 4310 - RNA, 19 nt, artificial
  Chemically synthesized
acuuuuaaaugcccuuucu

SEQ ID NO: 4311 - RNA, 19 nt, artificial
  Chemically synthesized
ccuuuuuucaaagguggag

SEQ ID NO: 4312 - RNA, 19 nt, artificial
  Chemically synthesized
auauacuauucccaccaug

SEQ ID NO: 4313 - RNA, 19 nt, artificial
  Chemically synthesized
gcuucagggcagccagcuc

SEQ ID NO: 4314 - RNA, 19 nt, artificial
  Chemically synthesized
gcaucccacuauugucagc

SEQ ID NO: 4315 - RNA, 19 nt, artificial
  Chemically synthesized
uuucagaggaccagugcuu

SEQ ID NO: 4316 - RNA, 19 nt, artificial
  Chemically synthesized
ccuguccuugcaggcuucu

SEQ ID NO: 4317 - RNA, 19 nt, artificial
  Chemically synthesized
uggaccugcagaucgcccu

SEQ ID NO: 4318 - RNA, 19 nt, artificial
  Chemically synthesized
uucagaggaccagugcuuu

SEQ ID NO: 4319 - RNA, 19 nt, artificial
  Chemically synthesized
gccugcuuuauuucagagg

SEQ ID NO: 4320 - RNA, 19 nt, artificial
  Chemically synthesized
uuauauacuauucccacca

SEQ ID NO: 4321 - RNA, 19 nt, artificial
  Chemically synthesized
auugaauggugauugccug

SEQ ID NO: 4322 - RNA, 19 nt, artificial
  Chemically synthesized
ugcuuuauuucagaggacc

SEQ ID NO: 4323 - RNA, 19 nt, artificial
  Chemically synthesized
cagaaauuaccuuuuugac

SEQ ID NO: 4324 - RNA, 19 nt, artificial
  Chemically synthesized
ucuuuuggucagaaauuac

SEQ ID NO: 4325 - RNA, 19 nt, artificial
  Chemically synthesized
ccugucggaccacagccug

SEQ ID NO: 4326 - RNA, 19 nt, artificial
  Chemically synthesized
gccugggcaucucccggag

SEQ ID NO: 4327 - RNA, 19 nt, artificial
  Chemically synthesized
uauaguggcagagaugucu

SEQ ID NO: 4328 - RNA, 19 nt, artificial
  Chemically synthesized
ugagugaaaccuugugaac

SEQ ID NO: 4329 - RNA, 19 nt, artificial
  Chemically synthesized
gagcuucagggcagccagc

SEQ ID NO: 4330 - RNA, 19 nt, artificial
  Chemically synthesized
uucaaccauuucacaagga

SEQ ID NO: 4331 - RNA, 19 nt, artificial
  Chemically synthesized
uuuggucagaaauuaccuu

SEQ ID NO: 4332 - RNA, 19 nt, artificial
  Chemically synthesized
ucccucgcggucagcauga

SEQ ID NO: 4333 - RNA, 19 nt, artificial
  Chemically synthesized
gaaccaggcguccaggacg

SEQ ID NO: 4334 - RNA, 19 nt, artificial
  Chemically synthesized
ucaucuucccaggguguuc

SEQ ID NO: 4335 - RNA, 19 nt, artificial
  Chemically synthesized
augauguacuuauucaugc

SEQ ID NO: 4336 - RNA, 19 nt, artificial
  Chemically synthesized
cuacaucuuggaccugcag

SEQ ID NO: 4337 - RNA, 19 nt, artificial
  Chemically synthesized
cagccugucggaccacagc

SEQ ID NO: 4338 - RNA, 19 nt, artificial
  Chemically synthesized
aagaaggugagcaagaugg

SEQ ID NO: 4339 - RNA, 19 nt, artificial
  Chemically synthesized
uucccuucugaguuaaugu

SEQ ID NO: 4340 - RNA, 19 nt, artificial
  Chemically synthesized
ggugccaagcgcagcuagc

SEQ ID NO: 4341 - RNA, 19 nt, artificial
  Chemically synthesized
acucgcaucccacuauugu

SEQ ID NO: 4342 - RNA, 19 nt, artificial
  Chemically synthesized
aacguuaaaaucacaagga

SEQ ID NO: 4343 - RNA, 19 nt, artificial
  Chemically synthesized
ucacaaggaggacaaguug

SEQ ID NO: 4344 - RNA, 19 nt, artificial
  Chemically synthesized
cucgcggucagcaugaaag

SEQ ID NO: 4345 - RNA, 19 nt, artificial
  Chemically synthesized
cccucccggucucgccuuc

SEQ ID NO: 4346 - RNA, 19 nt, artificial
  Chemically synthesized
ugacagcaaagcacugugu

SEQ ID NO: 4347 - RNA, 19 nt, artificial
  Chemically synthesized
cgacuacaucuuggaccug

SEQ ID NO: 4348 - RNA, 19 nt, artificial
  Chemically synthesized
uucuuugcacaacaacaac

SEQ ID NO: 4349 - RNA, 19 nt, artificial
  Chemically synthesized
uuuauuucagaggaccagu

SEQ ID NO: 4350 - RNA, 19 nt, artificial
  Chemically synthesized
gcagaucgcccuggacucg

SEQ ID NO: 4351 - RNA, 19 nt, artificial
  Chemically synthesized
aucaucuucccaggguguu

SEQ ID NO: 4352 - RNA, 19 nt, artificial
  Chemically synthesized
uuugacacaagccuacuga

SEQ ID NO: 4353 - RNA, 19 nt, artificial
  Chemically synthesized
cuauguuauaacugaaccc

SEQ ID NO: 4354 - RNA, 19 nt, artificial
  Chemically synthesized
cuuuauuucagaggaccag

SEQ ID NO: 4355 - RNA, 19 nt, artificial
  Chemically synthesized
caugaacgacugcuacucc

SEQ ID NO: 4356 - RNA, 19 nt, artificial
  Chemically synthesized
gaucgcccuggacucgcau

SEQ ID NO: 4357 - RNA, 19 nt, artificial
  Chemically synthesized
ugauugccugcuuuauuuc

SEQ ID NO: 4358 - RNA, 19 nt, artificial
  Chemically synthesized
aagccuucagucccgugag

SEQ ID NO: 4359 - RNA, 19 nt, artificial
  Chemically synthesized
ucuuggaccugcagaucgc

SEQ ID NO: 4360 - RNA, 19 nt, artificial
  Chemically synthesized
cagucccgugagguccguu

SEQ ID NO: 4361 - RNA, 19 nt, artificial
  Chemically synthesized
ucugaguuaaugucaaaug

SEQ ID NO: 4362 - RNA, 19 nt, artificial
  Chemically synthesized
uauugaauggugauugccu

SEQ ID NO: 4363 - RNA, 19 nt, artificial
  Chemically synthesized
auuucacaaggaggacaag

SEQ ID NO: 4364 - RNA, 19 nt, artificial
  Chemically synthesized
accacagccugggcaucuc

SEQ ID NO: 4365 - RNA, 19 nt, artificial
  Chemically synthesized
ccggucucgccuucccucg

SEQ ID NO: 4366 - RNA, 19 nt, artificial
  Chemically synthesized
acuguguggcugaauaagc

SEQ ID NO: 4367 - RNA, 19 nt, artificial
  Chemically synthesized
acagccugucggaccacag

SEQ ID NO: 4368 - RNA, 19 nt, artificial
  Chemically synthesized
cugucggaccacagccugg

SEQ ID NO: 4369 - RNA, 19 nt, artificial
  Chemically synthesized
gcugaccacccucaacacg

SEQ ID NO: 4370 - RNA, 19 nt, artificial
  Chemically synthesized
agggcagccagcucccucc

SEQ ID NO: 4371 - RNA, 19 nt, artificial
  Chemically synthesized
gcgcagcuagcucagcagg

SEQ ID NO: 4372 - RNA, 19 nt, artificial
  Chemically synthesized
agucacuuaaaugaagucu

SEQ ID NO: 4373 - RNA, 19 nt, artificial
  Chemically synthesized
ccaggacgccgcugaccac

SEQ ID NO: 4374 - RNA, 19 nt, artificial
  Chemically synthesized
gcggcggccugagcuucag

SEQ ID NO: 4375 - RNA, 19 nt, artificial
  Chemically synthesized
aaugaagucuuuuggucag

SEQ ID NO: 4376 - RNA, 19 nt, artificial
  Chemically synthesized
agcuucagggcagccagcu

SEQ ID NO: 4377 - RNA, 19 nt, artificial
  Chemically synthesized
cccgugagguccguuagga

SEQ ID NO: 4378 - RNA, 19 nt, artificial
  Chemically synthesized
gauggaaauccugcagcac

SEQ ID NO: 4379 - RNA, 19 nt, artificial
  Chemically synthesized
acuuugccuuuuuucaaag

SEQ ID NO: 4380 - RNA, 19 nt, artificial
  Chemically synthesized
augaucaucuucccagggu

SEQ ID NO: 4381 - RNA, 19 nt, artificial
  Chemically synthesized
gucucgccuucccucgcgg

SEQ ID NO: 4382 - RNA, 19 nt, artificial
  Chemically synthesized
cgacugcuacuccaagcuc

SEQ ID NO: 4383 - RNA, 19 nt, artificial
  Chemically synthesized
uuucaaccauuucacaagg

SEQ ID NO: 4384 - RNA, 19 nt, artificial
  Chemically synthesized
aaucacaaggaauugccca

SEQ ID NO: 4385 - RNA, 19 nt, artificial
  Chemically synthesized
aucuuggaccugcagaucg

SEQ ID NO: 4386 - RNA, 19 nt, artificial
  Chemically synthesized
augaaagccuucagucccg

SEQ ID NO: 4387 - RNA, 19 nt, artificial
  Chemically synthesized
gcagaaccaggcguccagg

SEQ ID NO: 4388 - RNA, 19 nt, artificial
  Chemically synthesized
gacuuuuaaaugcccuuuc

SEQ ID NO: 4389 - RNA, 19 nt, artificial
  Chemically synthesized
gaaaaacagccugucggac

SEQ ID NO: 4390 - RNA, 19 nt, artificial
  Chemically synthesized
gccagcucccucccggucu

SEQ ID NO: 4391 - RNA, 19 nt, artificial
  Chemically synthesized
aaggauccaguauucaguc

SEQ ID NO: 4392 - RNA, 19 nt, artificial
  Chemically synthesized
caucgacuacaucuuggac

SEQ ID NO: 4393 - RNA, 19 nt, artificial
  Chemically synthesized
ucagcaugaaagccuucag

SEQ ID NO: 4394 - RNA, 19 nt, artificial
  Chemically synthesized
aagcacuguguggcugaau

SEQ ID NO: 4395 - RNA, 19 nt, artificial
  Chemically synthesized
aagacuuuuaaaugcccuu

SEQ ID NO: 4396 - RNA, 19 nt, artificial
  Chemically synthesized
agccugucggaccacagcc

SEQ ID NO: 4397 - RNA, 19 nt, artificial
  Chemically synthesized
cauccuguccuugcaggcu

SEQ ID NO: 4398 - RNA, 19 nt, artificial
  Chemically synthesized
gaauaccagaaggauccag

SEQ ID NO: 4399 - RNA, 19 nt, artificial
  Chemically synthesized
ugaaagccuucagucccgu

SEQ ID NO: 4400 - RNA, 19 nt, artificial
  Chemically synthesized
ugcuacuccaagcucaagg

SEQ ID NO: 4401 - RNA, 19 nt, artificial
  Chemically synthesized
uuugagugaaaccuuguga

SEQ ID NO: 4402 - RNA, 19 nt, artificial
  Chemically synthesized
gcaaagcacuguguggcug

SEQ ID NO: 4403 - RNA, 19 nt, artificial
  Chemically synthesized
cuuuuuucaaagguggagc

SEQ ID NO: 4404 - RNA, 19 nt, artificial
  Chemically synthesized
acaagccuacugaaugcug

SEQ ID NO: 4405 - RNA, 19 nt, artificial
  Chemically synthesized
cgcaucccacuauugucag

SEQ ID NO: 4406 - RNA, 19 nt, artificial
  Chemically synthesized
uucugaauucccuucugag

SEQ ID NO: 4407 - RNA, 19 nt, artificial
  Chemically synthesized
gaaagccuucagucccgug

SEQ ID NO: 4408 - RNA, 19 nt, artificial
  Chemically synthesized
auggaaauccugcagcacg

SEQ ID NO: 4409 - RNA, 19 nt, artificial
  Chemically synthesized
ccacagccugggcaucucc

SEQ ID NO: 4410 - RNA, 19 nt, artificial
  Chemically synthesized
ccagcucccucccggucuc

SEQ ID NO: 4411 - RNA, 19 nt, artificial
  Chemically synthesized
auuaccuuuuugacacaag

SEQ ID NO: 4412 - RNA, 19 nt, artificial
  Chemically synthesized
uauguuauaacugaaccca

SEQ ID NO: 4413 - RNA, 19 nt, artificial
  Chemically synthesized
uugccuuuuuucaaaggug

SEQ ID NO: 4414 - RNA, 19 nt, artificial
  Chemically synthesized
cuuugccuuuuuucaaagg

SEQ ID NO: 4415 - RNA, 19 nt, artificial
  Chemically synthesized
accauuucacaaggaggac

SEQ ID NO: 4416 - RNA, 19 nt, artificial
  Chemically synthesized
ugccugcuuuauuucagag

SEQ ID NO: 4417 - RNA, 19 nt, artificial
  Chemically synthesized
aacgacugcuacuccaagc

SEQ ID NO: 4418 - RNA, 19 nt, artificial
  Chemically synthesized
cuuuuggucagaaauuacc

SEQ ID NO: 4419 - RNA, 19 nt, artificial
  Chemically synthesized
cccggucucgccuucccuc

SEQ ID NO: 4420 - RNA, 19 nt, artificial
  Chemically synthesized
cuguccuugcaggcuucug

SEQ ID NO: 4421 - RNA, 19 nt, artificial
  Chemically synthesized
uuugcacaacaacaacaac

SEQ ID NO: 4422 - RNA, 19 nt, artificial
  Chemically synthesized
aggaaaaacagccugucgg

SEQ ID NO: 4423 - RNA, 19 nt, artificial
  Chemically synthesized
ucagaggaccagugcuuug

SEQ ID NO: 4424 - RNA, 19 nt, artificial
  Chemically synthesized
uaguuguaaacuuaacccu

SEQ ID NO: 4425 - RNA, 19 nt, artificial
  Chemically synthesized
agcauccuguccuugcagg

SEQ ID NO: 4426 - RNA, 19 nt, artificial
  Chemically synthesized
acagcaaagcacugugugg

SEQ ID NO: 4427 - RNA, 19 nt, artificial
  Chemically synthesized
uccaggacgccgcugacca

SEQ ID NO: 4428 - RNA, 19 nt, artificial
  Chemically synthesized
ucaaccauuucacaaggag

SEQ ID NO: 4429 - RNA, 19 nt, artificial
  Chemically synthesized
cagcauccuguccuugcag

SEQ ID NO: 4430 - RNA, 19 nt, artificial
  Chemically synthesized
guccguuaggaaaaacagc

SEQ ID NO: 4431 - RNA, 19 nt, artificial
  Chemically synthesized
gacagcaaagcacugugug

SEQ ID NO: 4432 - RNA, 19 nt, artificial
  Chemically synthesized
uuuucaaccauuucacaag

SEQ ID NO: 4433 - RNA, 19 nt, artificial
  Chemically synthesized
uaaaugcccuuucugcagu

SEQ ID NO: 4434 - RNA, 19 nt, artificial
  Chemically synthesized
ucccacuauugucagccug

SEQ ID NO: 4435 - RNA, 19 nt, artificial
  Chemically synthesized
uuuaaaugcccuuucugca

SEQ ID NO: 4436 - RNA, 19 nt, artificial
  Chemically synthesized
uuuauauacuauucccacc

SEQ ID NO: 4437 - RNA, 19 nt, artificial
  Chemically synthesized
uuucacaaggaggacaagu

SEQ ID NO: 4438 - RNA, 19 nt, artificial
  Chemically synthesized
caagauggaaauccugcag

SEQ ID NO: 4439 - RNA, 19 nt, artificial
  Chemically synthesized
gcauccuguccuugcaggc

SEQ ID NO: 4440 - RNA, 19 nt, artificial
  Chemically synthesized
uuuucaaagguggagcgug

SEQ ID NO: 4441 - RNA, 19 nt, artificial
  Chemically synthesized
aguuuucuuguauaguggc

SEQ ID NO: 4442 - RNA, 19 nt, artificial
  Chemically synthesized
aauccugcagcacgucauc

SEQ ID NO: 4443 - RNA, 19 nt, artificial
  Chemically synthesized
cuucagggcagccagcucc

SEQ ID NO: 4444 - RNA, 19 nt, artificial
  Chemically synthesized
cucccucccggucucgccu

SEQ ID NO: 4445 - RNA, 19 nt, artificial
  Chemically synthesized
agcaagauggaaauccugc

SEQ ID NO: 4446 - RNA, 19 nt, artificial
  Chemically synthesized
uuuauugaauggugauugc

SEQ ID NO: 4447 - RNA, 19 nt, artificial
  Chemically synthesized
ucggaccacagccugggca

SEQ ID NO: 4448 - RNA, 19 nt, artificial
  Chemically synthesized
cagcuagcucagcaggcgg

SEQ ID NO: 4449 - RNA, 19 nt, artificial
  Chemically synthesized
cgcagcuagcucagcaggc

SEQ ID NO: 4450 - RNA, 19 nt, artificial
  Chemically synthesized
aaucuaagcagacuuugcc

SEQ ID NO: 4451 - RNA, 19 nt, artificial
  Chemically synthesized
cgggcagaaccaggcgucc

SEQ ID NO: 4452 - RNA, 19 nt, artificial
  Chemically synthesized
uuauuucagaggaccagug

SEQ ID NO: 4453 - RNA, 19 nt, artificial
  Chemically synthesized
auugccugcuuuauuucag

SEQ ID NO: 4454 - RNA, 19 nt, artificial
  Chemically synthesized
uauacuauucccaccaugg

SEQ ID NO: 4455 - RNA, 19 nt, artificial
  Chemically synthesized
uuaaugucaaaugacagca

SEQ ID NO: 4456 - RNA, 19 nt, artificial
  Chemically synthesized
cguccaggacgccgcugac

SEQ ID NO: 4457 - RNA, 19 nt, artificial
  Chemically synthesized
gucggaccacagccugggc

SEQ ID NO: 4458 - RNA, 19 nt, artificial
  Chemically synthesized
cugaccacccucaacacgg

SEQ ID NO: 4459 - RNA, 19 nt, artificial
  Chemically synthesized
ucccucccggucucgccuu

SEQ ID NO: 4460 - RNA, 19 nt, artificial
  Chemically synthesized
uacaacaugaacgacugcu

SEQ ID NO: 4461 - RNA, 19 nt, artificial
  Chemically synthesized
cggucucgccuucccucgc

SEQ ID NO: 4462 - RNA, 19 nt, artificial
  Chemically synthesized
aaaugacagcaaagcacug

SEQ ID NO: 4463 - RNA, 19 nt, artificial
  Chemically synthesized
guggacgacccgaugagcc

SEQ ID NO: 4464 - RNA, 19 nt, artificial
  Chemically synthesized
cuacuccaagcucaaggag

SEQ ID NO: 4465 - RNA, 19 nt, artificial
  Chemically synthesized
cuuaaaugaagucuuuugg

SEQ ID NO: 4466 - RNA, 19 nt, artificial
  Chemically synthesized
auucccuucugaguuaaug

SEQ ID NO: 4467 - RNA, 19 nt, artificial
  Chemically synthesized
aauugcccaaucuaagcag

SEQ ID NO: 4468 - RNA, 19 nt, artificial
  Chemically synthesized
guuaaugucaaaugacagc

SEQ ID NO: 4469 - RNA, 19 nt, artificial
  Chemically synthesized
cuuuuaaaugcccuuucug

SEQ ID NO: 4470 - RNA, 19 nt, artificial
  Chemically synthesized
cguuaggaaaaacagccug

SEQ ID NO: 4471 - RNA, 19 nt, artificial
  Chemically synthesized
ucuucccaggguguucucu

SEQ ID NO: 4472 - RNA, 19 nt, artificial
  Chemically synthesized
agaaccaggcguccaggac

SEQ ID NO: 4473 - RNA, 19 nt, artificial
  Chemically synthesized
uugcccaaucuaagcagac

SEQ ID NO: 4474 - RNA, 19 nt, artificial
  Chemically synthesized
gucccgugagguccguuag

SEQ ID NO: 4475 - RNA, 19 nt, artificial
  Chemically synthesized
aggcguccaggacgccgcu

SEQ ID NO: 4476 - RNA, 19 nt, artificial
  Chemically synthesized
ugucaaaugacagcaaagc

SEQ ID NO: 4477 - RNA, 19 nt, artificial
  Chemically synthesized
caucucccggagcaaaacc

SEQ ID NO: 4478 - RNA, 19 nt, artificial
  Chemically synthesized
aucuucccaggguguucuc

SEQ ID NO: 4479 - RNA, 19 nt, artificial
  Chemically synthesized
augcccuuucugcaguugg

SEQ ID NO: 4480 - RNA, 19 nt, artificial
  Chemically synthesized
uuuuggucagaaauuaccu

SEQ ID NO: 4481 - RNA, 19 nt, artificial
  Chemically synthesized
ucaaaugacagcaaagcac

SEQ ID NO: 4482 - RNA, 19 nt, artificial
  Chemically synthesized
gacgccgcugaccacccuc

SEQ ID NO: 4483 - RNA, 19 nt, artificial
  Chemically synthesized
cagggcagccagcucccuc

SEQ ID NO: 4484 - RNA, 19 nt, artificial
  Chemically synthesized
gugagcaagauggaaaucc

SEQ ID NO: 4485 - RNA, 19 nt, artificial
  Chemically synthesized
agcuagcucagcaggcggc

SEQ ID NO: 4486 - RNA, 19 nt, artificial
  Chemically synthesized
aaaaacagccugucggacc

SEQ ID NO: 4487 - RNA, 19 nt, artificial
  Chemically synthesized
aaucuuuuaagugcugaac

SEQ ID NO: 4488 - RNA, 19 nt, artificial
  Chemically synthesized
uuuuugacacaagccuacu

SEQ ID NO: 4489 - RNA, 19 nt, artificial
  Chemically synthesized
aaugcccuuucugcaguug

SEQ ID NO: 4490 - RNA, 19 nt, artificial
  Chemically synthesized
cagcaaagcacuguguggc

SEQ ID NO: 4491 - RNA, 19 nt, artificial
  Chemically synthesized
auacaacaugaacgacugc

SEQ ID NO: 4492 - RNA, 19 nt, artificial
  Chemically synthesized
gagguccguuaggaaaaac

SEQ ID NO: 4493 - RNA, 19 nt, artificial
  Chemically synthesized
uaggaaaaacagccugucg

SEQ ID NO: 4494 - RNA, 19 nt, artificial
  Chemically synthesized
cuuggaccugcagaucgcc

SEQ ID NO: 4495 - RNA, 19 nt, artificial
  Chemically synthesized
cgcggucagcaugaaagcc

SEQ ID NO: 4496 - RNA, 19 nt, artificial
  Chemically synthesized
cuucagucccgugaggucc

SEQ ID NO: 4497 - RNA, 19 nt, artificial
  Chemically synthesized
acgacccgaugagccugcu

SEQ ID NO: 4498 - RNA, 19 nt, artificial
  Chemically synthesized
ucccuucugaguuaauguc

SEQ ID NO: 4499 - RNA, 19 nt, artificial
  Chemically synthesized
uuaccuuuuugacacaagc

SEQ ID NO: 4500 - RNA, 19 nt, artificial
  Chemically synthesized
augacagcaaagcacugug

SEQ ID NO: 4501 - RNA, 19 nt, artificial
  Chemically synthesized
gaccugcagaucgcccugg

SEQ ID NO: 4502 - RNA, 19 nt, artificial
  Chemically synthesized
ugcaggcuucugaauuccc

SEQ ID NO: 4503 - RNA, 19 nt, artificial
  Chemically synthesized
uuugccuuuuuucaaaggu

SEQ ID NO: 4504 - RNA, 19 nt, artificial
  Chemically synthesized
cgcccuggacucgcauccc

SEQ ID NO: 4505 - RNA, 19 nt, artificial
  Chemically synthesized
gccuucccucgcggucagc

SEQ ID NO: 4506 - RNA, 19 nt, artificial
  Chemically synthesized
uguguggcugaauaagcgg

SEQ ID NO: 4507 - RNA, 19 nt, artificial
  Chemically synthesized
cucccggucucgccuuccc

SEQ ID NO: 4508 - RNA, 19 nt, artificial
  Chemically synthesized
aucagcauccuguccuugc

SEQ ID NO: 4509 - RNA, 19 nt, artificial
  Chemically synthesized
ucucgccuucccucgcggu

SEQ ID NO: 4510 - RNA, 19 nt, artificial
  Chemically synthesized
aaacguuaaaaucacaagg

SEQ ID NO: 4511 - RNA, 19 nt, artificial
  Chemically synthesized
ccugggcaucucccggagc

SEQ ID NO: 4512 - RNA, 19 nt, artificial
  Chemically synthesized
ggcggccugagcuucaggg

SEQ ID NO: 4513 - RNA, 19 nt, artificial
  Chemically synthesized
ugccaagcgcagcuagcuc

SEQ ID NO: 4514 - RNA, 19 nt, artificial
  Chemically synthesized
uaccuuuuugacacaagcc

SEQ ID NO: 4515 - RNA, 19 nt, artificial
  Chemically synthesized
aucgacuacaucuuggacc

SEQ ID NO: 4516 - RNA, 19 nt, artificial
  Chemically synthesized
cucgccuucccucgcgguc

SEQ ID NO: 4517 - RNA, 19 nt, artificial
  Chemically synthesized
aucgcccuggacucgcauc

SEQ ID NO: 4518 - RNA, 19 nt, artificial
  Chemically synthesized
ccugagcuucagggcagcc

SEQ ID NO: 4519 - RNA, 19 nt, artificial
  Chemically synthesized
aaugacagcaaagcacugu

SEQ ID NO: 4520 - RNA, 19 nt, artificial
  Chemically synthesized
uucccucgcggucagcaug

SEQ ID NO: 4521 - RNA, 19 nt, artificial
  Chemically synthesized
ccucccggucucgccuucc

SEQ ID NO: 4522 - RNA, 19 nt, artificial
  Chemically synthesized
gacgacccgaugagccugc

SEQ ID NO: 4523 - RNA, 19 nt, artificial
  Chemically synthesized
ucccggucucgccuucccu

SEQ ID NO: 4524 - RNA, 19 nt, artificial
  Chemically synthesized
uuuuuucaaagguggagcg

SEQ ID NO: 4525 - RNA, 19 nt, artificial
  Chemically synthesized
caagcgcagcuagcucagc

SEQ ID NO: 4526 - RNA, 19 nt, artificial
  Chemically synthesized
aaagacuuuuaaaugcccu

SEQ ID NO: 4527 - RNA, 19 nt, artificial
  Chemically synthesized
ugaauggugauugccugcu

SEQ ID NO: 4528 - RNA, 19 nt, artificial
  Chemically synthesized
uguggcugaauaagcggug

SEQ ID NO: 4529 - RNA, 19 nt, artificial
  Chemically synthesized
auacuauucccaccauggg

SEQ ID NO: 4530 - RNA, 19 nt, artificial
  Chemically synthesized
aagguggagcgugaauacc

SEQ ID NO: 4531 - RNA, 19 nt, artificial
  Chemically synthesized
cacagccugggcaucuccc

SEQ ID NO: 4532 - RNA, 19 nt, artificial
  Chemically synthesized
cagccugggcaucucccgg

SEQ ID NO: 4533 - RNA, 19 nt, artificial
  Chemically synthesized
uugcaggcuucugaauucc

SEQ ID NO: 4534 - RNA, 19 nt, artificial
  Chemically synthesized
cggcggccugagcuucagg

SEQ ID NO: 4535 - RNA, 19 nt, artificial
  Chemically synthesized
uguggacgacccgaugagc

SEQ ID NO: 4536 - RNA, 19 nt, artificial
  Chemically synthesized
ucagucccgugagguccgu

SEQ ID NO: 4537 - RNA, 19 nt, artificial
  Chemically synthesized
uuuugacacaagccuacug

SEQ ID NO: 4538 - RNA, 19 nt, artificial
  Chemically synthesized
ugucggaccacagccuggg

SEQ ID NO: 4539 - RNA, 19 nt, artificial
  Chemically synthesized
uaucagcauccuguccuug

SEQ ID NO: 4540 - RNA, 19 nt, artificial
  Chemically synthesized
ucagggcagccagcucccu

SEQ ID NO: 4541 - RNA, 19 nt, artificial
  Chemically synthesized
gcggccugagcuucagggc

SEQ ID NO: 4542 - RNA, 19 nt, artificial
  Chemically synthesized
aaacagccugucggaccac

SEQ ID NO: 4543 - RNA, 19 nt, artificial
  Chemically synthesized
uaaaugaagucuuuugguc

SEQ ID NO: 4544 - RNA, 19 nt, artificial
  Chemically synthesized
ucgcggucagcaugaaagc

SEQ ID NO: 4545 - RNA, 19 nt, artificial
  Chemically synthesized
acagccugggcaucucccg

SEQ ID NO: 4546 - RNA, 19 nt, artificial
  Chemically synthesized
caucccacuauugucagcc

SEQ ID NO: 4547 - RNA, 19 nt, artificial
  Chemically synthesized
auccugcagcacgucaucg

SEQ ID NO: 4548 - RNA, 19 nt, artificial
  Chemically synthesized
cagaucgcccuggacucgc

SEQ ID NO: 4549 - RNA, 19 nt, artificial
  Chemically synthesized
aaaaucacaaggaauugcc

SEQ ID NO: 4550 - RNA, 19 nt, artificial
  Chemically synthesized
aucucccggagcaaaaccc

SEQ ID NO: 4551 - RNA, 19 nt, artificial
  Chemically synthesized
agccagcucccucccgguc

SEQ ID NO: 4552 - RNA, 19 nt, artificial
  Chemically synthesized
aaaucacaaggaauugccc

SEQ ID NO: 4553 - RNA, 19 nt, artificial
  Chemically synthesized
aaccaggcguccaggacgc

SEQ ID NO: 4554 - RNA, 19 nt, artificial
  Chemically synthesized
uuuuucaaagguggagcgu

SEQ ID NO: 4555 - RNA, 19 nt, artificial
  Chemically synthesized
uuaggaaaaacagccuguc

SEQ ID NO: 4556 - RNA, 19 nt, artificial
  Chemically synthesized
uucuuguauaguggcagag

SEQ ID NO: 4557 - RNA, 19 nt, artificial
  Chemically synthesized
aggacgccgcugaccaccc

SEQ ID NO: 4558 - RNA, 19 nt, artificial
  Chemically synthesized
uauuucagaggaccagugc

SEQ ID NO: 4559 - RNA, 19 nt, artificial
  Chemically synthesized
uaaaaucacaaggaauugc

SEQ ID NO: 4560 - RNA, 19 nt, artificial
  Chemically synthesized
uucagucccgugagguccg

SEQ ID NO: 4561 - RNA, 19 nt, artificial
  Chemically synthesized
uccguuaggaaaaacagcc

SEQ ID NO: 4562 - RNA, 19 nt, artificial
  Chemically synthesized
caggacgccgcugaccacc

SEQ ID NO: 4563 - RNA, 19 nt, artificial
  Chemically synthesized
guccaggacgccgcugacc

SEQ ID NO: 4564 - RNA, 19 nt, artificial
  Chemically synthesized
ucgcccuggacucgcaucc

SEQ ID NO: 4565 - RNA, 19 nt, artificial
  Chemically synthesized
uuuucuuguauaguggcag

SEQ ID NO: 4566 - RNA, 19 nt, artificial
  Chemically synthesized
aaugaucaucuucccaggg

SEQ ID NO: 4567 - RNA, 19 nt, artificial
  Chemically synthesized
aaaagacuuuuaaaugccc

SEQ ID NO: 4568 - RNA, 19 nt, artificial
  Chemically synthesized
uugaauggugauugccugc

SEQ ID NO: 4569 - RNA, 19 nt, artificial
  Chemically synthesized
uuaaaugcccuuucugcag

SEQ ID NO: 4570 - RNA, 19 nt, artificial
  Chemically synthesized
uucagggcagccagcuccc

SEQ ID NO: 4571 - RNA, 19 nt, artificial
  Chemically synthesized
aagauggaaauccugcagc

SEQ ID NO: 4572 - RNA, 19 nt, artificial
  Chemically synthesized
cagcucccucccggucucg

SEQ ID NO: 4573 - RNA, 19 nt, artificial
  Chemically synthesized
uuuuaaaugcccuuucugc

SEQ ID NO: 4574 - RNA, 19 nt, artificial
  Chemically synthesized
uuaguuguaaacuuaaccc

SEQ ID NO: 4575 - RNA, 19 nt, artificial
  Chemically synthesized
uuauugaauggugauugcc

SEQ ID NO: 4576 - RNA, 19 nt, artificial
  Chemically synthesized
ucccgugagguccguuagg

SEQ ID NO: 4577 - RNA, 19 nt, artificial
  Chemically synthesized
agcucccucccggucucgc

SEQ ID NO: 4578 - RNA, 19 nt, artificial
  Chemically synthesized
uuggaccugcagaucgccc

SEQ ID NO: 4579 - RNA, 19 nt, artificial
  Chemically synthesized
accaggcguccaggacgcc

SEQ ID NO: 4580 - RNA, 19 nt, artificial
  Chemically synthesized
ugggaugcgaguccagggc

SEQ ID NO: 4581 - RNA, 19 nt, artificial
  Chemically synthesized
acugaaggcuuucaugcug

SEQ ID NO: 4582 - RNA, 19 nt, artificial
  Chemically synthesized
ugcuuagauugggcaauuc

SEQ ID NO: 4583 - RNA, 19 nt, artificial
  Chemically synthesized
ugguccgacaggcuguuuu

SEQ ID NO: 4584 - RNA, 19 nt, artificial
  Chemically synthesized
ugcucaccuucuuguucug

SEQ ID NO: 4585 - RNA, 19 nt, artificial
  Chemically synthesized
auaaagcaggcaaucacca

SEQ ID NO: 4586 - RNA, 19 nt, artificial
  Chemically synthesized
uaaagcaggcaaucaccau

SEQ ID NO: 4587 - RNA, 19 nt, artificial
  Chemically synthesized
uccuccuugugaaaugguu

SEQ ID NO: 4588 - RNA, 19 nt, artificial
  Chemically synthesized
cuuagauugggcaauuccu

SEQ ID NO: 4589 - RNA, 19 nt, artificial
  Chemically synthesized
ucugcuuagauugggcaau

SEQ ID NO: 4590 - RNA, 19 nt, artificial
  Chemically synthesized
aagagaacacccugggaag

SEQ ID NO: 4591 - RNA, 19 nt, artificial
  Chemically synthesized
uugaggguggucagcggcg

SEQ ID NO: 4592 - RNA, 19 nt, artificial
  Chemically synthesized
auuucugaccaaaagacuu

SEQ ID NO: 4593 - RNA, 19 nt, artificial
  Chemically synthesized
uggaguagcagucguucau

SEQ ID NO: 4594 - RNA, 19 nt, artificial
  Chemically synthesized
auacuggauccuucuggua

SEQ ID NO: 4595 - RNA, 19 nt, artificial
  Chemically synthesized
gugacugaauacuggaucc

SEQ ID NO: 4596 - RNA, 19 nt, artificial
  Chemically synthesized
cugcccugaagcucaggcc

SEQ ID NO: 4597 - RNA, 19 nt, artificial
  Chemically synthesized
agguccaagauguagucga

SEQ ID NO: 4598 - RNA, 19 nt, artificial
  Chemically synthesized
ucagaagccugcaaggaca

SEQ ID NO: 4599 - RNA, 19 nt, artificial
  Chemically synthesized
agaaaaccuuccaacugca

SEQ ID NO: 4600 - RNA, 19 nt, artificial
  Chemically synthesized
caaucaccauucaauaaac

SEQ ID NO: 4601 - RNA, 19 nt, artificial
  Chemically synthesized
ucaaagcacugguccucug

SEQ ID NO: 4602 - RNA, 19 nt, artificial
  Chemically synthesized
ugcaaggacaggaugcuga

SEQ ID NO: 4603 - RNA, 19 nt, artificial
  Chemically synthesized
aucaaagcacugguccucu

SEQ ID NO: 4604 - RNA, 19 nt, artificial
  Chemically synthesized
gaaggcuuucaugcugacc

SEQ ID NO: 4605 - RNA, 19 nt, artificial
  Chemically synthesized
agugggaugcgaguccagg

SEQ ID NO: 4606 - RNA, 19 nt, artificial
  Chemically synthesized
ugccacuauacaagaaaac

SEQ ID NO: 4607 - RNA, 19 nt, artificial
  Chemically synthesized
aacuuguccuccuugugaa

SEQ ID NO: 4608 - RNA, 19 nt, artificial
  Chemically synthesized
agggaauucagaagccugc

SEQ ID NO: 4609 - RNA, 19 nt, artificial
  Chemically synthesized
ugaccaaaagacuucauuu

SEQ ID NO: 4610 - RNA, 19 nt, artificial
  Chemically synthesized
cagaagggaauucagaagc

SEQ ID NO: 4611 - RNA, 19 nt, artificial
  Chemically synthesized
caagauguagucgaugacg

SEQ ID NO: 4612 - RNA, 19 nt, artificial
  Chemically synthesized
caaaaagguaauuucugac

SEQ ID NO: 4613 - RNA, 19 nt, artificial
  Chemically synthesized
uagugggaugcgaguccag

SEQ ID NO: 4614 - RNA, 19 nt, artificial
  Chemically synthesized
uguagucgaugacgugcug

SEQ ID NO: 4615 - RNA, 19 nt, artificial
  Chemically synthesized
ugaaggcuuucaugcugac

SEQ ID NO: 4616 - RNA, 19 nt, artificial
  Chemically synthesized
cucuaauuaaagaguucac

SEQ ID NO: 4617 - RNA, 19 nt, artificial
  Chemically synthesized
agugcuuugcugucauuug

SEQ ID NO: 4618 - RNA, 19 nt, artificial
  Chemically synthesized
cauuuaagugacugaauac

SEQ ID NO: 4619 - RNA, 19 nt, artificial
  Chemically synthesized
acucagaagggaauucaga

SEQ ID NO: 4620 - RNA, 19 nt, artificial
  Chemically synthesized
uugcuccgggagaugccca

SEQ ID NO: 4621 - RNA, 19 nt, artificial
  Chemically synthesized
ggaagaugaucauucuuag

SEQ ID NO: 4622 - RNA, 19 nt, artificial
  Chemically synthesized
cacccugggaagaugauca

SEQ ID NO: 4623 - RNA, 19 nt, artificial
  Chemically synthesized
aaaaaggcaaagucugcuu

SEQ ID NO: 4624 - RNA, 19 nt, artificial
  Chemically synthesized
uugcugucauuugacauua

SEQ ID NO: 4625 - RNA, 19 nt, artificial
  Chemically synthesized
ggauccuucugguauucac

SEQ ID NO: 4626 - RNA, 19 nt, artificial
  Chemically synthesized
aagugacugaauacuggau

SEQ ID NO: 4627 - RNA, 19 nt, artificial
  Chemically synthesized
ucucugccacuauacaaga

SEQ ID NO: 4628 - RNA, 19 nt, artificial
  Chemically synthesized
gcagaaauagacaucucug

SEQ ID NO: 4629 - RNA, 19 nt, artificial
  Chemically synthesized
ucugccacuauacaagaaa

SEQ ID NO: 4630 - RNA, 19 nt, artificial
  Chemically synthesized
gacaucucugccacuauac

SEQ ID NO: 4631 - RNA, 19 nt, artificial
  Chemically synthesized
ucagccacacagugcuuug

SEQ ID NO: 4632 - RNA, 19 nt, artificial
  Chemically synthesized
uguauuuauuuggguucag

SEQ ID NO: 4633 - RNA, 19 nt, artificial
  Chemically synthesized
ugaagcucaggccgccgcu

SEQ ID NO: 4634 - RNA, 19 nt, artificial
  Chemically synthesized
uccaagauguagucgauga

SEQ ID NO: 4635 - RNA, 19 nt, artificial
  Chemically synthesized
agaguucacaagguuucac

SEQ ID NO: 4636 - RNA, 19 nt, artificial
  Chemically synthesized
agaacacccugggaagaug

SEQ ID NO: 4637 - RNA, 19 nt, artificial
  Chemically synthesized
uccagggcgaucugcaggu

SEQ ID NO: 4638 - RNA, 19 nt, artificial
  Chemically synthesized
cuuguauuuauuuggguuc

SEQ ID NO: 4639 - RNA, 19 nt, artificial
  Chemically synthesized
augcugaccgcgagggaag

SEQ ID NO: 4640 - RNA, 19 nt, artificial
  Chemically synthesized
caauagugggaugcgaguc

SEQ ID NO: 4641 - RNA, 19 nt, artificial
  Chemically synthesized
acacagcauucaguaggcu

SEQ ID NO: 4642 - RNA, 19 nt, artificial
  Chemically synthesized
gaguucacaagguuucacu

SEQ ID NO: 4643 - RNA, 19 nt, artificial
  Chemically synthesized
aagccugcaaggacaggau

SEQ ID NO: 4644 - RNA, 19 nt, artificial
  Chemically synthesized
uagcaggcucaucgggucg

SEQ ID NO: 4645 - RNA, 19 nt, artificial
  Chemically synthesized
gacaauagugggaugcgag

SEQ ID NO: 4646 - RNA, 19 nt, artificial
  Chemically synthesized
ugcuccgggagaugcccag

SEQ ID NO: 4647 - RNA, 19 nt, artificial
  Chemically synthesized
guccucugaaauaaagcag

SEQ ID NO: 4648 - RNA, 19 nt, artificial
  Chemically synthesized
ccuccuugugaaaugguug

SEQ ID NO: 4649 - RNA, 19 nt, artificial
  Chemically synthesized
gugauuuuaacguuuucgc

SEQ ID NO: 4650 - RNA, 19 nt, artificial
  Chemically synthesized
uucacgcuccaccuuugaa

SEQ ID NO: 4651 - RNA, 19 nt, artificial
  Chemically synthesized
acaucucugccacuauaca

SEQ ID NO: 4652 - RNA, 19 nt, artificial
  Chemically synthesized
auucagaagccugcaagga

SEQ ID NO: 4653 - RNA, 19 nt, artificial
  Chemically synthesized
guuuugcuccgggagaugc

SEQ ID NO: 4654 - RNA, 19 nt, artificial
  Chemically synthesized
gaacuuguauuuauuuggg

SEQ ID NO: 4655 - RNA, 19 nt, artificial
  Chemically synthesized
aacugcagaaagggcauuu

SEQ ID NO: 4656 - RNA, 19 nt, artificial
  Chemically synthesized
guguugaggguggucagcg

SEQ ID NO: 4657 - RNA, 19 nt, artificial
  Chemically synthesized
uucagccacacagugcuuu

SEQ ID NO: 4658 - RNA, 19 nt, artificial
  Chemically synthesized
aaagcaggcaaucaccauu

SEQ ID NO: 4659 - RNA, 19 nt, artificial
  Chemically synthesized
uuuuuccuaacggaccuca

SEQ ID NO: 4660 - RNA, 19 nt, artificial
  Chemically synthesized
cgcuuauucagccacacag

SEQ ID NO: 4661 - RNA, 19 nt, artificial
  Chemically synthesized
gaugcccaggcuguggucc

SEQ ID NO: 4662 - RNA, 19 nt, artificial
  Chemically synthesized
agauugggcaauuccuugu

SEQ ID NO: 4663 - RNA, 19 nt, artificial
  Chemically synthesized
uccgggagaugcccaggcu

SEQ ID NO: 4664 - RNA, 19 nt, artificial
  Chemically synthesized
auagugggaugcgagucca

SEQ ID NO: 4665 - RNA, 19 nt, artificial
  Chemically synthesized
uucacaagguuucacucaa

SEQ ID NO: 4666 - RNA, 19 nt, artificial
  Chemically synthesized
uguuguuguuguugugcaa

SEQ ID NO: 4667 - RNA, 19 nt, artificial
  Chemically synthesized
cuuggaguagcagucguuc

SEQ ID NO: 4668 - RNA, 19 nt, artificial
  Chemically synthesized
gcauucaguaggcuugugu

SEQ ID NO: 4669 - RNA, 19 nt, artificial
  Chemically synthesized
aguccagggcgaucugcag

SEQ ID NO: 4670 - RNA, 19 nt, artificial
  Chemically synthesized
auucacgcuccaccuuuga

SEQ ID NO: 4671 - RNA, 19 nt, artificial
  Chemically synthesized
aaccuuccaacugcagaaa

SEQ ID NO: 4672 - RNA, 19 nt, artificial
  Chemically synthesized
cagggcgaucugcaggucc

SEQ ID NO: 4673 - RNA, 19 nt, artificial
  Chemically synthesized
ugcccugaagcucaggccg

SEQ ID NO: 4674 - RNA, 19 nt, artificial
  Chemically synthesized
gaagccugcaaggacagga

SEQ ID NO: 4675 - RNA, 19 nt, artificial
  Chemically synthesized
gauuuuaacguuuucgcuc

SEQ ID NO: 4676 - RNA, 19 nt, artificial
  Chemically synthesized
gacugaaggcuuucaugcu

SEQ ID NO: 4677 - RNA, 19 nt, artificial
  Chemically synthesized
guagucgaugacgugcugc

SEQ ID NO: 4678 - RNA, 19 nt, artificial
  Chemically synthesized
acuucauuuaagugacuga

SEQ ID NO: 4679 - RNA, 19 nt, artificial
  Chemically synthesized
aggcaaagucugcuuagau

SEQ ID NO: 4680 - RNA, 19 nt, artificial
  Chemically synthesized
aaggcaaagucugcuuaga

SEQ ID NO: 4681 - RNA, 19 nt, artificial
  Chemically synthesized
augacgugcugcaggauuu

SEQ ID NO: 4682 - RNA, 19 nt, artificial
  Chemically synthesized
acaccgcuuauucagccac

SEQ ID NO: 4683 - RNA, 19 nt, artificial
  Chemically synthesized
agucgaugacgugcugcag

SEQ ID NO: 4684 - RNA, 19 nt, artificial
  Chemically synthesized
aguagcagucguucauguu

SEQ ID NO: 4685 - RNA, 19 nt, artificial
  Chemically synthesized
cgcgagggaaggcgagacc

SEQ ID NO: 4686 - RNA, 19 nt, artificial
  Chemically synthesized
guagcagucguucauguug

SEQ ID NO: 4687 - RNA, 19 nt, artificial
  Chemically synthesized
ucagcggcguccuggacgc

SEQ ID NO: 4688 - RNA, 19 nt, artificial
  Chemically synthesized
uggauccuucugguauuca

SEQ ID NO: 4689 - RNA, 19 nt, artificial
  Chemically synthesized
cuuauucagccacacagug

SEQ ID NO: 4690 - RNA, 19 nt, artificial
  Chemically synthesized
ucgaugacgugcugcagga

SEQ ID NO: 4691 - RNA, 19 nt, artificial
  Chemically synthesized
aggcugacaauagugggau

SEQ ID NO: 4692 - RNA, 19 nt, artificial
  Chemically synthesized
uguuuuuccuaacggaccu

SEQ ID NO: 4693 - RNA, 19 nt, artificial
  Chemically synthesized
caggcucaucgggucgucc

SEQ ID NO: 4694 - RNA, 19 nt, artificial
  Chemically synthesized
gugucaaaaagguaauuuc

SEQ ID NO: 4695 - RNA, 19 nt, artificial
  Chemically synthesized
gggacugaaggcuuucaug

SEQ ID NO: 4696 - RNA, 19 nt, artificial
  Chemically synthesized
aggcuuucaugcugaccgc

SEQ ID NO: 4697 - RNA, 19 nt, artificial
  Chemically synthesized
guacaucauuacacuuuug

SEQ ID NO: 4698 - RNA, 19 nt, artificial
  Chemically synthesized
ccaagauguagucgaugac

SEQ ID NO: 4699 - RNA, 19 nt, artificial
  Chemically synthesized
gucgaugacgugcugcagg

SEQ ID NO: 4700 - RNA, 19 nt, artificial
  Chemically synthesized
ugacgugcugcaggauuuc

SEQ ID NO: 4701 - RNA, 19 nt, artificial
  Chemically synthesized
auccguguugagggugguc

SEQ ID NO: 4702 - RNA, 19 nt, artificial
  Chemically synthesized
ucugaaauaaagcaggcaa

SEQ ID NO: 4703 - RNA, 19 nt, artificial
  Chemically synthesized
agcauucaguaggcuugug

SEQ ID NO: 4704 - RNA, 19 nt, artificial
  Chemically synthesized
cuuugcugucauuugacau

SEQ ID NO: 4705 - RNA, 19 nt, artificial
  Chemically synthesized
ugugguccgacaggcuguu

SEQ ID NO: 4706 - RNA, 19 nt, artificial
  Chemically synthesized
aggguggucagcggcgucc

SEQ ID NO: 4707 - RNA, 19 nt, artificial
  Chemically synthesized
cugaccgcgagggaaggcg

SEQ ID NO: 4708 - RNA, 19 nt, artificial
  Chemically synthesized
aguucagcacuuaaaagau

SEQ ID NO: 4709 - RNA, 19 nt, artificial
  Chemically synthesized
accauucaauaaacacacu

SEQ ID NO: 4710 - RNA, 19 nt, artificial
  Chemically synthesized
gaaaaccuuccaacugcag

SEQ ID NO: 4711 - RNA, 19 nt, artificial
  Chemically synthesized
gacuucauuuaagugacug

SEQ ID NO: 4712 - RNA, 19 nt, artificial
  Chemically synthesized
gugggaauaguauauaaag

SEQ ID NO: 4713 - RNA, 19 nt, artificial
  Chemically synthesized
guugaggguggucagcggc

SEQ ID NO: 4714 - RNA, 19 nt, artificial
  Chemically synthesized
aaaaggcaaagucugcuua

SEQ ID NO: 4715 - RNA, 19 nt, artificial
  Chemically synthesized
accgcuuauucagccacac

SEQ ID NO: 4716 - RNA, 19 nt, artificial
  Chemically synthesized
aaagggcauuuaaaagucu

SEQ ID NO: 4717 - RNA, 19 nt, artificial
  Chemically synthesized
guaggcuugugucaaaaag

SEQ ID NO: 4718 - RNA, 19 nt, artificial
  Chemically synthesized
gaagaugaucauucuuagu

SEQ ID NO: 4719 - RNA, 19 nt, artificial
  Chemically synthesized
gaaaaaaggcaaagucugc

SEQ ID NO: 4720 - RNA, 19 nt, artificial
  Chemically synthesized
auggugggaauaguauaua

SEQ ID NO: 4721 - RNA, 19 nt, artificial
  Chemically synthesized
cugggaagaugaucauucu

SEQ ID NO: 4722 - RNA, 19 nt, artificial
  Chemically synthesized
caggauuuccaucuugcuc

SEQ ID NO: 4723 - RNA, 19 nt, artificial
  Chemically synthesized
guauucacgcuccaccuuu

SEQ ID NO: 4724 - RNA, 19 nt, artificial
  Chemically synthesized
gaguccagggcgaucugca

SEQ ID NO: 4725 - RNA, 19 nt, artificial
  Chemically synthesized
gcugcccugaagcucaggc

SEQ ID NO: 4726 - RNA, 19 nt, artificial
  Chemically synthesized
uccuggacgccugguucug

SEQ ID NO: 4727 - RNA, 19 nt, artificial
  Chemically synthesized
ucugaccaaaagacuucau

SEQ ID NO: 4728 - RNA, 19 nt, artificial
  Chemically synthesized
ugaccgcgagggaaggcga

SEQ ID NO: 4729 - RNA, 19 nt, artificial
  Chemically synthesized
gguucaguuauaacauagc

SEQ ID NO: 4730 - RNA, 19 nt, artificial
  Chemically synthesized
ugggaagaugaucauucuu

SEQ ID NO: 4731 - RNA, 19 nt, artificial
  Chemically synthesized
gcagguccaagauguaguc

SEQ ID NO: 4732 - RNA, 19 nt, artificial
  Chemically synthesized
cgccugcugagcuagcugc

SEQ ID NO: 4733 - RNA, 19 nt, artificial
  Chemically synthesized
aaagguaauuucugaccaa

SEQ ID NO: 4734 - RNA, 19 nt, artificial
  Chemically synthesized
ccauucaauaaacacacuu

SEQ ID NO: 4735 - RNA, 19 nt, artificial
  Chemically synthesized
cugcugagcuagcugcgcu

SEQ ID NO: 4736 - RNA, 19 nt, artificial
  Chemically synthesized
agccacacagugcuuugcu

SEQ ID NO: 4737 - RNA, 19 nt, artificial
  Chemically synthesized
uaacggaccucacgggacu

SEQ ID NO: 4738 - RNA, 19 nt, artificial
  Chemically synthesized
gacgugcugcaggauuucc

SEQ ID NO: 4739 - RNA, 19 nt, artificial
  Chemically synthesized
acuggauccuucugguauu

SEQ ID NO: 4740 - RNA, 19 nt, artificial
  Chemically synthesized
gauugggcaauuccuugug

SEQ ID NO: 4741 - RNA, 19 nt, artificial
  Chemically synthesized
gauuuccaucuugcucacc

SEQ ID NO: 4742 - RNA, 19 nt, artificial
  Chemically synthesized
aggcuugugucaaaaaggu

SEQ ID NO: 4743 - RNA, 19 nt, artificial
  Chemically synthesized
ccaccuuugaaaaaaggca

SEQ ID NO: 4744 - RNA, 19 nt, artificial
  Chemically synthesized
cugucauuugacauuaacu

SEQ ID NO: 4745 - RNA, 19 nt, artificial
  Chemically synthesized
caucucugccacuauacaa

SEQ ID NO: 4746 - RNA, 19 nt, artificial
  Chemically synthesized
acaggcuguuuuuccuaac

SEQ ID NO: 4747 - RNA, 19 nt, artificial
  Chemically synthesized
guucaguuauaacauagca

SEQ ID NO: 4748 - RNA, 19 nt, artificial
  Chemically synthesized
gaccucacgggacugaagg

SEQ ID NO: 4749 - RNA, 19 nt, artificial
  Chemically synthesized
agcuagcugcgcuuggcac

SEQ ID NO: 4750 - RNA, 19 nt, artificial
  Chemically synthesized
gcucaccuucuuguucugg

SEQ ID NO: 4751 - RNA, 19 nt, artificial
  Chemically synthesized
cuguuuuuccuaacggacc

SEQ ID NO: 4752 - RNA, 19 nt, artificial
  Chemically synthesized
agcacugguccucugaaau

SEQ ID NO: 4753 - RNA, 19 nt, artificial
  Chemically synthesized
gaucugcagguccaagaug

SEQ ID NO: 4754 - RNA, 19 nt, artificial
  Chemically synthesized
cuugagcuuggaguagcag

SEQ ID NO: 4755 - RNA, 19 nt, artificial
  Chemically synthesized
uggcugcccugaagcucag

SEQ ID NO: 4756 - RNA, 19 nt, artificial
  Chemically synthesized
cugagcuagcugcgcuugg

SEQ ID NO: 4757 - RNA, 19 nt, artificial
  Chemically synthesized
cuggcugcccugaagcuca

SEQ ID NO: 4758 - RNA, 19 nt, artificial
  Chemically synthesized
ugaggguggucagcggcgu

SEQ ID NO: 4759 - RNA, 19 nt, artificial
  Chemically synthesized
ccucacgggacugaaggcu

SEQ ID NO: 4760 - RNA, 19 nt, artificial
  Chemically synthesized
aggcuguuuuuccuaacgg

SEQ ID NO: 4761 - RNA, 19 nt, artificial
  Chemically synthesized
gaagggaauucagaagccu

SEQ ID NO: 4762 - RNA, 19 nt, artificial
  Chemically synthesized
auuaacucagaagggaauu

SEQ ID NO: 4763 - RNA, 19 nt, artificial
  Chemically synthesized
gaguagcagucguucaugu

SEQ ID NO: 4764 - RNA, 19 nt, artificial
  Chemically synthesized
gucauuugacauuaacuca

SEQ ID NO: 4765 - RNA, 19 nt, artificial
  Chemically synthesized
cacagcauucaguaggcuu

SEQ ID NO: 4766 - RNA, 19 nt, artificial
  Chemically synthesized
ugcugaccgcgagggaagg

SEQ ID NO: 4767 - RNA, 19 nt, artificial
  Chemically synthesized
guuuagcaugaauaaguac

SEQ ID NO: 4768 - RNA, 19 nt, artificial
  Chemically synthesized
accucacgggacugaaggc

SEQ ID NO: 4769 - RNA, 19 nt, artificial
  Chemically synthesized
ugcugagcuagcugcgcuu

SEQ ID NO: 4770 - RNA, 19 nt, artificial
  Chemically synthesized
ucugcagguccaagaugua

SEQ ID NO: 4771 - RNA, 19 nt, artificial
  Chemically synthesized
gugggaugcgaguccaggg

SEQ ID NO: 4772 - RNA, 19 nt, artificial
  Chemically synthesized
aagaguucacaagguuuca

SEQ ID NO: 4773 - RNA, 19 nt, artificial
  Chemically synthesized
accgggagggagcuggcug

SEQ ID NO: 4774 - RNA, 19 nt, artificial
  Chemically synthesized
agcuuggaguagcagucgu

SEQ ID NO: 4775 - RNA, 19 nt, artificial
  Chemically synthesized
cuucauuuaagugacugaa

SEQ ID NO: 4776 - RNA, 19 nt, artificial
  Chemically synthesized
gggaagaugaucauucuua

SEQ ID NO: 4777 - RNA, 19 nt, artificial
  Chemically synthesized
guauuuauuuggguucagu

SEQ ID NO: 4778 - RNA, 19 nt, artificial
  Chemically synthesized
guccagggcgaucugcagg

SEQ ID NO: 4779 - RNA, 19 nt, artificial
  Chemically synthesized
auugggcaauuccuuguga

SEQ ID NO: 4780 - RNA, 19 nt, artificial
  Chemically synthesized
ucacgggacugaaggcuuu

SEQ ID NO: 4781 - RNA, 19 nt, artificial
  Chemically synthesized
ugccgccugcugagcuagc

SEQ ID NO: 4782 - RNA, 19 nt, artificial
  Chemically synthesized
aggcucaucgggucgucca

SEQ ID NO: 4783 - RNA, 19 nt, artificial
  Chemically synthesized
agaaagggcauuuaaaagu

SEQ ID NO: 4784 - RNA, 19 nt, artificial
  Chemically synthesized
cuccaccuuugaaaaaagg

SEQ ID NO: 4785 - RNA, 19 nt, artificial
  Chemically synthesized
cauggugggaauaguauau

SEQ ID NO: 4786 - RNA, 19 nt, artificial
  Chemically synthesized
gagcuggcugcccugaagc

SEQ ID NO: 4787 - RNA, 19 nt, artificial
  Chemically synthesized
gcugacaauagugggaugc

SEQ ID NO: 4788 - RNA, 19 nt, artificial
  Chemically synthesized
aagcacugguccucugaaa

SEQ ID NO: 4789 - RNA, 19 nt, artificial
  Chemically synthesized
agaagccugcaaggacagg

SEQ ID NO: 4790 - RNA, 19 nt, artificial
  Chemically synthesized
agggcgaucugcaggucca

SEQ ID NO: 4791 - RNA, 19 nt, artificial
  Chemically synthesized
aaagcacugguccucugaa

SEQ ID NO: 4792 - RNA, 19 nt, artificial
  Chemically synthesized
ccucugaaauaaagcaggc

SEQ ID NO: 4793 - RNA, 19 nt, artificial
  Chemically synthesized
uggugggaauaguauauaa

SEQ ID NO: 4794 - RNA, 19 nt, artificial
  Chemically synthesized
caggcaaucaccauucaau

SEQ ID NO: 4795 - RNA, 19 nt, artificial
  Chemically synthesized
gguccucugaaauaaagca

SEQ ID NO: 4796 - RNA, 19 nt, artificial
  Chemically synthesized
gucaaaaagguaauuucug

SEQ ID NO: 4797 - RNA, 19 nt, artificial
  Chemically synthesized
guaauuucugaccaaaaga

SEQ ID NO: 4798 - RNA, 19 nt, artificial
  Chemically synthesized
caggcugugguccgacagg

SEQ ID NO: 4799 - RNA, 19 nt, artificial
  Chemically synthesized
cuccgggagaugcccaggc

SEQ ID NO: 4800 - RNA, 19 nt, artificial
  Chemically synthesized
agacaucucugccacuaua

SEQ ID NO: 4801 - RNA, 19 nt, artificial
  Chemically synthesized
guucacaagguuucacuca

SEQ ID NO: 4802 - RNA, 19 nt, artificial
  Chemically synthesized
gcuggcugcccugaagcuc

SEQ ID NO: 4803 - RNA, 19 nt, artificial
  Chemically synthesized
uccuugugaaaugguugaa

SEQ ID NO: 4804 - RNA, 19 nt, artificial
  Chemically synthesized
aagguaauuucugaccaaa

SEQ ID NO: 4805 - RNA, 19 nt, artificial
  Chemically synthesized
ucaugcugaccgcgaggga

SEQ ID NO: 4806 - RNA, 19 nt, artificial
  Chemically synthesized
cguccuggacgccugguuc

SEQ ID NO: 4807 - RNA, 19 nt, artificial
  Chemically synthesized
gaacacccugggaagauga

SEQ ID NO: 4808 - RNA, 19 nt, artificial
  Chemically synthesized
gcaugaauaaguacaucau

SEQ ID NO: 4809 - RNA, 19 nt, artificial
  Chemically synthesized
cugcagguccaagauguag

SEQ ID NO: 4810 - RNA, 19 nt, artificial
  Chemically synthesized
gcugugguccgacaggcug

SEQ ID NO: 4811 - RNA, 19 nt, artificial
  Chemically synthesized
ccaucuugcucaccuucuu

SEQ ID NO: 4812 - RNA, 19 nt, artificial
  Chemically synthesized
acauuaacucagaagggaa

SEQ ID NO: 4813 - RNA, 19 nt, artificial
  Chemically synthesized
gcuagcugcgcuuggcacc

SEQ ID NO: 4814 - RNA, 19 nt, artificial
  Chemically synthesized
acaauagugggaugcgagu

SEQ ID NO: 4815 - RNA, 19 nt, artificial
  Chemically synthesized
uccuugugauuuuaacguu

SEQ ID NO: 4816 - RNA, 19 nt, artificial
  Chemically synthesized
caacuuguccuccuuguga

SEQ ID NO: 4817 - RNA, 19 nt, artificial
  Chemically synthesized
cuuucaugcugaccgcgag

SEQ ID NO: 4818 - RNA, 19 nt, artificial
  Chemically synthesized
gaaggcgagaccgggaggg

SEQ ID NO: 4819 - RNA, 19 nt, artificial
  Chemically synthesized
acacagugcuuugcuguca

SEQ ID NO: 4820 - RNA, 19 nt, artificial
  Chemically synthesized
cagguccaagauguagucg

SEQ ID NO: 4821 - RNA, 19 nt, artificial
  Chemically synthesized
guuguuguugugcaaagaa

SEQ ID NO: 4822 - RNA, 19 nt, artificial
  Chemically synthesized
acugguccucugaaauaaa

SEQ ID NO: 4823 - RNA, 19 nt, artificial
  Chemically synthesized
cgaguccagggcgaucugc

SEQ ID NO: 4824 - RNA, 19 nt, artificial
  Chemically synthesized
aacacccugggaagaugau

SEQ ID NO: 4825 - RNA, 19 nt, artificial
  Chemically synthesized
ucaguaggcuugugucaaa

SEQ ID NO: 4826 - RNA, 19 nt, artificial
  Chemically synthesized
ggguucaguuauaacauag

SEQ ID NO: 4827 - RNA, 19 nt, artificial
  Chemically synthesized
cugguccucugaaauaaag

SEQ ID NO: 4828 - RNA, 19 nt, artificial
  Chemically synthesized
ggaguagcagucguucaug

SEQ ID NO: 4829 - RNA, 19 nt, artificial
  Chemically synthesized
augcgaguccagggcgauc

SEQ ID NO: 4830 - RNA, 19 nt, artificial
  Chemically synthesized
gaaauaaagcaggcaauca

SEQ ID NO: 4831 - RNA, 19 nt, artificial
  Chemically synthesized
cucacgggacugaaggcuu

SEQ ID NO: 4832 - RNA, 19 nt, artificial
  Chemically synthesized
gcgaucugcagguccaaga

SEQ ID NO: 4833 - RNA, 19 nt, artificial
  Chemically synthesized
aacggaccucacgggacug

SEQ ID NO: 4834 - RNA, 19 nt, artificial
  Chemically synthesized
cauuugacauuaacucaga

SEQ ID NO: 4835 - RNA, 19 nt, artificial
  Chemically synthesized
aggcaaucaccauucaaua

SEQ ID NO: 4836 - RNA, 19 nt, artificial
  Chemically synthesized
cuuguccuccuugugaaau

SEQ ID NO: 4837 - RNA, 19 nt, artificial
  Chemically synthesized
gagaugcccaggcuguggu

SEQ ID NO: 4838 - RNA, 19 nt, artificial
  Chemically synthesized
cgagggaaggcgagaccgg

SEQ ID NO: 4839 - RNA, 19 nt, artificial
  Chemically synthesized
gcuuauucagccacacagu

SEQ ID NO: 4840 - RNA, 19 nt, artificial
  Chemically synthesized
cugugguccgacaggcugu

SEQ ID NO: 4841 - RNA, 19 nt, artificial
  Chemically synthesized
ccaggcugugguccgacag

SEQ ID NO: 4842 - RNA, 19 nt, artificial
  Chemically synthesized
cguguugaggguggucagc

SEQ ID NO: 4843 - RNA, 19 nt, artificial
  Chemically synthesized
ggagggagcuggcugcccu

SEQ ID NO: 4844 - RNA, 19 nt, artificial
  Chemically synthesized
ccugcugagcuagcugcgc

SEQ ID NO: 4845 - RNA, 19 nt, artificial
  Chemically synthesized
agacuucauuuaagugacu

SEQ ID NO: 4846 - RNA, 19 nt, artificial
  Chemically synthesized
guggucagcggcguccugg

SEQ ID NO: 4847 - RNA, 19 nt, artificial
  Chemically synthesized
cugaagcucaggccgccgc

SEQ ID NO: 4848 - RNA, 19 nt, artificial
  Chemically synthesized
cugaccaaaagacuucauu

SEQ ID NO: 4849 - RNA, 19 nt, artificial
  Chemically synthesized
agcuggcugcccugaagcu

SEQ ID NO: 4850 - RNA, 19 nt, artificial
  Chemically synthesized
uccuaacggaccucacggg

SEQ ID NO: 4851 - RNA, 19 nt, artificial
  Chemically synthesized
gugcugcaggauuuccauc

SEQ ID NO: 4852 - RNA, 19 nt, artificial
  Chemically synthesized
cuuugaaaaaaggcaaagu

SEQ ID NO: 4853 - RNA, 19 nt, artificial
  Chemically synthesized
acccugggaagaugaucau

SEQ ID NO: 4854 - RNA, 19 nt, artificial
  Chemically synthesized
ccgcgagggaaggcgagac

SEQ ID NO: 4855 - RNA, 19 nt, artificial
  Chemically synthesized
gagcuuggaguagcagucg

SEQ ID NO: 4856 - RNA, 19 nt, artificial
  Chemically synthesized
ccuugugaaaugguugaaa

SEQ ID NO: 4857 - RNA, 19 nt, artificial
  Chemically synthesized
ugggcaauuccuugugauu

SEQ ID NO: 4858 - RNA, 19 nt, artificial
  Chemically synthesized
cgaucugcagguccaagau

SEQ ID NO: 4859 - RNA, 19 nt, artificial
  Chemically synthesized
cgggacugaaggcuuucau

SEQ ID NO: 4860 - RNA, 19 nt, artificial
  Chemically synthesized
ccuggacgccugguucugc

SEQ ID NO: 4861 - RNA, 19 nt, artificial
  Chemically synthesized
gaaagggcauuuaaaaguc

SEQ ID NO: 4862 - RNA, 19 nt, artificial
  Chemically synthesized
guccgacaggcuguuuuuc

SEQ ID NO: 4863 - RNA, 19 nt, artificial
  Chemically synthesized
agaccgggagggagcuggc

SEQ ID NO: 4864 - RNA, 19 nt, artificial
  Chemically synthesized
gacugaauacuggauccuu

SEQ ID NO: 4865 - RNA, 19 nt, artificial
  Chemically synthesized
guccaagauguagucgaug

SEQ ID NO: 4866 - RNA, 19 nt, artificial
  Chemically synthesized
cugaaggcuuucaugcuga

SEQ ID NO: 4867 - RNA, 19 nt, artificial
  Chemically synthesized
auucagccacacagugcuu

SEQ ID NO: 4868 - RNA, 19 nt, artificial
  Chemically synthesized
aagggcauuuaaaagucuu

SEQ ID NO: 4869 - RNA, 19 nt, artificial
  Chemically synthesized
ggcugugguccgacaggcu

SEQ ID NO: 4870 - RNA, 19 nt, artificial
  Chemically synthesized
agccugcaaggacaggaug

SEQ ID NO: 4871 - RNA, 19 nt, artificial
  Chemically synthesized
cuggauccuucugguauuc

SEQ ID NO: 4872 - RNA, 19 nt, artificial
  Chemically synthesized
acgggacugaaggcuuuca

SEQ ID NO: 4873 - RNA, 19 nt, artificial
  Chemically synthesized
ccuugagcuuggaguagca

SEQ ID NO: 4874 - RNA, 19 nt, artificial
  Chemically synthesized
ucacaagguuucacucaaa

SEQ ID NO: 4875 - RNA, 19 nt, artificial
  Chemically synthesized
cagccacacagugcuuugc

SEQ ID NO: 4876 - RNA, 19 nt, artificial
  Chemically synthesized
gcuccaccuuugaaaaaag

SEQ ID NO: 4877 - RNA, 19 nt, artificial
  Chemically synthesized
cagcauucaguaggcuugu

SEQ ID NO: 4878 - RNA, 19 nt, artificial
  Chemically synthesized
cugacaauagugggaugcg

SEQ ID NO: 4879 - RNA, 19 nt, artificial
  Chemically synthesized
cucagaagggaauucagaa

SEQ ID NO: 4880 - RNA, 19 nt, artificial
  Chemically synthesized
cacgggacugaaggcuuuc

SEQ ID NO: 4881 - RNA, 19 nt, artificial
  Chemically synthesized
cgugcugcaggauuuccau

SEQ ID NO: 4882 - RNA, 19 nt, artificial
  Chemically synthesized
ggagaugcccaggcugugg

SEQ ID NO: 4883 - RNA, 19 nt, artificial
  Chemically synthesized
gagaccgggagggagcugg

SEQ ID NO: 4884 - RNA, 19 nt, artificial
  Chemically synthesized
cuugugucaaaaagguaau

SEQ ID NO: 4885 - RNA, 19 nt, artificial
  Chemically synthesized
uggguucaguuauaacaua

SEQ ID NO: 4886 - RNA, 19 nt, artificial
  Chemically synthesized
caccuuugaaaaaaggcaa

SEQ ID NO: 4887 - RNA, 19 nt, artificial
  Chemically synthesized
ccuuugaaaaaaggcaaag

SEQ ID NO: 4888 - RNA, 19 nt, artificial
  Chemically synthesized
guccuccuugugaaauggu

SEQ ID NO: 4889 - RNA, 19 nt, artificial
  Chemically synthesized
cucugaaauaaagcaggca

SEQ ID NO: 4890 - RNA, 19 nt, artificial
  Chemically synthesized
gcuuggaguagcagucguu

SEQ ID NO: 4891 - RNA, 19 nt, artificial
  Chemically synthesized
gguaauuucugaccaaaag

SEQ ID NO: 4892 - RNA, 19 nt, artificial
  Chemically synthesized
gagggaaggcgagaccggg

SEQ ID NO: 4893 - RNA, 19 nt, artificial
  Chemically synthesized
cagaagccugcaaggacag

SEQ ID NO: 4894 - RNA, 19 nt, artificial
  Chemically synthesized
guuguuguuguugugcaaa

SEQ ID NO: 4895 - RNA, 19 nt, artificial
  Chemically synthesized
ccgacaggcuguuuuuccu

SEQ ID NO: 4896 - RNA, 19 nt, artificial
  Chemically synthesized
caaagcacugguccucuga

SEQ ID NO: 4897 - RNA, 19 nt, artificial
  Chemically synthesized
aggguuaaguuuacaacua

SEQ ID NO: 4898 - RNA, 19 nt, artificial
  Chemically synthesized
ccugcaaggacaggaugcu

SEQ ID NO: 4899 - RNA, 19 nt, artificial
  Chemically synthesized
ccacacagugcuuugcugu

SEQ ID NO: 4900 - RNA, 19 nt, artificial
  Chemically synthesized
uggucagcggcguccugga

SEQ ID NO: 4901 - RNA, 19 nt, artificial
  Chemically synthesized
cuccuugugaaaugguuga

SEQ ID NO: 4902 - RNA, 19 nt, artificial
  Chemically synthesized
cugcaaggacaggaugcug

SEQ ID NO: 4903 - RNA, 19 nt, artificial
  Chemically synthesized
gcuguuuuuccuaacggac

SEQ ID NO: 4904 - RNA, 19 nt, artificial
  Chemically synthesized
cacacagugcuuugcuguc

SEQ ID NO: 4905 - RNA, 19 nt, artificial
  Chemically synthesized
cuugugaaaugguugaaaa

SEQ ID NO: 4906 - RNA, 19 nt, artificial
  Chemically synthesized
acugcagaaagggcauuua

SEQ ID NO: 4907 - RNA, 19 nt, artificial
  Chemically synthesized
caggcugacaauaguggga

SEQ ID NO: 4908 - RNA, 19 nt, artificial
  Chemically synthesized
ugcagaaagggcauuuaaa

SEQ ID NO: 4909 - RNA, 19 nt, artificial
  Chemically synthesized
ggugggaauaguauauaaa

SEQ ID NO: 4910 - RNA, 19 nt, artificial
  Chemically synthesized
acuuguccuccuugugaaa

SEQ ID NO: 4911 - RNA, 19 nt, artificial
  Chemically synthesized
cugcaggauuuccaucuug

SEQ ID NO: 4912 - RNA, 19 nt, artificial
  Chemically synthesized
gccugcaaggacaggaugc

SEQ ID NO: 4913 - RNA, 19 nt, artificial
  Chemically synthesized
cacgcuccaccuuugaaaa

SEQ ID NO: 4914 - RNA, 19 nt, artificial
  Chemically synthesized
gccacuauacaagaaaacu

SEQ ID NO: 4915 - RNA, 19 nt, artificial
  Chemically synthesized
gaugacgugcugcaggauu

SEQ ID NO: 4916 - RNA, 19 nt, artificial
  Chemically synthesized
ggagcuggcugcccugaag

SEQ ID NO: 4917 - RNA, 19 nt, artificial
  Chemically synthesized
aggcgagaccgggagggag

SEQ ID NO: 4918 - RNA, 19 nt, artificial
  Chemically synthesized
gcaggauuuccaucuugcu

SEQ ID NO: 4919 - RNA, 19 nt, artificial
  Chemically synthesized
gcaaucaccauucaauaaa

SEQ ID NO: 4920 - RNA, 19 nt, artificial
  Chemically synthesized
ugcccaggcugugguccga

SEQ ID NO: 4921 - RNA, 19 nt, artificial
  Chemically synthesized
ccgccugcugagcuagcug

SEQ ID NO: 4922 - RNA, 19 nt, artificial
  Chemically synthesized
gccugcugagcuagcugcg

SEQ ID NO: 4923 - RNA, 19 nt, artificial
  Chemically synthesized
ggcaaagucugcuuagauu

SEQ ID NO: 4924 - RNA, 19 nt, artificial
  Chemically synthesized
ggacgccugguucugcccg

SEQ ID NO: 4925 - RNA, 19 nt, artificial
  Chemically synthesized
cacugguccucugaaauaa

SEQ ID NO: 4926 - RNA, 19 nt, artificial
  Chemically synthesized
cugaaauaaagcaggcaau

SEQ ID NO: 4927 - RNA, 19 nt, artificial
  Chemically synthesized
ccauggugggaauaguaua

SEQ ID NO: 4928 - RNA, 19 nt, artificial
  Chemically synthesized
ugcugucauuugacauuaa

SEQ ID NO: 4929 - RNA, 19 nt, artificial
  Chemically synthesized
gucagcggcguccuggacg

SEQ ID NO: 4930 - RNA, 19 nt, artificial
  Chemically synthesized
gcccaggcugugguccgac

SEQ ID NO: 4931 - RNA, 19 nt, artificial
  Chemically synthesized
ccguguugaggguggucag

SEQ ID NO: 4932 - RNA, 19 nt, artificial
  Chemically synthesized
aaggcgagaccgggaggga

SEQ ID NO: 4933 - RNA, 19 nt, artificial
  Chemically synthesized
agcagucguucauguugua

SEQ ID NO: 4934 - RNA, 19 nt, artificial
  Chemically synthesized
gcgagggaaggcgagaccg

SEQ ID NO: 4935 - RNA, 19 nt, artificial
  Chemically synthesized
cagugcuuugcugucauuu

SEQ ID NO: 4936 - RNA, 19 nt, artificial
  Chemically synthesized
ggcucaucgggucguccac

SEQ ID NO: 4937 - RNA, 19 nt, artificial
  Chemically synthesized
cuccuugagcuuggaguag

SEQ ID NO: 4938 - RNA, 19 nt, artificial
  Chemically synthesized
ccaaaagacuucauuuaag

SEQ ID NO: 4939 - RNA, 19 nt, artificial
  Chemically synthesized
cauuaacucagaagggaau

SEQ ID NO: 4940 - RNA, 19 nt, artificial
  Chemically synthesized
cugcuuagauugggcaauu

SEQ ID NO: 4941 - RNA, 19 nt, artificial
  Chemically synthesized
gcugucauuugacauuaac

SEQ ID NO: 4942 - RNA, 19 nt, artificial
  Chemically synthesized
cagaaagggcauuuaaaag

SEQ ID NO: 4943 - RNA, 19 nt, artificial
  Chemically synthesized
caggcuguuuuuccuaacg

SEQ ID NO: 4944 - RNA, 19 nt, artificial
  Chemically synthesized
agagaacacccugggaaga

SEQ ID NO: 4945 - RNA, 19 nt, artificial
  Chemically synthesized
guccuggacgccugguucu

SEQ ID NO: 4946 - RNA, 19 nt, artificial
  Chemically synthesized
gucugcuuagauugggcaa

SEQ ID NO: 4947 - RNA, 19 nt, artificial
  Chemically synthesized
cuaacggaccucacgggac

SEQ ID NO: 4948 - RNA, 19 nt, artificial
  Chemically synthesized
agcggcguccuggacgccu

SEQ ID NO: 4949 - RNA, 19 nt, artificial
  Chemically synthesized
gcuuugcugucauuugaca

SEQ ID NO: 4950 - RNA, 19 nt, artificial
  Chemically synthesized
gguuuugcuccgggagaug

SEQ ID NO: 4951 - RNA, 19 nt, artificial
  Chemically synthesized
gagaacacccugggaagau

SEQ ID NO: 4952 - RNA, 19 nt, artificial
  Chemically synthesized
ccaacugcagaaagggcau

SEQ ID NO: 4953 - RNA, 19 nt, artificial
  Chemically synthesized
agguaauuucugaccaaaa

SEQ ID NO: 4954 - RNA, 19 nt, artificial
  Chemically synthesized
gugcuuugcugucauuuga

SEQ ID NO: 4955 - RNA, 19 nt, artificial
  Chemically synthesized
gaggguggucagcggcguc

SEQ ID NO: 4956 - RNA, 19 nt, artificial
  Chemically synthesized
gagggagcuggcugcccug

SEQ ID NO: 4957 - RNA, 19 nt, artificial
  Chemically synthesized
ggauuuccaucuugcucac

SEQ ID NO: 4958 - RNA, 19 nt, artificial
  Chemically synthesized
gccgccugcugagcuagcu

SEQ ID NO: 4959 - RNA, 19 nt, artificial
  Chemically synthesized
gguccgacaggcuguuuuu

SEQ ID NO: 4960 - RNA, 19 nt, artificial
  Chemically synthesized
guucagcacuuaaaagauu

SEQ ID NO: 4961 - RNA, 19 nt, artificial
  Chemically synthesized
aguaggcuugugucaaaaa

SEQ ID NO: 4962 - RNA, 19 nt, artificial
  Chemically synthesized
caacugcagaaagggcauu

SEQ ID NO: 4963 - RNA, 19 nt, artificial
  Chemically synthesized
gccacacagugcuuugcug

SEQ ID NO: 4964 - RNA, 19 nt, artificial
  Chemically synthesized
gcagucguucauguuguau

SEQ ID NO: 4965 - RNA, 19 nt, artificial
  Chemically synthesized
guuuuuccuaacggaccuc

SEQ ID NO: 4966 - RNA, 19 nt, artificial
  Chemically synthesized
cgacaggcuguuuuuccua

SEQ ID NO: 4967 - RNA, 19 nt, artificial
  Chemically synthesized
ggcgaucugcagguccaag

SEQ ID NO: 4968 - RNA, 19 nt, artificial
  Chemically synthesized
ggcuuucaugcugaccgcg

SEQ ID NO: 4969 - RNA, 19 nt, artificial
  Chemically synthesized
ggaccucacgggacugaag

SEQ ID NO: 4970 - RNA, 19 nt, artificial
  Chemically synthesized
agcaggcucaucgggucgu

SEQ ID NO: 4971 - RNA, 19 nt, artificial
  Chemically synthesized
gacauuaacucagaaggga

SEQ ID NO: 4972 - RNA, 19 nt, artificial
  Chemically synthesized
gcuugugucaaaaagguaa

SEQ ID NO: 4973 - RNA, 19 nt, artificial
  Chemically synthesized
cacagugcuuugcugucau

SEQ ID NO: 4974 - RNA, 19 nt, artificial
  Chemically synthesized
ccagggcgaucugcagguc

SEQ ID NO: 4975 - RNA, 19 nt, artificial
  Chemically synthesized
gggaauucagaagccugca

SEQ ID NO: 4976 - RNA, 19 nt, artificial
  Chemically synthesized
accuuugaaaaaaggcaaa

SEQ ID NO: 4977 - RNA, 19 nt, artificial
  Chemically synthesized
gggaugcgaguccagggcg

SEQ ID NO: 4978 - RNA, 19 nt, artificial
  Chemically synthesized
gcugaccgcgagggaaggc

SEQ ID NO: 4979 - RNA, 19 nt, artificial
  Chemically synthesized
ccgcuuauucagccacaca

SEQ ID NO: 4980 - RNA, 19 nt, artificial
  Chemically synthesized
gggaaggcgagaccgggag

SEQ ID NO: 4981 - RNA, 19 nt, artificial
  Chemically synthesized
gcaaggacaggaugcugau

SEQ ID NO: 4982 - RNA, 19 nt, artificial
  Chemically synthesized
accgcgagggaaggcgaga

SEQ ID NO: 4983 - RNA, 19 nt, artificial
  Chemically synthesized
ccuugugauuuuaacguuu

SEQ ID NO: 4984 - RNA, 19 nt, artificial
  Chemically synthesized
gcuccgggagaugcccagg

SEQ ID NO: 4985 - RNA, 19 nt, artificial
  Chemically synthesized
cccugaagcucaggccgcc

SEQ ID NO: 4986 - RNA, 19 nt, artificial
  Chemically synthesized
gagcuagcugcgcuuggca

SEQ ID NO: 4987 - RNA, 19 nt, artificial
  Chemically synthesized
ggcuugugucaaaaaggua

SEQ ID NO: 4988 - RNA, 19 nt, artificial
  Chemically synthesized
gguccaagauguagucgau

SEQ ID NO: 4989 - RNA, 19 nt, artificial
  Chemically synthesized
gaccgcgagggaaggcgag

SEQ ID NO: 4990 - RNA, 19 nt, artificial
  Chemically synthesized
gaugcgaguccagggcgau

SEQ ID NO: 4991 - RNA, 19 nt, artificial
  Chemically synthesized
ggcugcccugaagcucagg

SEQ ID NO: 4992 - RNA, 19 nt, artificial
  Chemically synthesized
acagugcuuugcugucauu

SEQ ID NO: 4993 - RNA, 19 nt, artificial
  Chemically synthesized
caugcugaccgcgagggaa

SEQ ID NO: 4994 - RNA, 19 nt, artificial
  Chemically synthesized
ggaaggcgagaccgggagg

SEQ ID NO: 4995 - RNA, 19 nt, artificial
  Chemically synthesized
gcaggcucaucgggucguc

SEQ ID NO: 4996 - RNA, 19 nt, artificial
  Chemically synthesized
agggaaggcgagaccggga

SEQ ID NO: 4997 - RNA, 19 nt, artificial
  Chemically synthesized
cgcuccaccuuugaaaaaa

SEQ ID NO: 4998 - RNA, 19 nt, artificial
  Chemically synthesized
gcugagcuagcugcgcuug

SEQ ID NO: 4999 - RNA, 19 nt, artificial
  Chemically synthesized
agggcauuuaaaagucuuu

SEQ ID NO: 5000 - RNA, 19 nt, artificial
  Chemically synthesized
agcaggcaaucaccauuca

SEQ ID NO: 5001 - RNA, 19 nt, artificial
  Chemically synthesized
caccgcuuauucagccaca

SEQ ID NO: 5002 - RNA, 19 nt, artificial
  Chemically synthesized
cccauggugggaauaguau

SEQ ID NO: 5003 - RNA, 19 nt, artificial
  Chemically synthesized
gguauucacgcuccaccuu

SEQ ID NO: 5004 - RNA, 19 nt, artificial
  Chemically synthesized
gggagaugcccaggcugug

SEQ ID NO: 5005 - RNA, 19 nt, artificial
  Chemically synthesized
ccgggagaugcccaggcug

SEQ ID NO: 5006 - RNA, 19 nt, artificial
  Chemically synthesized
ggaauucagaagccugcaa

SEQ ID NO: 5007 - RNA, 19 nt, artificial
  Chemically synthesized
ccugaagcucaggccgccg

SEQ ID NO: 5008 - RNA, 19 nt, artificial
  Chemically synthesized
gcucaucgggucguccaca

SEQ ID NO: 5009 - RNA, 19 nt, artificial
  Chemically synthesized
acggaccucacgggacuga

SEQ ID NO: 5010 - RNA, 19 nt, artificial
  Chemically synthesized
caguaggcuugugucaaaa

SEQ ID NO: 5011 - RNA, 19 nt, artificial
  Chemically synthesized
cccaggcugugguccgaca

SEQ ID NO: 5012 - RNA, 19 nt, artificial
  Chemically synthesized
caaggacaggaugcugaua

SEQ ID NO: 5013 - RNA, 19 nt, artificial
  Chemically synthesized
agggagcuggcugcccuga

SEQ ID NO: 5014 - RNA, 19 nt, artificial
  Chemically synthesized
gcccugaagcucaggccgc

SEQ ID NO: 5015 - RNA, 19 nt, artificial
  Chemically synthesized
gugguccgacaggcuguuu

SEQ ID NO: 5016 - RNA, 19 nt, artificial
  Chemically synthesized
gaccaaaagacuucauuua

SEQ ID NO: 5017 - RNA, 19 nt, artificial
  Chemically synthesized
gcuuucaugcugaccgcga

SEQ ID NO: 5018 - RNA, 19 nt, artificial
  Chemically synthesized
cgggagaugcccaggcugu

SEQ ID NO: 5019 - RNA, 19 nt, artificial
  Chemically synthesized
ggcugacaauagugggaug

SEQ ID NO: 5020 - RNA, 19 nt, artificial
  Chemically synthesized
cgaugacgugcugcaggau

SEQ ID NO: 5021 - RNA, 19 nt, artificial
  Chemically synthesized
gcgaguccagggcgaucug

SEQ ID NO: 5022 - RNA, 19 nt, artificial
  Chemically synthesized
ggcaauuccuugugauuuu

SEQ ID NO: 5023 - RNA, 19 nt, artificial
  Chemically synthesized
ggguuuugcuccgggagau

SEQ ID NO: 5024 - RNA, 19 nt, artificial
  Chemically synthesized
gaccgggagggagcuggcu

SEQ ID NO: 5025 - RNA, 19 nt, artificial
  Chemically synthesized
gggcaauuccuugugauuu

SEQ ID NO: 5026 - RNA, 19 nt, artificial
  Chemically synthesized
gcguccuggacgccugguu

SEQ ID NO: 5027 - RNA, 19 nt, artificial
  Chemically synthesized
acgcuccaccuuugaaaaa

SEQ ID NO: 5028 - RNA, 19 nt, artificial
  Chemically synthesized
gacaggcuguuuuuccuaa

SEQ ID NO: 5029 - RNA, 19 nt, artificial
  Chemically synthesized
cucugccacuauacaagaa

SEQ ID NO: 5030 - RNA, 19 nt, artificial
  Chemically synthesized
ggguggucagcggcguccu

SEQ ID NO: 5031 - RNA, 19 nt, artificial
  Chemically synthesized
gcacugguccucugaaaua

SEQ ID NO: 5032 - RNA, 19 nt, artificial
  Chemically synthesized
gcaauuccuugugauuuua

SEQ ID NO: 5033 - RNA, 19 nt, artificial
  Chemically synthesized
cggaccucacgggacugaa

SEQ ID NO: 5034 - RNA, 19 nt, artificial
  Chemically synthesized
ggcuguuuuuccuaacgga

SEQ ID NO: 5035 - RNA, 19 nt, artificial
  Chemically synthesized
gguggucagcggcguccug

SEQ ID NO: 5036 - RNA, 19 nt, artificial
  Chemically synthesized
ggucagcggcguccuggac

SEQ ID NO: 5037 - RNA, 19 nt, artificial
  Chemically synthesized
ggaugcgaguccagggcga

SEQ ID NO: 5038 - RNA, 19 nt, artificial
  Chemically synthesized
cugccacuauacaagaaaa

SEQ ID NO: 5039 - RNA, 19 nt, artificial
  Chemically synthesized
cccugggaagaugaucauu

SEQ ID NO: 5040 - RNA, 19 nt, artificial
  Chemically synthesized
gggcauuuaaaagucuuuu

SEQ ID NO: 5041 - RNA, 19 nt, artificial
  Chemically synthesized
gcaggcaaucaccauucaa

SEQ ID NO: 5042 - RNA, 19 nt, artificial
  Chemically synthesized
cugcagaaagggcauuuaa

SEQ ID NO: 5043 - RNA, 19 nt, artificial
  Chemically synthesized
gggagcuggcugcccugaa

SEQ ID NO: 5044 - RNA, 19 nt, artificial
  Chemically synthesized
gcugcaggauuuccaucuu

SEQ ID NO: 5045 - RNA, 19 nt, artificial
  Chemically synthesized
cgagaccgggagggagcug

SEQ ID NO: 5046 - RNA, 19 nt, artificial
  Chemically synthesized
gcagaaagggcauuuaaaa

SEQ ID NO: 5047 - RNA, 19 nt, artificial
  Chemically synthesized
ggguuaaguuuacaacuaa

SEQ ID NO: 5048 - RNA, 19 nt, artificial
  Chemically synthesized
ggcaaucaccauucaauaa

SEQ ID NO: 5049 - RNA, 19 nt, artificial
  Chemically synthesized
ccuaacggaccucacggga

SEQ ID NO: 5050 - RNA, 19 nt, artificial
  Chemically synthesized
gcgagaccgggagggagcu

SEQ ID NO: 5051 - RNA, 19 nt, artificial
  Chemically synthesized
gggcgaucugcagguccaa

SEQ ID NO: 5052 - RNA, 19 nt, Artificial Sequence
  Chemically synthesized
ggcguccuggacgccuggu

SEQ ID NO: 5053 - RNA, 18 nt, artificial
  Chemically synthesized
ccagaaggauccaguauu

SEQ ID NO: 5054 - RNA, 18 nt, artificial
  Chemically synthesized
ggaaggaaaacuaagaau

SEQ ID NO: 5055 - RNA, 18 nt, artificial
  Chemically synthesized
ggaccagugcuuugauuu

SEQ ID NO: 5056 - RNA, 18 nt, artificial
  Chemically synthesized
ggcagagaugucuauuuc

SEQ ID NO: 5057 - RNA, 18 nt, artificial
  Chemically synthesized
guuggaagguuuucuuua

SEQ ID NO: 5058 - RNA, 18 nt, artificial
  Chemically synthesized
cccagaacaagaagguga

SEQ ID NO: 5059 - RNA, 18 nt, artificial
  Chemically synthesized
cuuguauaguggcagaga

SEQ ID NO: 5060 - RNA, 18 nt, artificial
  Chemically synthesized
gcccaaucuaagcagacu

SEQ ID NO: 5061 - RNA, 18 nt, artificial
  Chemically synthesized
cgugaauaccagaaggau

SEQ ID NO: 5062 - RNA, 18 nt, artificial
  Chemically synthesized
guggcagagaugucuauu

SEQ ID NO: 5063 - RNA, 18 nt, artificial
  Chemically synthesized
cccaaucuaagcagacuu

SEQ ID NO: 5064 - RNA, 18 nt, artificial
  Chemically synthesized
cuauuugagugaaaccuu

SEQ ID NO: 5065 - RNA, 18 nt, artificial
  Chemically synthesized
gcagagaugucuauuucu

SEQ ID NO: 5066 - RNA, 18 nt, artificial
  Chemically synthesized
cgguguucaugauuucuu

SEQ ID NO: 5067 - RNA, 18 nt, artificial
  Chemically synthesized
guguguuuauugaauggu

SEQ ID NO: 5068 - RNA, 18 nt, artificial
  Chemically synthesized
gguggagcgugaauacca

SEQ ID NO: 5069 - RNA, 18 nt, artificial
  Chemically synthesized
ccuacugaaugcugugua

SEQ ID NO: 5070 - RNA, 18 nt, artificial
  Chemically synthesized
caaucuaagcagacuuug

SEQ ID NO: 5071 - RNA, 18 nt, artificial
  Chemically synthesized
gcaugaaagccuucaguc

SEQ ID NO: 5072 - RNA, 18 nt, artificial
  Chemically synthesized
gguguucaugauuucuuu

SEQ ID NO: 5073 - RNA, 18 nt, artificial
  Chemically synthesized
ggacgaagggaagcucca

SEQ ID NO: 5074 - RNA, 18 nt, artificial
  Chemically synthesized
gaugucuauuucugcauu

SEQ ID NO: 5075 - RNA, 18 nt, artificial
  Chemically synthesized
agaaggauccaguauuca

SEQ ID NO: 5076 - RNA, 18 nt, artificial
  Chemically synthesized
gacacaagccuacugaau

SEQ ID NO: 5077 - RNA, 18 nt, artificial
  Chemically synthesized
cuugcaggcuucugaauu

SEQ ID NO: 5078 - RNA, 18 nt, artificial
  Chemically synthesized
ccuugugaacucuuuaau

SEQ ID NO: 5079 - RNA, 18 nt, artificial
  Chemically synthesized
cccuuucugcaguuggaa

SEQ ID NO: 5080 - RNA, 18 nt, artificial
  Chemically synthesized
cccucaacacggauauca

SEQ ID NO: 5081 - RNA, 18 nt, artificial
  Chemically synthesized
cggcgagugcggauaaaa

SEQ ID NO: 5082 - RNA, 18 nt, artificial
  Chemically synthesized
agcacgucaucgacuaca

SEQ ID NO: 5083 - RNA, 18 nt, artificial
  Chemically synthesized
gaacaagaaggugagcaa

SEQ ID NO: 5084 - RNA, 18 nt, artificial
  Chemically synthesized
gcaguuggaagguuuucu

SEQ ID NO: 5085 - RNA, 18 nt, artificial
  Chemically synthesized
gcacaacaacaacaacaa

SEQ ID NO: 5086 - RNA, 18 nt, artificial
  Chemically synthesized
gcuucugaauucccuucu

SEQ ID NO: 5087 - RNA, 18 nt, artificial
  Chemically synthesized
gaguuuucuuguauagug

SEQ ID NO: 5088 - RNA, 18 nt, artificial
  Chemically synthesized
accagaaggauccaguau

SEQ ID NO: 5089 - RNA, 18 nt, artificial
  Chemically synthesized
uggcagagaugucuauuu

SEQ ID NO: 5090 - RNA, 18 nt, artificial
  Chemically synthesized
ggcagaaccaggcgucca

SEQ ID NO: 5091 - RNA, 18 nt, artificial
  Chemically synthesized
ggugauugccugcuuuau

SEQ ID NO: 5092 - RNA, 18 nt, artificial
  Chemically synthesized
acaaauucacggaaucuu

SEQ ID NO: 5093 - RNA, 18 nt, artificial
  Chemically synthesized
ggcgagugcggauaaaag

SEQ ID NO: 5094 - RNA, 18 nt, artificial
  Chemically synthesized
acaacaaauucacggaau

SEQ ID NO: 5095 - RNA, 18 nt, artificial
  Chemically synthesized
ggaauugcccaaucuaag

SEQ ID NO: 5096 - RNA, 18 nt, artificial
  Chemically synthesized
agaugucuauuucugcau

SEQ ID NO: 5097 - RNA, 18 nt, artificial
  Chemically synthesized
ggacucgcaucccacuau

SEQ ID NO: 5098 - RNA, 18 nt, artificial
  Chemically synthesized
gcgugaauaccagaagga

SEQ ID NO: 5099 - RNA, 18 nt, artificial
  Chemically synthesized
ggucagaaauuaccuuuu

SEQ ID NO: 5100 - RNA, 18 nt, artificial
  Chemically synthesized
cugaaugcuguguauaua

SEQ ID NO: 5101 - RNA, 18 nt, artificial
  Chemically synthesized
ggcuucauucugagccga

SEQ ID NO: 5102 - RNA, 18 nt, artificial
  Chemically synthesized
ggauccaguauucaguca

SEQ ID NO: 5103 - RNA, 18 nt, artificial
  Chemically synthesized
gaaugaucaucuucccag

SEQ ID NO: 5104 - RNA, 18 nt, artificial
  Chemically synthesized
gugauugccugcuuuauu

SEQ ID NO: 5105 - RNA, 18 nt, artificial
  Chemically synthesized
gguguucucuuacuugga

SEQ ID NO: 5106 - RNA, 18 nt, artificial
  Chemically synthesized
ccaaucuaagcagacuuu

SEQ ID NO: 5107 - RNA, 18 nt, artificial
  Chemically synthesized
caagaaggugagcaagau

SEQ ID NO: 5108 - RNA, 18 nt, artificial
  Chemically synthesized
gucacuuaaaugaagucu

SEQ ID NO: 5109 - RNA, 18 nt, artificial
  Chemically synthesized
ggagcgugaauaccagaa

SEQ ID NO: 5110 - RNA, 18 nt, artificial
  Chemically synthesized
acgucaucgacuacaucu

SEQ ID NO: 5111 - RNA, 18 nt, artificial
  Chemically synthesized
ggccugagcuucagggca

SEQ ID NO: 5112 - RNA, 18 nt, artificial
  Chemically synthesized
ccugcuauacaacaugaa

SEQ ID NO: 5113 - RNA, 18 nt, artificial
  Chemically synthesized
caaccauuucacaaggag

SEQ ID NO: 5114 - RNA, 18 nt, artificial
  Chemically synthesized
cggucagcaugaaagccu

SEQ ID NO: 5115 - RNA, 18 nt, artificial
  Chemically synthesized
cggauaucagcauccugu

SEQ ID NO: 5116 - RNA, 18 nt, artificial
  Chemically synthesized
gcuucauucugagccgag

SEQ ID NO: 5117 - RNA, 18 nt, artificial
  Chemically synthesized
acaucuuggaccugcaga

SEQ ID NO: 5118 - RNA, 18 nt, artificial
  Chemically synthesized
caaauucacggaaucuuu

SEQ ID NO: 5119 - RNA, 18 nt, artificial
  Chemically synthesized
gagaugucuauuucugca

SEQ ID NO: 5120 - RNA, 18 nt, artificial
  Chemically synthesized
guguuuauugaaugguga

SEQ ID NO: 5121 - RNA, 18 nt, artificial
  Chemically synthesized
gagccugcuauacaacau

SEQ ID NO: 5122 - RNA, 18 nt, artificial
  Chemically synthesized
aggugagcaagauggaaa

SEQ ID NO: 5123 - RNA, 18 nt, artificial
  Chemically synthesized
guuguaaacuuaacccuu

SEQ ID NO: 5124 - RNA, 18 nt, artificial
  Chemically synthesized
ccagugcuuugauuuuua

SEQ ID NO: 5125 - RNA, 18 nt, artificial
  Chemically synthesized
ggucagcaugaaagccuu

SEQ ID NO: 5126 - RNA, 18 nt, artificial
  Chemically synthesized
acaagaaggugagcaaga

SEQ ID NO: 5127 - RNA, 18 nt, artificial
  Chemically synthesized
gagcgugaauaccagaag

SEQ ID NO: 5128 - RNA, 18 nt, artificial
  Chemically synthesized
gauccaguauucagucac

SEQ ID NO: 5129 - RNA, 18 nt, artificial
  Chemically synthesized
gaaggauccaguauucag

SEQ ID NO: 5130 - RNA, 18 nt, artificial
  Chemically synthesized
cuaagaaugaucaucuuc

SEQ ID NO: 5131 - RNA, 18 nt, artificial
  Chemically synthesized
gaccagugcuuugauuuu

SEQ ID NO: 5132 - RNA, 18 nt, artificial
  Chemically synthesized
aggguguucucuuacuug

SEQ ID NO: 5133 - RNA, 18 nt, artificial
  Chemically synthesized
ucugcaguuggaagguuu

SEQ ID NO: 5134 - RNA, 18 nt, artificial
  Chemically synthesized
cacggaaucuuuuaagug

SEQ ID NO: 5135 - RNA, 18 nt, artificial
  Chemically synthesized
cugcuauacaacaugaac

SEQ ID NO: 5136 - RNA, 18 nt, artificial
  Chemically synthesized
gugaauaccagaaggauc

SEQ ID NO: 5137 - RNA, 18 nt, artificial
  Chemically synthesized
ggacugugauauucguua

SEQ ID NO: 5138 - RNA, 18 nt, artificial
  Chemically synthesized
cugcuuuauuucagagga

SEQ ID NO: 5139 - RNA, 18 nt, artificial
  Chemically synthesized
cagagacccgggcagaac

SEQ ID NO: 5140 - RNA, 18 nt, artificial
  Chemically synthesized
cgucaucgacuacaucuu

SEQ ID NO: 5141 - RNA, 18 nt, artificial
  Chemically synthesized
gcgaaaacguuaaaauca

SEQ ID NO: 5142 - RNA, 18 nt, artificial
  Chemically synthesized
cagagaugucuauuucug

SEQ ID NO: 5143 - RNA, 18 nt, artificial
  Chemically synthesized
caggguguucucuuacuu

SEQ ID NO: 5144 - RNA, 18 nt, artificial
  Chemically synthesized
gcaucucccggagcaaaa

SEQ ID NO: 5145 - RNA, 18 nt, artificial
  Chemically synthesized
ccaggguguucucuuacu

SEQ ID NO: 5146 - RNA, 18 nt, artificial
  Chemically synthesized
cgcugaccacccucaaca

SEQ ID NO: 5147 - RNA, 18 nt, artificial
  Chemically synthesized
guauaguggcagagaugu

SEQ ID NO: 5148 - RNA, 18 nt, artificial
  Chemically synthesized
ccuuucugcaguuggaag

SEQ ID NO: 5149 - RNA, 18 nt, artificial
  Chemically synthesized
cgggcuucauucugagcc

SEQ ID NO: 5150 - RNA, 18 nt, artificial
  Chemically synthesized
gaugagccugcuauacaa

SEQ ID NO: 5151 - RNA, 18 nt, artificial
  Chemically synthesized
gccugcaucaccagagac

SEQ ID NO: 5152 - RNA, 18 nt, artificial
  Chemically synthesized
ugaucaucuucccagggu

SEQ ID NO: 5153 - RNA, 18 nt, artificial
  Chemically synthesized
agugaaaccuugugaacu

SEQ ID NO: 5154 - RNA, 18 nt, artificial
  Chemically synthesized
gcacgucaucgacuacau

SEQ ID NO: 5155 - RNA, 18 nt, artificial
  Chemically synthesized
uacugaaugcuguguaua

SEQ ID NO: 5156 - RNA, 18 nt, artificial
  Chemically synthesized
cucgcaucccacuauugu

SEQ ID NO: 5157 - RNA, 18 nt, artificial
  Chemically synthesized
gcaucaccagagacccgg

SEQ ID NO: 5158 - RNA, 18 nt, artificial
  Chemically synthesized
ccagagacccgggcagaa

SEQ ID NO: 5159 - RNA, 18 nt, artificial
  Chemically synthesized
uauacaacaugaacgacu

SEQ ID NO: 5160 - RNA, 18 nt, artificial
  Chemically synthesized
ggagcgaaaacguuaaaa

SEQ ID NO: 5161 - RNA, 18 nt, artificial
  Chemically synthesized
cuuacuuggacugugaua

SEQ ID NO: 5162 - RNA, 18 nt, artificial
  Chemically synthesized
gcagcacgucaucgacua

SEQ ID NO: 5163 - RNA, 18 nt, artificial
  Chemically synthesized
ccugcaucaccagagacc

SEQ ID NO: 5164 - RNA, 18 nt, artificial
  Chemically synthesized
gaacgacugcuacuccaa

SEQ ID NO: 5165 - RNA, 18 nt, artificial
  Chemically synthesized
cccaggguguucucuuac

SEQ ID NO: 5166 - RNA, 18 nt, artificial
  Chemically synthesized
agccugcaucaccagaga

SEQ ID NO: 5167 - RNA, 18 nt, artificial
  Chemically synthesized
gacucgcaucccacuauu

SEQ ID NO: 5168 - RNA, 18 nt, artificial
  Chemically synthesized
ucuauuugagugaaaccu

SEQ ID NO: 5169 - RNA, 18 nt, artificial
  Chemically synthesized
gggcucgggcuucauucu

SEQ ID NO: 5170 - RNA, 18 nt, artificial
  Chemically synthesized
caguuggaagguuuucuu

SEQ ID NO: 5171 - RNA, 18 nt, artificial
  Chemically synthesized
ggaccacagccugggcau

SEQ ID NO: 5172 - RNA, 18 nt, artificial
  Chemically synthesized
caacaugaacgacugcua

SEQ ID NO: 5173 - RNA, 18 nt, artificial
  Chemically synthesized
acacaagccuacugaaug

SEQ ID NO: 5174 - RNA, 18 nt, artificial
  Chemically synthesized
ugagccugcuauacaaca

SEQ ID NO: 5175 - RNA, 18 nt, artificial
  Chemically synthesized
gaagggaagcuccagcgu

SEQ ID NO: 5176 - RNA, 18 nt, artificial
  Chemically synthesized
gcuauacaacaugaacga

SEQ ID NO: 5177 - RNA, 18 nt, artificial
  Chemically synthesized
gaaaccuugugaacucuu

SEQ ID NO: 5178 - RNA, 18 nt, artificial
  Chemically synthesized
cggaaucuuuuaagugcu

SEQ ID NO: 5179 - RNA, 18 nt, artificial
  Chemically synthesized
gcgguguucaugauuucu

SEQ ID NO: 5180 - RNA, 18 nt, artificial
  Chemically synthesized
agucuuuuggucagaaau

SEQ ID NO: 5181 - RNA, 18 nt, artificial
  Chemically synthesized
ccacccucaacacggaua

SEQ ID NO: 5182 - RNA, 18 nt, artificial
  Chemically synthesized
cugaauucccuucugagu

SEQ ID NO: 5183 - RNA, 18 nt, artificial
  Chemically synthesized
caagccuacugaaugcug

SEQ ID NO: 5184 - RNA, 18 nt, artificial
  Chemically synthesized
gcucgggcuucauucuga

SEQ ID NO: 5185 - RNA, 18 nt, artificial
  Chemically synthesized
ccagaacaagaaggugag

SEQ ID NO: 5186 - RNA, 18 nt, artificial
  Chemically synthesized
uccuguccuugcaggcuu

SEQ ID NO: 5187 - RNA, 18 nt, artificial
  Chemically synthesized
gagcgaaaacguuaaaau

SEQ ID NO: 5188 - RNA, 18 nt, artificial
  Chemically synthesized
agcaugaaagccuucagu

SEQ ID NO: 5189 - RNA, 18 nt, artificial
  Chemically synthesized
ccugcagcacgucaucga

SEQ ID NO: 5190 - RNA, 18 nt, artificial
  Chemically synthesized
aggaauugcccaaucuaa

SEQ ID NO: 5191 - RNA, 18 nt, artificial
  Chemically synthesized
guuauaacugaacccaaa

SEQ ID NO: 5192 - RNA, 18 nt, artificial
  Chemically synthesized
gagugcggauaaaagccg

SEQ ID NO: 5193 - RNA, 18 nt, artificial
  Chemically synthesized
ggagcuggugcccagcau

SEQ ID NO: 5194 - RNA, 18 nt, artificial
  Chemically synthesized
ccuugcaggcuucugaau

SEQ ID NO: 5195 - RNA, 18 nt, artificial
  Chemically synthesized
ugauguacuuauucaugc

SEQ ID NO: 5196 - RNA, 18 nt, artificial
  Chemically synthesized
caacacggauaucagcau

SEQ ID NO: 5197 - RNA, 18 nt, artificial
  Chemically synthesized
aggaccagugcuuugauu

SEQ ID NO: 5198 - RNA, 18 nt, artificial
  Chemically synthesized
gccgcugaccacccucaa

SEQ ID NO: 5199 - RNA, 18 nt, artificial
  Chemically synthesized
cuuuuugacacaagccua

SEQ ID NO: 5200 - RNA, 18 nt, artificial
  Chemically synthesized
uggucagaaauuaccuuu

SEQ ID NO: 5201 - RNA, 18 nt, artificial
  Chemically synthesized
caugaaagccuucagucc

SEQ ID NO: 5202 - RNA, 18 nt, artificial
  Chemically synthesized
uggaaggaaaacuaagaa

SEQ ID NO: 5203 - RNA, 18 nt, artificial
  Chemically synthesized
augucaaaugacagcaaa

SEQ ID NO: 5204 - RNA, 18 nt, artificial
  Chemically synthesized
cgccuucccucgcgguca

SEQ ID NO: 5205 - RNA, 18 nt, artificial
  Chemically synthesized
gaggaccagugcuuugau

SEQ ID NO: 5206 - RNA, 18 nt, artificial
  Chemically synthesized
guguucucuuacuuggac

SEQ ID NO: 5207 - RNA, 18 nt, artificial
  Chemically synthesized
ggaccugcagaucgcccu

SEQ ID NO: 5208 - RNA, 18 nt, artificial
  Chemically synthesized
agcagacuuugccuuuuu

SEQ ID NO: 5209 - RNA, 18 nt, artificial
  Chemically synthesized
cacuauugucagccugca

SEQ ID NO: 5210 - RNA, 18 nt, artificial
  Chemically synthesized
ugcccaaucuaagcagac

SEQ ID NO: 5211 - RNA, 18 nt, artificial
  Chemically synthesized
cccacuauugucagccug

SEQ ID NO: 5212 - RNA, 18 nt, artificial
  Chemically synthesized
aaagguggagcgugaaua

SEQ ID NO: 5213 - RNA, 18 nt, artificial
  Chemically synthesized
agccuucagucccgugag

SEQ ID NO: 5214 - RNA, 18 nt, artificial
  Chemically synthesized
cguuaaaaucacaaggaa

SEQ ID NO: 5215 - RNA, 18 nt, artificial
  Chemically synthesized
agaaugaucaucuuccca

SEQ ID NO: 5216 - RNA, 18 nt, artificial
  Chemically synthesized
cugcaguuggaagguuuu

SEQ ID NO: 5217 - RNA, 18 nt, artificial
  Chemically synthesized
cagucacuuaaaugaagu

SEQ ID NO: 5218 - RNA, 18 nt, artificial
  Chemically synthesized
gucaucgacuacaucuug

SEQ ID NO: 5219 - RNA, 18 nt, artificial
  Chemically synthesized
ggauaucagcauccuguc

SEQ ID NO: 5220 - RNA, 18 nt, artificial
  Chemically synthesized
cuuggacugugauauucg

SEQ ID NO: 5221 - RNA, 18 nt, artificial
  Chemically synthesized
ccucaacacggauaucag

SEQ ID NO: 5222 - RNA, 18 nt, artificial
  Chemically synthesized
cccgaugagccugcuaua

SEQ ID NO: 5223 - RNA, 18 nt, artificial
  Chemically synthesized
gcagacuuugccuuuuuu

SEQ ID NO: 5224 - RNA, 18 nt, artificial
  Chemically synthesized
ggacgacccgaugagccu

SEQ ID NO: 5225 - RNA, 18 nt, artificial
  Chemically synthesized
cucuuacuuggacuguga

SEQ ID NO: 5226 - RNA, 18 nt, artificial
  Chemically synthesized
caacaaauucacggaauc

SEQ ID NO: 5227 - RNA, 18 nt, artificial
  Chemically synthesized
cacggauaucagcauccu

SEQ ID NO: 5228 - RNA, 18 nt, artificial
  Chemically synthesized
cuguguggcugaauaagc

SEQ ID NO: 5229 - RNA, 18 nt, artificial
  Chemically synthesized
gcuauguuauaacugaac

SEQ ID NO: 5230 - RNA, 18 nt, artificial
  Chemically synthesized
gccugagcuucagggcag

SEQ ID NO: 5231 - RNA, 18 nt, artificial
  Chemically synthesized
ugcagaucgcccuggacu

SEQ ID NO: 5232 - RNA, 18 nt, artificial
  Chemically synthesized
uaguggcagagaugucua

SEQ ID NO: 5233 - RNA, 18 nt, artificial
  Chemically synthesized
gccugcuuuauuucagag

SEQ ID NO: 5234 - RNA, 18 nt, artificial
  Chemically synthesized
aagggaagcuccagcgug

SEQ ID NO: 5235 - RNA, 18 nt, artificial
  Chemically synthesized
aacaaauucacggaaucu

SEQ ID NO: 5236 - RNA, 18 nt, artificial
  Chemically synthesized
aguggcagagaugucuau

SEQ ID NO: 5237 - RNA, 18 nt, artificial
  Chemically synthesized
agcgcagcuagcucagca

SEQ ID NO: 5238 - RNA, 18 nt, artificial
  Chemically synthesized
gacuacaucuuggaccug

SEQ ID NO: 5239 - RNA, 18 nt, artificial
  Chemically synthesized
cggaccacagccugggca

SEQ ID NO: 5240 - RNA, 18 nt, artificial
  Chemically synthesized
cuucccaggguguucucu

SEQ ID NO: 5241 - RNA, 18 nt, artificial
  Chemically synthesized
caacaacaacaaauucac

SEQ ID NO: 5242 - RNA, 18 nt, artificial
  Chemically synthesized
ugagcaagauggaaaucc

SEQ ID NO: 5243 - RNA, 18 nt, artificial
  Chemically synthesized
ggcugaauaagcgguguu

SEQ ID NO: 5244 - RNA, 18 nt, artificial
  Chemically synthesized
uucugcaguuggaagguu

SEQ ID NO: 5245 - RNA, 18 nt, artificial
  Chemically synthesized
gagcaagauggaaauccu

SEQ ID NO: 5246 - RNA, 18 nt, artificial
  Chemically synthesized
cugcauucaaaaguguaa

SEQ ID NO: 5247 - RNA, 18 nt, artificial
  Chemically synthesized
gagugaaaccuugugaac

SEQ ID NO: 5248 - RNA, 18 nt, artificial
  Chemically synthesized
gcgagugcggauaaaagc

SEQ ID NO: 5249 - RNA, 18 nt, artificial
  Chemically synthesized
accacagccugggcaucu

SEQ ID NO: 5250 - RNA, 18 nt, artificial
  Chemically synthesized
ggaaauccugcagcacgu

SEQ ID NO: 5251 - RNA, 18 nt, artificial
  Chemically synthesized
gguccguuaggaaaaaca

SEQ ID NO: 5252 - RNA, 18 nt, artificial
  Chemically synthesized
gccugucggaccacagcc

SEQ ID NO: 5253 - RNA, 18 nt, artificial
  Chemically synthesized
cacaaggaauugcccaau

SEQ ID NO: 5254 - RNA, 18 nt, artificial
  Chemically synthesized
ggugagcaagauggaaau

SEQ ID NO: 5255 - RNA, 18 nt, artificial
  Chemically synthesized
cugcuacuccaagcucaa

SEQ ID NO: 5256 - RNA, 18 nt, artificial
  Chemically synthesized
ccaagcgcagcuagcuca

SEQ ID NO: 5257 - RNA, 18 nt, artificial
  Chemically synthesized
ugagcuucagggcagcca

SEQ ID NO: 5258 - RNA, 18 nt, artificial
  Chemically synthesized
ggucucgccuucccucgc

SEQ ID NO: 5259 - RNA, 18 nt, artificial
  Chemically synthesized
cccuguggacgacccgau

SEQ ID NO: 5260 - RNA, 18 nt, artificial
  Chemically synthesized
cacccucaacacggauau

SEQ ID NO: 5261 - RNA, 18 nt, artificial
  Chemically synthesized
cccuggacucgcauccca

SEQ ID NO: 5262 - RNA, 18 nt, artificial
  Chemically synthesized
cugcaucaccagagaccc

SEQ ID NO: 5263 - RNA, 18 nt, artificial
  Chemically synthesized
ccuucagucccgugaggu

SEQ ID NO: 5264 - RNA, 18 nt, artificial
  Chemically synthesized
cuauacaacaugaacgac

SEQ ID NO: 5265 - RNA, 18 nt, artificial
  Chemically synthesized
caucuuggaccugcagau

SEQ ID NO: 5266 - RNA, 18 nt, artificial
  Chemically synthesized
ugccuuuuuucaaaggug

SEQ ID NO: 5267 - RNA, 18 nt, artificial
  Chemically synthesized
uggaaauccugcagcacg

SEQ ID NO: 5268 - RNA, 18 nt, artificial
  Chemically synthesized
cacgucaucgacuacauc

SEQ ID NO: 5269 - RNA, 18 nt, artificial
  Chemically synthesized
ccgggcagaaccaggcgu

SEQ ID NO: 5270 - RNA, 18 nt, artificial
  Chemically synthesized
ggcuucugaauucccuuc

SEQ ID NO: 5271 - RNA, 18 nt, artificial
  Chemically synthesized
uguucucuuacuuggacu

SEQ ID NO: 5272 - RNA, 18 nt, artificial
  Chemically synthesized
ccugcagaucgcccugga

SEQ ID NO: 5273 - RNA, 18 nt, artificial
  Chemically synthesized
gacccgaugagccugcua

SEQ ID NO: 5274 - RNA, 18 nt, artificial
  Chemically synthesized
auaucagcauccuguccu

SEQ ID NO: 5275 - RNA, 18 nt, artificial
  Chemically synthesized
aggcuucugaauucccuu

SEQ ID NO: 5276 - RNA, 18 nt, artificial
  Chemically synthesized
acaugaacgacugcuacu

SEQ ID NO: 5277 - RNA, 18 nt, artificial
  Chemically synthesized
acuccaagcucaaggagc

SEQ ID NO: 5278 - RNA, 18 nt, artificial
  Chemically synthesized
cugaauaagcgguguuca

SEQ ID NO: 5279 - RNA, 18 nt, artificial
  Chemically synthesized
uaagaaugaucaucuucc

SEQ ID NO: 5280 - RNA, 18 nt, artificial
  Chemically synthesized
ccgggcucgggcuucauu

SEQ ID NO: 5281 - RNA, 18 nt, artificial
  Chemically synthesized
gaucaucuucccagggug

SEQ ID NO: 5282 - RNA, 18 nt, artificial
  Chemically synthesized
uuguauaguggcagagau

SEQ ID NO: 5283 - RNA, 18 nt, artificial
  Chemically synthesized
aguuguaaacuuaacccu

SEQ ID NO: 5284 - RNA, 18 nt, artificial
  Chemically synthesized
ugagugaaaccuugugaa

SEQ ID NO: 5285 - RNA, 18 nt, artificial
  Chemically synthesized
uggugauugccugcuuua

SEQ ID NO: 5286 - RNA, 18 nt, artificial
  Chemically synthesized
ccuuuuuucaaaggugga

SEQ ID NO: 5287 - RNA, 18 nt, artificial
  Chemically synthesized
gacgaagggaagcuccag

SEQ ID NO: 5288 - RNA, 18 nt, artificial
  Chemically synthesized
caggcuucugaauucccu

SEQ ID NO: 5289 - RNA, 18 nt, artificial
  Chemically synthesized
aacaacaaauucacggaa

SEQ ID NO: 5290 - RNA, 18 nt, artificial
  Chemically synthesized
ccagcucccucccggucu

SEQ ID NO: 5291 - RNA, 18 nt, artificial
  Chemically synthesized
gaauggugauugccugcu

SEQ ID NO: 5292 - RNA, 18 nt, artificial
  Chemically synthesized
ugcuuuauuucagaggac

SEQ ID NO: 5293 - RNA, 18 nt, artificial
  Chemically synthesized
aagucuuuuggucagaaa

SEQ ID NO: 5294 - RNA, 18 nt, artificial
  Chemically synthesized
gccugggcaucucccgga

SEQ ID NO: 5295 - RNA, 18 nt, artificial
  Chemically synthesized
gcaucccacuauugucag

SEQ ID NO: 5296 - RNA, 18 nt, artificial
  Chemically synthesized
aagcgguguucaugauuu

SEQ ID NO: 5297 - RNA, 18 nt, artificial
  Chemically synthesized
ugacacaagccuacugaa

SEQ ID NO: 5298 - RNA, 18 nt, artificial
  Chemically synthesized
aagccuacugaaugcugu

SEQ ID NO: 5299 - RNA, 18 nt, artificial
  Chemically synthesized
uaccagaaggauccagua

SEQ ID NO: 5300 - RNA, 18 nt, artificial
  Chemically synthesized
gcuucagggcagccagcu

SEQ ID NO: 5301 - RNA, 18 nt, artificial
  Chemically synthesized
ucuuuuaagugcugaacu

SEQ ID NO: 5302 - RNA, 18 nt, artificial
  Chemically synthesized
cuuuuuucaaagguggag

SEQ ID NO: 5303 - RNA, 18 nt, artificial
  Chemically synthesized
gggaagcuccagcgugug

SEQ ID NO: 5304 - RNA, 18 nt, artificial
  Chemically synthesized
gagcuucagggcagccag

SEQ ID NO: 5305 - RNA, 18 nt, artificial
  Chemically synthesized
cuaagcagacuuugccuu

SEQ ID NO: 5306 - RNA, 18 nt, artificial
  Chemically synthesized
agcucaaggagcuggugc

SEQ ID NO: 5307 - RNA, 18 nt, artificial
  Chemically synthesized
cgggcucgggcuucauuc

SEQ ID NO: 5308 - RNA, 18 nt, artificial
  Chemically synthesized
cacuguguggcugaauaa

SEQ ID NO: 5309 - RNA, 18 nt, artificial
  Chemically synthesized
uucuuugcacaacaacaa

SEQ ID NO: 5310 - RNA, 18 nt, artificial
  Chemically synthesized
aucuauuugagugaaacc

SEQ ID NO: 5311 - RNA, 18 nt, artificial
  Chemically synthesized
cuacaucuuggaccugca

SEQ ID NO: 5312 - RNA, 18 nt, artificial
  Chemically synthesized
guguggcugaauaagcgg

SEQ ID NO: 5313 - RNA, 18 nt, artificial
  Chemically synthesized
agaggaccagugcuuuga

SEQ ID NO: 5314 - RNA, 18 nt, artificial
  Chemically synthesized
gcagcuagcucagcaggc

SEQ ID NO: 5315 - RNA, 18 nt, artificial
  Chemically synthesized
cagccugucggaccacag

SEQ ID NO: 5316 - RNA, 18 nt, artificial
  Chemically synthesized
cucgcggucagcaugaaa

SEQ ID NO: 5317 - RNA, 18 nt, artificial
  Chemically synthesized
auauacuauucccaccau

SEQ ID NO: 5318 - RNA, 18 nt, artificial
  Chemically synthesized
gagacccgggcagaacca

SEQ ID NO: 5319 - RNA, 18 nt, artificial
  Chemically synthesized
ggugccaagcgcagcuag

SEQ ID NO: 5320 - RNA, 18 nt, artificial
  Chemically synthesized
ugccugcuuuauuucaga

SEQ ID NO: 5321 - RNA, 18 nt, artificial
  Chemically synthesized
ucgacuacaucuuggacc

SEQ ID NO: 5322 - RNA, 18 nt, artificial
  Chemically synthesized
acggaaucuuuuaagugc

SEQ ID NO: 5323 - RNA, 18 nt, artificial
  Chemically synthesized
cuguccuugcaggcuucu

SEQ ID NO: 5324 - RNA, 18 nt, artificial
  Chemically synthesized
ugcaguuggaagguuuuc

SEQ ID NO: 5325 - RNA, 18 nt, artificial
  Chemically synthesized
auugaauggugauugccu

SEQ ID NO: 5326 - RNA, 18 nt, artificial
  Chemically synthesized
cuauguuauaacugaacc

SEQ ID NO: 5327 - RNA, 18 nt, artificial
  Chemically synthesized
ccugucggaccacagccu

SEQ ID NO: 5328 - RNA, 18 nt, artificial
  Chemically synthesized
cccucccggucucgccuu

SEQ ID NO: 5329 - RNA, 18 nt, artificial
  Chemically synthesized
cuuuauuucagaggacca

SEQ ID NO: 5330 - RNA, 18 nt, artificial
  Chemically synthesized
caugaacgacugcuacuc

SEQ ID NO: 5331 - RNA, 18 nt, artificial
  Chemically synthesized
ccuggacucgcaucccac

SEQ ID NO: 5332 - RNA, 18 nt, artificial
  Chemically synthesized
aagaaggugagcaagaug

SEQ ID NO: 5333 - RNA, 18 nt, artificial
  Chemically synthesized
gcaggcuucugaauuccc

SEQ ID NO: 5334 - RNA, 18 nt, artificial
  Chemically synthesized
cuuucugcaguuggaagg

SEQ ID NO: 5335 - RNA, 18 nt, artificial
  Chemically synthesized
ccaggacgccgcugacca

SEQ ID NO: 5336 - RNA, 18 nt, artificial
  Chemically synthesized
gaagcuccagcguguggc

SEQ ID NO: 5337 - RNA, 18 nt, artificial
  Chemically synthesized
aagccuucagucccguga

SEQ ID NO: 5338 - RNA, 18 nt, artificial
  Chemically synthesized
uacuuggacugugauauu

SEQ ID NO: 5339 - RNA, 18 nt, artificial
  Chemically synthesized
gauggaaauccugcagca

SEQ ID NO: 5340 - RNA, 18 nt, artificial
  Chemically synthesized
auuucacaaggaggacaa

SEQ ID NO: 5341 - RNA, 18 nt, artificial
  Chemically synthesized
ucuuggaccugcagaucg

SEQ ID NO: 5342 - RNA, 18 nt, artificial
  Chemically synthesized
acagccugucggaccaca

SEQ ID NO: 5343 - RNA, 18 nt, artificial
  Chemically synthesized
ugauugccugcuuuauuu

SEQ ID NO: 5344 - RNA, 18 nt, artificial
  Chemically synthesized
agggcagccagcucccuc

SEQ ID NO: 5345 - RNA, 18 nt, artificial
  Chemically synthesized
caaaugacagcaaagcac

SEQ ID NO: 5346 - RNA, 18 nt, artificial
  Chemically synthesized
cuguggacgacccgauga

SEQ ID NO: 5347 - RNA, 18 nt, artificial
  Chemically synthesized
acuauugucagccugcau

SEQ ID NO: 5348 - RNA, 18 nt, artificial
  Chemically synthesized
gcggcggccugagcuuca

SEQ ID NO: 5349 - RNA, 18 nt, artificial
  Chemically synthesized
aaugaagucuuuugguca

SEQ ID NO: 5350 - RNA, 18 nt, artificial
  Chemically synthesized
acuguguggcugaauaag

SEQ ID NO: 5351 - RNA, 18 nt, artificial
  Chemically synthesized
gaaaaacagccugucgga

SEQ ID NO: 5352 - RNA, 18 nt, artificial
  Chemically synthesized
caucgacuacaucuugga

SEQ ID NO: 5353 - RNA, 18 nt, artificial
  Chemically synthesized
cgacuacaucuuggaccu

SEQ ID NO: 5354 - RNA, 18 nt, artificial
  Chemically synthesized
acuuggacugugauauuc

SEQ ID NO: 5355 - RNA, 18 nt, artificial
  Chemically synthesized
augaaagccuucaguccc

SEQ ID NO: 5356 - RNA, 18 nt, artificial
  Chemically synthesized
ucugaauucccuucugag

SEQ ID NO: 5357 - RNA, 18 nt, artificial
  Chemically synthesized
cuucccucgcggucagca

SEQ ID NO: 5358 - RNA, 18 nt, artificial
  Chemically synthesized
agacccgggcagaaccag

SEQ ID NO: 5359 - RNA, 18 nt, artificial
  Chemically synthesized
cuucauucugagccgagc

SEQ ID NO: 5360 - RNA, 18 nt, artificial
  Chemically synthesized
aaucuaagcagacuuugc

SEQ ID NO: 5361 - RNA, 18 nt, artificial
  Chemically synthesized
accuugugaacucuuuaa

SEQ ID NO: 5362 - RNA, 18 nt, artificial
  Chemically synthesized
cugucggaccacagccug

SEQ ID NO: 5363 - RNA, 18 nt, artificial
  Chemically synthesized
uaagcagacuuugccuuu

SEQ ID NO: 5364 - RNA, 18 nt, artificial
  Chemically synthesized
uucacaaggaggacaagu

SEQ ID NO: 5365 - RNA, 18 nt, artificial
  Chemically synthesized
gcgcagcuagcucagcag

SEQ ID NO: 5366 - RNA, 18 nt, artificial
  Chemically synthesized
ucagcaugaaagccuuca

SEQ ID NO: 5367 - RNA, 18 nt, artificial
  Chemically synthesized
uucucuuacuuggacugu

SEQ ID NO: 5368 - RNA, 18 nt, artificial
  Chemically synthesized
cucgggcuucauucugag

SEQ ID NO: 5369 - RNA, 18 nt, artificial
  Chemically synthesized
agccugucggaccacagc

SEQ ID NO: 5370 - RNA, 18 nt, artificial
  Chemically synthesized
cgacugcuacuccaagcu

SEQ ID NO: 5371 - RNA, 18 nt, artificial
  Chemically synthesized
gugaaaccuugugaacuc

SEQ ID NO: 5372 - RNA, 18 nt, artificial
  Chemically synthesized
cgagugcggauaaaagcc

SEQ ID NO: 5373 - RNA, 18 nt, artificial
  Chemically synthesized
gaauaccagaaggaucca

SEQ ID NO: 5374 - RNA, 18 nt, artificial
  Chemically synthesized
caucuucccaggguguuc

SEQ ID NO: 5375 - RNA, 18 nt, artificial
  Chemically synthesized
accauuucacaaggagga

SEQ ID NO: 5376 - RNA, 18 nt, artificial
  Chemically synthesized
ugucagccugcaucacca

SEQ ID NO: 5377 - RNA, 18 nt, artificial
  Chemically synthesized
gacuuuuaaaugcccuuu

SEQ ID NO: 5378 - RNA, 18 nt, artificial
  Chemically synthesized
ggaagcuccagcgugugg

SEQ ID NO: 5379 - RNA, 18 nt, artificial
  Chemically synthesized
aaggauccaguauucagu

SEQ ID NO: 5380 - RNA, 18 nt, artificial
  Chemically synthesized
cgcaucccacuauuguca

SEQ ID NO: 5381 - RNA, 18 nt, artificial
  Chemically synthesized
agggaagcuccagcgugu

SEQ ID NO: 5382 - RNA, 18 nt, artificial
  Chemically synthesized
uucugaauucccuucuga

SEQ ID NO: 5383 - RNA, 18 nt, artificial
  Chemically synthesized
gucucgccuucccucgcg

SEQ ID NO: 5384 - RNA, 18 nt, artificial
  Chemically synthesized
uuugcacaacaacaacaa

SEQ ID NO: 5385 - RNA, 18 nt, artificial
  Chemically synthesized
aucuucccaggguguucu

SEQ ID NO: 5386 - RNA, 18 nt, artificial
  Chemically synthesized
ccacagccugggcaucuc

SEQ ID NO: 5387 - RNA, 18 nt, artificial
  Chemically synthesized
gcagaaccaggcguccag

SEQ ID NO: 5388 - RNA, 18 nt, artificial
  Chemically synthesized
agccuacugaaugcugug

SEQ ID NO: 5389 - RNA, 18 nt, artificial
  Chemically synthesized
cagccagcucccucccgg

SEQ ID NO: 5390 - RNA, 18 nt, artificial
  Chemically synthesized
gaaccaggcguccaggac

SEQ ID NO: 5391 - RNA, 18 nt, artificial
  Chemically synthesized
uggacucgcaucccacua

SEQ ID NO: 5392 - RNA, 18 nt, artificial
  Chemically synthesized
ucagccugcaucaccaga

SEQ ID NO: 5393 - RNA, 18 nt, artificial
  Chemically synthesized
cuuuuggucagaaauuac

SEQ ID NO: 5394 - RNA, 18 nt, artificial
  Chemically synthesized
cugaccacccucaacacg

SEQ ID NO: 5395 - RNA, 18 nt, artificial
  Chemically synthesized
cuuuuaaaugcccuuucu

SEQ ID NO: 5396 - RNA, 18 nt, artificial
  Chemically synthesized
uguauaguggcagagaug

SEQ ID NO: 5397 - RNA, 18 nt, artificial
  Chemically synthesized
aagcagacuuugccuuuu

SEQ ID NO: 5398 - RNA, 18 nt, artificial
  Chemically synthesized
aacgacugcuacuccaag

SEQ ID NO: 5399 - RNA, 18 nt, artificial
  Chemically synthesized
cagcaugaaagccuucag

SEQ ID NO: 5400 - RNA, 18 nt, artificial
  Chemically synthesized
auccaguauucagucacu

SEQ ID NO: 5401 - RNA, 18 nt, artificial
  Chemically synthesized
uuacuuggacugugauau

SEQ ID NO: 5402 - RNA, 18 nt, artificial
  Chemically synthesized
aauacuggauccuucugg

SEQ ID NO: 5403 - RNA, 18 nt, artificial
  Chemically synthesized
auucuuaguuuuccuucc

SEQ ID NO: 5404 - RNA, 18 nt, artificial
  Chemically synthesized
aaaucaaagcacuggucc

SEQ ID NO: 5405 - RNA, 18 nt, artificial
  Chemically synthesized
gaaauagacaucucugcc

SEQ ID NO: 5406 - RNA, 18 nt, artificial
  Chemically synthesized
uaaagaaaaccuuccaac

SEQ ID NO: 5407 - RNA, 18 nt, artificial
  Chemically synthesized
ucaccuucuuguucuggg

SEQ ID NO: 5408 - RNA, 18 nt, artificial
  Chemically synthesized
ucucugccacuauacaag

SEQ ID NO: 5409 - RNA, 18 nt, artificial
  Chemically synthesized
agucugcuuagauugggc

SEQ ID NO: 5410 - RNA, 18 nt, artificial
  Chemically synthesized
auccuucugguauucacg

SEQ ID NO: 5411 - RNA, 18 nt, artificial
  Chemically synthesized
aauagacaucucugccac

SEQ ID NO: 5412 - RNA, 18 nt, artificial
  Chemically synthesized
aagucugcuuagauuggg

SEQ ID NO: 5413 - RNA, 18 nt, artificial
  Chemically synthesized
aagguuucacucaaauag

SEQ ID NO: 5414 - RNA, 18 nt, artificial
  Chemically synthesized
agaaauagacaucucugc

SEQ ID NO: 5415 - RNA, 18 nt, artificial
  Chemically synthesized
aagaaaucaugaacaccg

SEQ ID NO: 5416 - RNA, 18 nt, artificial
  Chemically synthesized
accauucaauaaacacac

SEQ ID NO: 5417 - RNA, 18 nt, artificial
  Chemically synthesized
ugguauucacgcuccacc

SEQ ID NO: 5418 - RNA, 18 nt, artificial
  Chemically synthesized
uacacagcauucaguagg

SEQ ID NO: 5419 - RNA, 18 nt, artificial
  Chemically synthesized
caaagucugcuuagauug

SEQ ID NO: 5420 - RNA, 18 nt, artificial
  Chemically synthesized
gacugaaggcuuucaugc

SEQ ID NO: 5421 - RNA, 18 nt, artificial
  Chemically synthesized
aaagaaaucaugaacacc

SEQ ID NO: 5422 - RNA, 18 nt, artificial
  Chemically synthesized
uggagcuucccuucgucc

SEQ ID NO: 5423 - RNA, 18 nt, artificial
  Chemically synthesized
aaugcagaaauagacauc

SEQ ID NO: 5424 - RNA, 18 nt, artificial
  Chemically synthesized
ugaauacuggauccuucu

SEQ ID NO: 5425 - RNA, 18 nt, artificial
  Chemically synthesized
auucaguaggcuuguguc

SEQ ID NO: 5426 - RNA, 18 nt, artificial
  Chemically synthesized
aauucagaagccugcaag

SEQ ID NO: 5427 - RNA, 18 nt, artificial
  Chemically synthesized
auuaaagaguucacaagg

SEQ ID NO: 5428 - RNA, 18 nt, artificial
  Chemically synthesized
uuccaacugcagaaaggg

SEQ ID NO: 5429 - RNA, 18 nt, artificial
  Chemically synthesized
ugauauccguguugaggg

SEQ ID NO: 5430 - RNA, 18 nt, artificial
  Chemically synthesized
uuuuauccgcacucgccg

SEQ ID NO: 5431 - RNA, 18 nt, artificial
  Chemically synthesized
uguagucgaugacgugcu

SEQ ID NO: 5432 - RNA, 18 nt, artificial
  Chemically synthesized
uugcucaccuucuuguuc

SEQ ID NO: 5433 - RNA, 18 nt, artificial
  Chemically synthesized
agaaaaccuuccaacugc

SEQ ID NO: 5434 - RNA, 18 nt, artificial
  Chemically synthesized
uuguuguuguuguugugc

SEQ ID NO: 5435 - RNA, 18 nt, artificial
  Chemically synthesized
agaagggaauucagaagc

SEQ ID NO: 5436 - RNA, 18 nt, artificial
  Chemically synthesized
cacuauacaagaaaacuc

SEQ ID NO: 5437 - RNA, 18 nt, artificial
  Chemically synthesized
auacuggauccuucuggu

SEQ ID NO: 5438 - RNA, 18 nt, artificial
  Chemically synthesized
aaauagacaucucugcca

SEQ ID NO: 5439 - RNA, 18 nt, artificial
  Chemically synthesized
uggacgccugguucugcc

SEQ ID NO: 5440 - RNA, 18 nt, artificial
  Chemically synthesized
auaaagcaggcaaucacc

SEQ ID NO: 5441 - RNA, 18 nt, artificial
  Chemically synthesized
aagauuccgugaauuugu

SEQ ID NO: 5442 - RNA, 18 nt, artificial
  Chemically synthesized
cuuuuauccgcacucgcc

SEQ ID NO: 5443 - RNA, 18 nt, artificial
  Chemically synthesized
auuccgugaauuuguugu

SEQ ID NO: 5444 - RNA, 18 nt, artificial
  Chemically synthesized
cuuagauugggcaauucc

SEQ ID NO: 5445 - RNA, 18 nt, artificial
  Chemically synthesized
augcagaaauagacaucu

SEQ ID NO: 5446 - RNA, 18 nt, artificial
  Chemically synthesized
auagugggaugcgagucc

SEQ ID NO: 5447 - RNA, 18 nt, artificial
  Chemically synthesized
uccuucugguauucacgc

SEQ ID NO: 5448 - RNA, 18 nt, artificial
  Chemically synthesized
aaaagguaauuucugacc

SEQ ID NO: 5449 - RNA, 18 nt, artificial
  Chemically synthesized
uauauacacagcauucag

SEQ ID NO: 5450 - RNA, 18 nt, artificial
  Chemically synthesized
ucggcucagaaugaagcc

SEQ ID NO: 5451 - RNA, 18 nt, artificial
  Chemically synthesized
ugacugaauacuggaucc

SEQ ID NO: 5452 - RNA, 18 nt, artificial
  Chemically synthesized
cugggaagaugaucauuc

SEQ ID NO: 5453 - RNA, 18 nt, artificial
  Chemically synthesized
aauaaagcaggcaaucac

SEQ ID NO: 5454 - RNA, 18 nt, artificial
  Chemically synthesized
uccaaguaagagaacacc

SEQ ID NO: 5455 - RNA, 18 nt, artificial
  Chemically synthesized
aaagucugcuuagauugg

SEQ ID NO: 5456 - RNA, 18 nt, artificial
  Chemically synthesized
aucuugcucaccuucuug

SEQ ID NO: 5457 - RNA, 18 nt, artificial
  Chemically synthesized
agacuucauuuaagugac

SEQ ID NO: 5458 - RNA, 18 nt, artificial
  Chemically synthesized
uucugguauucacgcucc

SEQ ID NO: 5459 - RNA, 18 nt, artificial
  Chemically synthesized
agauguagucgaugacgu

SEQ ID NO: 5460 - RNA, 18 nt, artificial
  Chemically synthesized
ugcccugaagcucaggcc

SEQ ID NO: 5461 - RNA, 18 nt, artificial
  Chemically synthesized
uucauguuguauagcagg

SEQ ID NO: 5462 - RNA, 18 nt, artificial
  Chemically synthesized
cuccuugugaaaugguug

SEQ ID NO: 5463 - RNA, 18 nt, artificial
  Chemically synthesized
aggcuuucaugcugaccg

SEQ ID NO: 5464 - RNA, 18 nt, artificial
  Chemically synthesized
acaggaugcugauauccg

SEQ ID NO: 5465 - RNA, 18 nt, artificial
  Chemically synthesized
cucggcucagaaugaagc

SEQ ID NO: 5466 - RNA, 18 nt, artificial
  Chemically synthesized
ucugcagguccaagaugu

SEQ ID NO: 5467 - RNA, 18 nt, artificial
  Chemically synthesized
aaagauuccgugaauuug

SEQ ID NO: 5468 - RNA, 18 nt, artificial
  Chemically synthesized
ugcagaaauagacaucuc

SEQ ID NO: 5469 - RNA, 18 nt, artificial
  Chemically synthesized
ucaccauucaauaaacac

SEQ ID NO: 5470 - RNA, 18 nt, artificial
  Chemically synthesized
auguuguauagcaggcuc

SEQ ID NO: 5471 - RNA, 18 nt, artificial
  Chemically synthesized
uuuccaucuugcucaccu

SEQ ID NO: 5472 - RNA, 18 nt, artificial
  Chemically synthesized
aaggguuaaguuuacaac

SEQ ID NO: 5473 - RNA, 18 nt, artificial
  Chemically synthesized
uaaaaaucaaagcacugg

SEQ ID NO: 5474 - RNA, 18 nt, artificial
  Chemically synthesized
aaggcuuucaugcugacc

SEQ ID NO: 5475 - RNA, 18 nt, artificial
  Chemically synthesized
ucuugcucaccuucuugu

SEQ ID NO: 5476 - RNA, 18 nt, artificial
  Chemically synthesized
cuucugguauucacgcuc

SEQ ID NO: 5477 - RNA, 18 nt, artificial
  Chemically synthesized
gugacugaauacuggauc

SEQ ID NO: 5478 - RNA, 18 nt, artificial
  Chemically synthesized
cugaauacuggauccuuc

SEQ ID NO: 5479 - RNA, 18 nt, artificial
  Chemically synthesized
gaagaugaucauucuuag

SEQ ID NO: 5480 - RNA, 18 nt, artificial
  Chemically synthesized
aaaaucaaagcacugguc

SEQ ID NO: 5481 - RNA, 18 nt, artificial
  Chemically synthesized
caaguaagagaacacccu

SEQ ID NO: 5482 - RNA, 18 nt, artificial
  Chemically synthesized
aaaccuuccaacugcaga

SEQ ID NO: 5483 - RNA, 18 nt, artificial
  Chemically synthesized
cacuuaaaagauuccgug

SEQ ID NO: 5484 - RNA, 18 nt, artificial
  Chemically synthesized
guucauguuguauagcag

SEQ ID NO: 5485 - RNA, 18 nt, artificial
  Chemically synthesized
gauccuucugguauucac

SEQ ID NO: 5486 - RNA, 18 nt, artificial
  Chemically synthesized
uaacgaauaucacagucc

SEQ ID NO: 5487 - RNA, 18 nt, artificial
  Chemically synthesized
uccucugaaauaaagcag

SEQ ID NO: 5488 - RNA, 18 nt, artificial
  Chemically synthesized
guucugcccgggucucug

SEQ ID NO: 5489 - RNA, 18 nt, artificial
  Chemically synthesized
aagauguagucgaugacg

SEQ ID NO: 5490 - RNA, 18 nt, artificial
  Chemically synthesized
ugauuuuaacguuuucgc

SEQ ID NO: 5491 - RNA, 18 nt, artificial
  Chemically synthesized
cagaaauagacaucucug

SEQ ID NO: 5492 - RNA, 18 nt, artificial
  Chemically synthesized
aaguaagagaacacccug

SEQ ID NO: 5493 - RNA, 18 nt, artificial
  Chemically synthesized
uuuugcuccgggagaugc

SEQ ID NO: 5494 - RNA, 18 nt, artificial
  Chemically synthesized
aguaagagaacacccugg

SEQ ID NO: 5495 - RNA, 18 nt, artificial
  Chemically synthesized
uguugaggguggucagcg

SEQ ID NO: 5496 - RNA, 18 nt, artificial
  Chemically synthesized
acaucucugccacuauac

SEQ ID NO: 5497 - RNA, 18 nt, artificial
  Chemically synthesized
cuuccaacugcagaaagg

SEQ ID NO: 5498 - RNA, 18 nt, artificial
  Chemically synthesized
ggcucagaaugaagcccg

SEQ ID NO: 5499 - RNA, 18 nt, artificial
  Chemically synthesized
uuguauagcaggcucauc

SEQ ID NO: 5500 - RNA, 18 nt, artificial
  Chemically synthesized
gucucuggugaugcaggc

SEQ ID NO: 5501 - RNA, 18 nt, artificial
  Chemically synthesized
acccugggaagaugauca

SEQ ID NO: 5502 - RNA, 18 nt, artificial
  Chemically synthesized
aguucacaagguuucacu

SEQ ID NO: 5503 - RNA, 18 nt, artificial
  Chemically synthesized
auguagucgaugacgugc

SEQ ID NO: 5504 - RNA, 18 nt, artificial
  Chemically synthesized
uauacacagcauucagua

SEQ ID NO: 5505 - RNA, 18 nt, artificial
  Chemically synthesized
acaauagugggaugcgag

SEQ ID NO: 5506 - RNA, 18 nt, artificial
  Chemically synthesized
ccgggucucuggugaugc

SEQ ID NO: 5507 - RNA, 18 nt, artificial
  Chemically synthesized
uucugcccgggucucugg

SEQ ID NO: 5508 - RNA, 18 nt, artificial
  Chemically synthesized
agucguucauguuguaua

SEQ ID NO: 5509 - RNA, 18 nt, artificial
  Chemically synthesized
uuuuaacguuuucgcucc

SEQ ID NO: 5510 - RNA, 18 nt, artificial
  Chemically synthesized
uaucacaguccaaguaag

SEQ ID NO: 5511 - RNA, 18 nt, artificial
  Chemically synthesized
uagucgaugacgugcugc

SEQ ID NO: 5512 - RNA, 18 nt, artificial
  Chemically synthesized
ggucucuggugaugcagg

SEQ ID NO: 5513 - RNA, 18 nt, artificial
  Chemically synthesized
uuggaguagcagucguuc

SEQ ID NO: 5514 - RNA, 18 nt, artificial
  Chemically synthesized
guaagagaacacccuggg

SEQ ID NO: 5515 - RNA, 18 nt, artificial
  Chemically synthesized
ucucuggugaugcaggcu

SEQ ID NO: 5516 - RNA, 18 nt, artificial
  Chemically synthesized
aauagugggaugcgaguc

SEQ ID NO: 5517 - RNA, 18 nt, artificial
  Chemically synthesized
agguuucacucaaauaga

SEQ ID NO: 5518 - RNA, 18 nt, artificial
  Chemically synthesized
agaaugaagcccgagccc

SEQ ID NO: 5519 - RNA, 18 nt, artificial
  Chemically synthesized
aagaaaaccuuccaacug

SEQ ID NO: 5520 - RNA, 18 nt, artificial
  Chemically synthesized
augcccaggcuguggucc

SEQ ID NO: 5521 - RNA, 18 nt, artificial
  Chemically synthesized
uagcagucguucauguug

SEQ ID NO: 5522 - RNA, 18 nt, artificial
  Chemically synthesized
cauucaguaggcuugugu

SEQ ID NO: 5523 - RNA, 18 nt, artificial
  Chemically synthesized
uguuguauagcaggcuca

SEQ ID NO: 5524 - RNA, 18 nt, artificial
  Chemically synthesized
acgcuggagcuucccuuc

SEQ ID NO: 5525 - RNA, 18 nt, artificial
  Chemically synthesized
ucguucauguuguauagc

SEQ ID NO: 5526 - RNA, 18 nt, artificial
  Chemically synthesized
aagaguucacaagguuuc

SEQ ID NO: 5527 - RNA, 18 nt, artificial
  Chemically synthesized
agcacuuaaaagauuccg

SEQ ID NO: 5528 - RNA, 18 nt, artificial
  Chemically synthesized
agaaaucaugaacaccgc

SEQ ID NO: 5529 - RNA, 18 nt, artificial
  Chemically synthesized
auuucugaccaaaagacu

SEQ ID NO: 5530 - RNA, 18 nt, artificial
  Chemically synthesized
uauccguguugagggugg

SEQ ID NO: 5531 - RNA, 18 nt, artificial
  Chemically synthesized
acucagaagggaauucag

SEQ ID NO: 5532 - RNA, 18 nt, artificial
  Chemically synthesized
cagcauucaguaggcuug

SEQ ID NO: 5533 - RNA, 18 nt, artificial
  Chemically synthesized
ucagaaugaagcccgagc

SEQ ID NO: 5534 - RNA, 18 nt, artificial
  Chemically synthesized
cucaccuucuuguucugg

SEQ ID NO: 5535 - RNA, 18 nt, artificial
  Chemically synthesized
aagccugcaaggacagga

SEQ ID NO: 5536 - RNA, 18 nt, artificial
  Chemically synthesized
auuuuaacguuuucgcuc

SEQ ID NO: 5537 - RNA, 18 nt, artificial
  Chemically synthesized
acugaaggcuuucaugcu

SEQ ID NO: 5538 - RNA, 18 nt, artificial
  Chemically synthesized
ucgaugacgugcugcagg

SEQ ID NO: 5539 - RNA, 18 nt, artificial
  Chemically synthesized
uuagauugggcaauuccu

SEQ ID NO: 5540 - RNA, 18 nt, artificial
  Chemically synthesized
uuuggguucaguuauaac

SEQ ID NO: 5541 - RNA, 18 nt, artificial
  Chemically synthesized
cggcuuuuauccgcacuc

SEQ ID NO: 5542 - RNA, 18 nt, artificial
  Chemically synthesized
augcugggcaccagcucc

SEQ ID NO: 5543 - RNA, 18 nt, artificial
  Chemically synthesized
auucagaagccugcaagg

SEQ ID NO: 5544 - RNA, 18 nt, artificial
  Chemically synthesized
gcaugaauaaguacauca

SEQ ID NO: 5545 - RNA, 18 nt, artificial
  Chemically synthesized
augcugauauccguguug

SEQ ID NO: 5546 - RNA, 18 nt, artificial
  Chemically synthesized
aaucaaagcacugguccu

SEQ ID NO: 5547 - RNA, 18 nt, artificial
  Chemically synthesized
uugaggguggucagcggc

SEQ ID NO: 5548 - RNA, 18 nt, artificial
  Chemically synthesized
uaggcuugugucaaaaag

SEQ ID NO: 5549 - RNA, 18 nt, artificial
  Chemically synthesized
aaagguaauuucugacca

SEQ ID NO: 5550 - RNA, 18 nt, artificial
  Chemically synthesized
ggacugaaggcuuucaug

SEQ ID NO: 5551 - RNA, 18 nt, artificial
  Chemically synthesized
uucuuaguuuuccuucca

SEQ ID NO: 5552 - RNA, 18 nt, artificial
  Chemically synthesized
uuugcugucauuugacau

SEQ ID NO: 5553 - RNA, 18 nt, artificial
  Chemically synthesized
ugaccgcgagggaaggcg

SEQ ID NO: 5554 - RNA, 18 nt, artificial
  Chemically synthesized
aucaaagcacugguccuc

SEQ ID NO: 5555 - RNA, 18 nt, artificial
  Chemically synthesized
guccaaguaagagaacac

SEQ ID NO: 5556 - RNA, 18 nt, artificial
  Chemically synthesized
agggcgaucugcaggucc

SEQ ID NO: 5557 - RNA, 18 nt, artificial
  Chemically synthesized
aaaaaggcaaagucugcu

SEQ ID NO: 5558 - RNA, 18 nt, artificial
  Chemically synthesized
ugcaggcugacaauagug

SEQ ID NO: 5559 - RNA, 18 nt, artificial
  Chemically synthesized
gucugcuuagauugggca

SEQ ID NO: 5560 - RNA, 18 nt, artificial
  Chemically synthesized
caggcugacaauaguggg

SEQ ID NO: 5561 - RNA, 18 nt, artificial
  Chemically synthesized
uauucacgcuccaccuuu

SEQ ID NO: 5562 - RNA, 18 nt, artificial
  Chemically synthesized
cucacgggacugaaggcu

SEQ ID NO: 5563 - RNA, 18 nt, artificial
  Chemically synthesized
uuccuugugauuuuaacg

SEQ ID NO: 5564 - RNA, 18 nt, artificial
  Chemically synthesized
ugggaagaugaucauucu

SEQ ID NO: 5565 - RNA, 18 nt, artificial
  Chemically synthesized
aaaaccuuccaacugcag

SEQ ID NO: 5566 - RNA, 18 nt, artificial
  Chemically synthesized
acuucauuuaagugacug

SEQ ID NO: 5567 - RNA, 18 nt, artificial
  Chemically synthesized
caagauguagucgaugac

SEQ ID NO: 5568 - RNA, 18 nt, artificial
  Chemically synthesized
gacaggaugcugauaucc

SEQ ID NO: 5569 - RNA, 18 nt, artificial
  Chemically synthesized
cgaauaucacaguccaag

SEQ ID NO: 5570 - RNA, 18 nt, artificial
  Chemically synthesized
cugauauccguguugagg

SEQ ID NO: 5571 - RNA, 18 nt, artificial
  Chemically synthesized
uauagcaggcucaucggg

SEQ ID NO: 5572 - RNA, 18 nt, artificial
  Chemically synthesized
aaaaaaggcaaagucugc

SEQ ID NO: 5573 - RNA, 18 nt, artificial
  Chemically synthesized
aggcucaucgggucgucc

SEQ ID NO: 5574 - RNA, 18 nt, artificial
  Chemically synthesized
ucacaguccaaguaagag

SEQ ID NO: 5575 - RNA, 18 nt, artificial
  Chemically synthesized
gauuccgugaauuuguug

SEQ ID NO: 5576 - RNA, 18 nt, artificial
  Chemically synthesized
aggaugcugauauccgug

SEQ ID NO: 5577 - RNA, 18 nt, artificial
  Chemically synthesized
gcuuauucagccacacag

SEQ ID NO: 5578 - RNA, 18 nt, artificial
  Chemically synthesized
guucaguuauaacauagc

SEQ ID NO: 5579 - RNA, 18 nt, artificial
  Chemically synthesized
cugcccugaagcucaggc

SEQ ID NO: 5580 - RNA, 18 nt, artificial
  Chemically synthesized
aguccagggcgaucugca

SEQ ID NO: 5581 - RNA, 18 nt, artificial
  Chemically synthesized
uagacaucucugccacua

SEQ ID NO: 5582 - RNA, 18 nt, artificial
  Chemically synthesized
cucugaaauaaagcaggc

SEQ ID NO: 5583 - RNA, 18 nt, artificial
  Chemically synthesized
cacgcuggagcuucccuu

SEQ ID NO: 5584 - RNA, 18 nt, artificial
  Chemically synthesized
agauuccgugaauuuguu

SEQ ID NO: 5585 - RNA, 18 nt, artificial
  Chemically synthesized
auagacaucucugccacu

SEQ ID NO: 5586 - RNA, 18 nt, artificial
  Chemically synthesized
ugcugagcuagcugcgcu

SEQ ID NO: 5587 - RNA, 18 nt, artificial
  Chemically synthesized
cagguccaagauguaguc

SEQ ID NO: 5588 - RNA, 18 nt, artificial
  Chemically synthesized
ugcccaggcugugguccg

SEQ ID NO: 5589 - RNA, 18 nt, artificial
  Chemically synthesized
agagaacacccugggaag

SEQ ID NO: 5590 - RNA, 18 nt, artificial
  Chemically synthesized
gugaauuuguuguuguug

SEQ ID NO: 5591 - RNA, 18 nt, artificial
  Chemically synthesized
ggauuuccaucuugcuca

SEQ ID NO: 5592 - RNA, 18 nt, artificial
  Chemically synthesized
aacaccgcuuauucagcc

SEQ ID NO: 5593 - RNA, 18 nt, artificial
  Chemically synthesized
aaccuuccaacugcagaa

SEQ ID NO: 5594 - RNA, 18 nt, artificial
  Chemically synthesized
aggauuuccaucuugcuc

SEQ ID NO: 5595 - RNA, 18 nt, artificial
  Chemically synthesized
uuacacuuuugaaugcag

SEQ ID NO: 5596 - RNA, 18 nt, artificial
  Chemically synthesized
guucacaagguuucacuc

SEQ ID NO: 5597 - RNA, 18 nt, artificial
  Chemically synthesized
gcuuuuauccgcacucgc

SEQ ID NO: 5598 - RNA, 18 nt, artificial
  Chemically synthesized
agaugcccaggcuguggu

SEQ ID NO: 5599 - RNA, 18 nt, artificial
  Chemically synthesized
acgugcugcaggauuucc

SEQ ID NO: 5600 - RNA, 18 nt, artificial
  Chemically synthesized
uguuuuuccuaacggacc

SEQ ID NO: 5601 - RNA, 18 nt, artificial
  Chemically synthesized
ggcugugguccgacaggc

SEQ ID NO: 5602 - RNA, 18 nt, artificial
  Chemically synthesized
auugggcaauuccuugug

SEQ ID NO: 5603 - RNA, 18 nt, artificial
  Chemically synthesized
auuuccaucuugcucacc

SEQ ID NO: 5604 - RNA, 18 nt, artificial
  Chemically synthesized
uugagcuuggaguagcag

SEQ ID NO: 5605 - RNA, 18 nt, artificial
  Chemically synthesized
ugagcuagcugcgcuugg

SEQ ID NO: 5606 - RNA, 18 nt, artificial
  Chemically synthesized
uggcugcccugaagcuca

SEQ ID NO: 5607 - RNA, 18 nt, artificial
  Chemically synthesized
gcgagggaaggcgagacc

SEQ ID NO: 5608 - RNA, 18 nt, artificial
  Chemically synthesized
aucgggucguccacaggg

SEQ ID NO: 5609 - RNA, 18 nt, artificial
  Chemically synthesized
auauccguguugagggug

SEQ ID NO: 5610 - RNA, 18 nt, artificial
  Chemically synthesized
ugggaugcgaguccaggg

SEQ ID NO: 5611 - RNA, 18 nt, artificial
  Chemically synthesized
gggucucuggugaugcag

SEQ ID NO: 5612 - RNA, 18 nt, artificial
  Chemically synthesized
accucacgggacugaagg

SEQ ID NO: 5613 - RNA, 18 nt, artificial
  Chemically synthesized
gucguucauguuguauag

SEQ ID NO: 5614 - RNA, 18 nt, artificial
  Chemically synthesized
aucugcagguccaagaug

SEQ ID NO: 5615 - RNA, 18 nt, artificial
  Chemically synthesized
caccuuugaaaaaaggca

SEQ ID NO: 5616 - RNA, 18 nt, artificial
  Chemically synthesized
cgugcugcaggauuucca

SEQ ID NO: 5617 - RNA, 18 nt, artificial
  Chemically synthesized
gauguagucgaugacgug

SEQ ID NO: 5618 - RNA, 18 nt, artificial
  Chemically synthesized
acgccugguucugcccgg

SEQ ID NO: 5619 - RNA, 18 nt, artificial
  Chemically synthesized
gaagggaauucagaagcc

SEQ ID NO: 5620 - RNA, 18 nt, artificial
  Chemically synthesized
aguccaaguaagagaaca

SEQ ID NO: 5621 - RNA, 18 nt, artificial
  Chemically synthesized
uccagggcgaucugcagg

SEQ ID NO: 5622 - RNA, 18 nt, artificial
  Chemically synthesized
uagcaggcucaucggguc

SEQ ID NO: 5623 - RNA, 18 nt, artificial
  Chemically synthesized
aggacaggaugcugauau

SEQ ID NO: 5624 - RNA, 18 nt, artificial
  Chemically synthesized
aagggaauucagaagccu

SEQ ID NO: 5625 - RNA, 18 nt, artificial
  Chemically synthesized
aguagcagucguucaugu

SEQ ID NO: 5626 - RNA, 18 nt, artificial
  Chemically synthesized
gcuccuugagcuuggagu

SEQ ID NO: 5627 - RNA, 18 nt, artificial
  Chemically synthesized
ugaacaccgcuuauucag

SEQ ID NO: 5628 - RNA, 18 nt, artificial
  Chemically synthesized
ggaagaugaucauucuua

SEQ ID NO: 5629 - RNA, 18 nt, artificial
  Chemically synthesized
aaugaagcccgagcccgg

SEQ ID NO: 5630 - RNA, 18 nt, artificial
  Chemically synthesized
cacccugggaagaugauc

SEQ ID NO: 5631 - RNA, 18 nt, artificial
  Chemically synthesized
aucucugccacuauacaa

SEQ ID NO: 5632 - RNA, 18 nt, artificial
  Chemically synthesized
aggguuaaguuuacaacu

SEQ ID NO: 5633 - RNA, 18 nt, artificial
  Chemically synthesized
uucacaagguuucacuca

SEQ ID NO: 5634 - RNA, 18 nt, artificial
  Chemically synthesized
uaaagcaggcaaucacca

SEQ ID NO: 5635 - RNA, 18 nt, artificial
  Chemically synthesized
uccaccuuugaaaaaagg

SEQ ID NO: 5636 - RNA, 18 nt, artificial
  Chemically synthesized
cuggagcuucccuucguc

SEQ ID NO: 5637 - RNA, 18 nt, artificial
  Chemically synthesized
agggaauucagaagccug

SEQ ID NO: 5638 - RNA, 18 nt, artificial
  Chemically synthesized
uuccgugaauuuguuguu

SEQ ID NO: 5639 - RNA, 18 nt, artificial
  Chemically synthesized
agaccgggagggagcugg

SEQ ID NO: 5640 - RNA, 18 nt, artificial
  Chemically synthesized
agcaggcaaucaccauuc

SEQ ID NO: 5641 - RNA, 18 nt, artificial
  Chemically synthesized
guccucugaaauaaagca

SEQ ID NO: 5642 - RNA, 18 nt, artificial
  Chemically synthesized
uuucugaccaaaagacuu

SEQ ID NO: 5643 - RNA, 18 nt, artificial
  Chemically synthesized
uccgggagaugcccaggc

SEQ ID NO: 5644 - RNA, 18 nt, artificial
  Chemically synthesized
cugacaauagugggaugc

SEQ ID NO: 5645 - RNA, 18 nt, artificial
  Chemically synthesized
aaaucaugaacaccgcuu

SEQ ID NO: 5646 - RNA, 18 nt, artificial
  Chemically synthesized
uucaguaggcuuguguca

SEQ ID NO: 5647 - RNA, 18 nt, artificial
  Chemically synthesized
acagcauucaguaggcuu

SEQ ID NO: 5648 - RNA, 18 nt, artificial
  Chemically synthesized
uacuggauccuucuggua

SEQ ID NO: 5649 - RNA, 18 nt, artificial
  Chemically synthesized
agcuggcugcccugaagc

SEQ ID NO: 5650 - RNA, 18 nt, artificial
  Chemically synthesized
aguucagcacuuaaaaga

SEQ ID NO: 5651 - RNA, 18 nt, artificial
  Chemically synthesized
cuccaccuuugaaaaaag

SEQ ID NO: 5652 - RNA, 18 nt, artificial
  Chemically synthesized
cacacgcuggagcuuccc

SEQ ID NO: 5653 - RNA, 18 nt, artificial
  Chemically synthesized
cuggcugcccugaagcuc

SEQ ID NO: 5654 - RNA, 18 nt, artificial
  Chemically synthesized
aaggcaaagucugcuuag

SEQ ID NO: 5655 - RNA, 18 nt, artificial
  Chemically synthesized
gcaccagcuccuugagcu

SEQ ID NO: 5656 - RNA, 18 nt, artificial
  Chemically synthesized
gaaugaagcccgagcccg

SEQ ID NO: 5657 - RNA, 18 nt, artificial
  Chemically synthesized
uuauucagccacacagug

SEQ ID NO: 5658 - RNA, 18 nt, artificial
  Chemically synthesized
uuguuguugugcaaagaa

SEQ ID NO: 5659 - RNA, 18 nt, artificial
  Chemically synthesized
gguuucacucaaauagau

SEQ ID NO: 5660 - RNA, 18 nt, artificial
  Chemically synthesized
ugcagguccaagauguag

SEQ ID NO: 5661 - RNA, 18 nt, artificial
  Chemically synthesized
ccgcuuauucagccacac

SEQ ID NO: 5662 - RNA, 18 nt, artificial
  Chemically synthesized
ucaaagcacugguccucu

SEQ ID NO: 5663 - RNA, 18 nt, artificial
  Chemically synthesized
gccugcugagcuagcugc

SEQ ID NO: 5664 - RNA, 18 nt, artificial
  Chemically synthesized
cugugguccgacaggcug

SEQ ID NO: 5665 - RNA, 18 nt, artificial
  Chemically synthesized
uuucaugcugaccgcgag

SEQ ID NO: 5666 - RNA, 18 nt, artificial
  Chemically synthesized
auggugggaauaguauau

SEQ ID NO: 5667 - RNA, 18 nt, artificial
  Chemically synthesized
ugguucugcccgggucuc

SEQ ID NO: 5668 - RNA, 18 nt, artificial
  Chemically synthesized
cuagcugcgcuuggcacc

SEQ ID NO: 5669 - RNA, 18 nt, artificial
  Chemically synthesized
ucugaaauaaagcaggca

SEQ ID NO: 5670 - RNA, 18 nt, artificial
  Chemically synthesized
gguccaagauguagucga

SEQ ID NO: 5671 - RNA, 18 nt, artificial
  Chemically synthesized
gcacuuaaaagauuccgu

SEQ ID NO: 5672 - RNA, 18 nt, artificial
  Chemically synthesized
agaagccugcaaggacag

SEQ ID NO: 5673 - RNA, 18 nt, artificial
  Chemically synthesized
gaaaaccuuccaacugca

SEQ ID NO: 5674 - RNA, 18 nt, artificial
  Chemically synthesized
aggcaaucaccauucaau

SEQ ID NO: 5675 - RNA, 18 nt, artificial
  Chemically synthesized
gguucaguuauaacauag

SEQ ID NO: 5676 - RNA, 18 nt, artificial
  Chemically synthesized
aggcugugguccgacagg

SEQ ID NO: 5677 - RNA, 18 nt, artificial
  Chemically synthesized
aaggcgagaccgggaggg

SEQ ID NO: 5678 - RNA, 18 nt, artificial
  Chemically synthesized
ugguccucugaaauaaag

SEQ ID NO: 5679 - RNA, 18 nt, artificial
  Chemically synthesized
gaguagcagucguucaug

SEQ ID NO: 5680 - RNA, 18 nt, artificial
  Chemically synthesized
gugggaugcgaguccagg

SEQ ID NO: 5681 - RNA, 18 nt, artificial
  Chemically synthesized
caucuugcucaccuucuu

SEQ ID NO: 5682 - RNA, 18 nt, artificial
  Chemically synthesized
gggaauucagaagccugc

SEQ ID NO: 5683 - RNA, 18 nt, artificial
  Chemically synthesized
ccuuccaacugcagaaag

SEQ ID NO: 5684 - RNA, 18 nt, artificial
  Chemically synthesized
uggucagcggcguccugg

SEQ ID NO: 5685 - RNA, 18 nt, artificial
  Chemically synthesized
gccacacgcuggagcuuc

SEQ ID NO: 5686 - RNA, 18 nt, artificial
  Chemically synthesized
ucacgggacugaaggcuu

SEQ ID NO: 5687 - RNA, 18 nt, artificial
  Chemically synthesized
aauaucacaguccaagua

SEQ ID NO: 5688 - RNA, 18 nt, artificial
  Chemically synthesized
ugcugcaggauuuccauc

SEQ ID NO: 5689 - RNA, 18 nt, artificial
  Chemically synthesized
uuguccuccuugugaaau

SEQ ID NO: 5690 - RNA, 18 nt, artificial
  Chemically synthesized
cgaucugcagguccaaga

SEQ ID NO: 5691 - RNA, 18 nt, artificial
  Chemically synthesized
ugugguccgacaggcugu

SEQ ID NO: 5692 - RNA, 18 nt, artificial
  Chemically synthesized
aaauaaagcaggcaauca

SEQ ID NO: 5693 - RNA, 18 nt, artificial
  Chemically synthesized
gagggagcuggcugcccu

SEQ ID NO: 5694 - RNA, 18 nt, artificial
  Chemically synthesized
gugcuuugcugucauuug

SEQ ID NO: 5695 - RNA, 18 nt, artificial
  Chemically synthesized
ucaucgggucguccacag

SEQ ID NO: 5696 - RNA, 18 nt, artificial
  Chemically synthesized
augcaggcugacaauagu

SEQ ID NO: 5697 - RNA, 18 nt, artificial
  Chemically synthesized
ugaagcucaggccgccgc

SEQ ID NO: 5698 - RNA, 18 nt, artificial
  Chemically synthesized
ugaccaaaagacuucauu

SEQ ID NO: 5699 - RNA, 18 nt, artificial
  Chemically synthesized
cuuauucagccacacagu

SEQ ID NO: 5700 - RNA, 18 nt, artificial
  Chemically synthesized
uccgacaggcuguuuuuc

SEQ ID NO: 5701 - RNA, 18 nt, artificial
  Chemically synthesized
uccaagauguagucgaug

SEQ ID NO: 5702 - RNA, 18 nt, artificial
  Chemically synthesized
agguccaagauguagucg

SEQ ID NO: 5703 - RNA, 18 nt, artificial
  Chemically synthesized
gaauaucacaguccaagu

SEQ ID NO: 5704 - RNA, 18 nt, artificial
  Chemically synthesized
gggacugaaggcuuucau

SEQ ID NO: 5705 - RNA, 18 nt, artificial
  Chemically synthesized
cucagaagggaauucaga

SEQ ID NO: 5706 - RNA, 18 nt, artificial
  Chemically synthesized
ugcugaccgcgagggaag

SEQ ID NO: 5707 - RNA, 18 nt, artificial
  Chemically synthesized
cugguucugcccgggucu

SEQ ID NO: 5708 - RNA, 18 nt, artificial
  Chemically synthesized
gcucggcucagaaugaag

SEQ ID NO: 5709 - RNA, 18 nt, artificial
  Chemically synthesized
gcaaagucugcuuagauu

SEQ ID NO: 5710 - RNA, 18 nt, artificial
  Chemically synthesized
uuaaagaguucacaaggu

SEQ ID NO: 5711 - RNA, 18 nt, artificial
  Chemically synthesized
caggcugugguccgacag

SEQ ID NO: 5712 - RNA, 18 nt, artificial
  Chemically synthesized
aaaggcaaagucugcuua

SEQ ID NO: 5713 - RNA, 18 nt, artificial
  Chemically synthesized
acuuguccuccuugugaa

SEQ ID NO: 5714 - RNA, 18 nt, artificial
  Chemically synthesized
cugcugagcuagcugcgc

SEQ ID NO: 5715 - RNA, 18 nt, artificial
  Chemically synthesized
ugaaggcuuucaugcuga

SEQ ID NO: 5716 - RNA, 18 nt, artificial
  Chemically synthesized
acaguccaaguaagagaa

SEQ ID NO: 5717 - RNA, 18 nt, artificial
  Chemically synthesized
cucagaaugaagcccgag

SEQ ID NO: 5718 - RNA, 18 nt, artificial
  Chemically synthesized
gcugugguccgacaggcu

SEQ ID NO: 5719 - RNA, 18 nt, artificial
  Chemically synthesized
agcuuggaguagcagucg

SEQ ID NO: 5720 - RNA, 18 nt, artificial
  Chemically synthesized
gaguucacaagguuucac

SEQ ID NO: 5721 - RNA, 18 nt, artificial
  Chemically synthesized
ggcuuuuauccgcacucg

SEQ ID NO: 5722 - RNA, 18 nt, artificial
  Chemically synthesized
uggauccuucugguauuc

SEQ ID NO: 5723 - RNA, 18 nt, artificial
  Chemically synthesized
gaacacccugggaagaug

SEQ ID NO: 5724 - RNA, 18 nt, artificial
  Chemically synthesized
uccuccuugugaaauggu

SEQ ID NO: 5725 - RNA, 18 nt, artificial
  Chemically synthesized
uggugaugcaggcugaca

SEQ ID NO: 5726 - RNA, 18 nt, artificial
  Chemically synthesized
aaagggcauuuaaaaguc

SEQ ID NO: 5727 - RNA, 18 nt, artificial
  Chemically synthesized
ccacacgcuggagcuucc

SEQ ID NO: 5728 - RNA, 18 nt, artificial
  Chemically synthesized
acugaauacuggauccuu

SEQ ID NO: 5729 - RNA, 18 nt, artificial
  Chemically synthesized
ugacaauagugggaugcg

SEQ ID NO: 5730 - RNA, 18 nt, artificial
  Chemically synthesized
acacgcuggagcuucccu

SEQ ID NO: 5731 - RNA, 18 nt, artificial
  Chemically synthesized
ucagaagggaauucagaa

SEQ ID NO: 5732 - RNA, 18 nt, artificial
  Chemically synthesized
cgcgagggaaggcgagac

SEQ ID NO: 5733 - RNA, 18 nt, artificial
  Chemically synthesized
uuguuguuguugugcaaa

SEQ ID NO: 5734 - RNA, 18 nt, artificial
  Chemically synthesized
agaacacccugggaagau

SEQ ID NO: 5735 - RNA, 18 nt, artificial
  Chemically synthesized
gagaugcccaggcugugg

SEQ ID NO: 5736 - RNA, 18 nt, artificial
  Chemically synthesized
cuggacgccugguucugc

SEQ ID NO: 5737 - RNA, 18 nt, artificial
  Chemically synthesized
cacagcauucaguaggcu

SEQ ID NO: 5738 - RNA, 18 nt, artificial
  Chemically synthesized
ccgggagggagcuggcug

SEQ ID NO: 5739 - RNA, 18 nt, artificial
  Chemically synthesized
guccuggacgccugguuc

SEQ ID NO: 5740 - RNA, 18 nt, artificial
  Chemically synthesized
uagugggaugcgagucca

SEQ ID NO: 5741 - RNA, 18 nt, artificial
  Chemically synthesized
ucuggugaugcaggcuga

SEQ ID NO: 5742 - RNA, 18 nt, artificial
  Chemically synthesized
guaauuucugaccaaaag

SEQ ID NO: 5743 - RNA, 18 nt, artificial
  Chemically synthesized
cguguugaggguggucag

SEQ ID NO: 5744 - RNA, 18 nt, artificial
  Chemically synthesized
agaaagggcauuuaaaag

SEQ ID NO: 5745 - RNA, 18 nt, artificial
  Chemically synthesized
caucucugccacuauaca

SEQ ID NO: 5746 - RNA, 18 nt, artificial
  Chemically synthesized
aaaaggcaaagucugcuu

SEQ ID NO: 5747 - RNA, 18 nt, artificial
  Chemically synthesized
cuuggaguagcagucguu

SEQ ID NO: 5748 - RNA, 18 nt, artificial
  Chemically synthesized
cugaaggcuuucaugcug

SEQ ID NO: 5749 - RNA, 18 nt, artificial
  Chemically synthesized
agugacugaauacuggau

SEQ ID NO: 5750 - RNA, 18 nt, Artificial Sequence
  Chemically synthesized
auaucacaguccaaguaa

SEQ ID NO: 5751 - RNA, 18 nt, artificial
  Chemically synthesized
ucaaccauuucacaagga

SEQ ID NO: 5752 - RNA, 18 nt, artificial
  Chemically synthesized
aaauccugcagcacguca

SEQ ID NO: 5753 - RNA, 18 nt, artificial
  Chemically synthesized
acaaggaauugcccaauc

SEQ ID NO: 5754 - RNA, 18 nt, artificial
  Chemically synthesized
cccggucucgccuucccu

SEQ ID NO: 5755 - RNA, 18 nt, artificial
  Chemically synthesized
gcagaucgcccuggacuc

SEQ ID NO: 5756 - RNA, 18 nt, artificial
  Chemically synthesized
cagcauccuguccuugca

SEQ ID NO: 5757 - RNA, 18 nt, artificial
  Chemically synthesized
cugcagaucgcccuggac

SEQ ID NO: 5758 - RNA, 18 nt, artificial
  Chemically synthesized
gcaaagcacuguguggcu

SEQ ID NO: 5759 - RNA, 18 nt, artificial
  Chemically synthesized
acaagccuacugaaugcu

SEQ ID NO: 5760 - RNA, 18 nt, artificial
  Chemically synthesized
auccuguccuugcaggcu

SEQ ID NO: 5761 - RNA, 18 nt, artificial
  Chemically synthesized
gaaagccuucagucccgu

SEQ ID NO: 5762 - RNA, 18 nt, artificial
  Chemically synthesized
guccguuaggaaaaacag

SEQ ID NO: 5763 - RNA, 18 nt, artificial
  Chemically synthesized
agcuagcucagcaggcgg

SEQ ID NO: 5764 - RNA, 18 nt, artificial
  Chemically synthesized
aggaaaaacagccugucg

SEQ ID NO: 5765 - RNA, 18 nt, artificial
  Chemically synthesized
uugccuuuuuucaaaggu

SEQ ID NO: 5766 - RNA, 18 nt, artificial
  Chemically synthesized
caagauggaaauccugca

SEQ ID NO: 5767 - RNA, 18 nt, artificial
  Chemically synthesized
aucuaagcagacuuugcc

SEQ ID NO: 5768 - RNA, 18 nt, artificial
  Chemically synthesized
agcauccuguccuugcag

SEQ ID NO: 5769 - RNA, 18 nt, artificial
  Chemically synthesized
acagcaaagcacugugug

SEQ ID NO: 5770 - RNA, 18 nt, artificial
  Chemically synthesized
gggcagccagcucccucc

SEQ ID NO: 5771 - RNA, 18 nt, artificial
  Chemically synthesized
ccggucucgccuucccuc

SEQ ID NO: 5772 - RNA, 18 nt, artificial
  Chemically synthesized
cugcagcacgucaucgac

SEQ ID NO: 5773 - RNA, 18 nt, artificial
  Chemically synthesized
aaaugcccuuucugcagu

SEQ ID NO: 5774 - RNA, 18 nt, artificial
  Chemically synthesized
aacaugaacgacugcuac

SEQ ID NO: 5775 - RNA, 18 nt, artificial
  Chemically synthesized
gcugaccacccucaacac

SEQ ID NO: 5776 - RNA, 18 nt, artificial
  Chemically synthesized
ucagucacuuaaaugaag

SEQ ID NO: 5777 - RNA, 18 nt, artificial
  Chemically synthesized
cuucagggcagccagcuc

SEQ ID NO: 5778 - RNA, 18 nt, artificial
  Chemically synthesized
gaccacccucaacacgga

SEQ ID NO: 5779 - RNA, 18 nt, artificial
  Chemically synthesized
aauggugauugccugcuu

SEQ ID NO: 5780 - RNA, 18 nt, artificial
  Chemically synthesized
guggcugaauaagcggug

SEQ ID NO: 5781 - RNA, 18 nt, artificial
  Chemically synthesized
cguccaggacgccgcuga

SEQ ID NO: 5782 - RNA, 18 nt, artificial
  Chemically synthesized
ucagaggaccagugcuuu

SEQ ID NO: 5783 - RNA, 18 nt, artificial
  Chemically synthesized
aguuuucuuguauagugg

SEQ ID NO: 5784 - RNA, 18 nt, artificial
  Chemically synthesized
cgggcagaaccaggcguc

SEQ ID NO: 5785 - RNA, 18 nt, artificial
  Chemically synthesized
aucccacuauugucagcc

SEQ ID NO: 5786 - RNA, 18 nt, artificial
  Chemically synthesized
agcaagauggaaauccug

SEQ ID NO: 5787 - RNA, 18 nt, artificial
  Chemically synthesized
auugccugcuuuauuuca

SEQ ID NO: 5788 - RNA, 18 nt, artificial
  Chemically synthesized
ucaucuucccaggguguu

SEQ ID NO: 5789 - RNA, 18 nt, artificial
  Chemically synthesized
aauccugcagcacgucau

SEQ ID NO: 5790 - RNA, 18 nt, artificial
  Chemically synthesized
uccuugcaggcuucugaa

SEQ ID NO: 5791 - RNA, 18 nt, artificial
  Chemically synthesized
uauauacuauucccacca

SEQ ID NO: 5792 - RNA, 18 nt, artificial
  Chemically synthesized
aucuuggaccugcagauc

SEQ ID NO: 5793 - RNA, 18 nt, artificial
  Chemically synthesized
gacagcaaagcacugugu

SEQ ID NO: 5794 - RNA, 18 nt, artificial
  Chemically synthesized
gcggucagcaugaaagcc

SEQ ID NO: 5795 - RNA, 18 nt, artificial
  Chemically synthesized
uuucugcaguuggaaggu

SEQ ID NO: 5796 - RNA, 18 nt, artificial
  Chemically synthesized
cacaagccuacugaaugc

SEQ ID NO: 5797 - RNA, 18 nt, artificial
  Chemically synthesized
ggacgccgcugaccaccc

SEQ ID NO: 5798 - RNA, 18 nt, artificial
  Chemically synthesized
ucccacuauugucagccu

SEQ ID NO: 5799 - RNA, 18 nt, artificial
  Chemically synthesized
agaaccaggcguccagga

SEQ ID NO: 5800 - RNA, 18 nt, artificial
  Chemically synthesized
aucuuuuaagugcugaac

SEQ ID NO: 5801 - RNA, 18 nt, artificial
  Chemically synthesized
cuacuccaagcucaagga

SEQ ID NO: 5802 - RNA, 18 nt, artificial
  Chemically synthesized
cagcuagcucagcaggcg

SEQ ID NO: 5803 - RNA, 18 nt, artificial
  Chemically synthesized
ucuaagcagacuuugccu

SEQ ID NO: 5804 - RNA, 18 nt, artificial
  Chemically synthesized
gucggaccacagccuggg

SEQ ID NO: 5805 - RNA, 18 nt, artificial
  Chemically synthesized
ccugggcaucucccggag

SEQ ID NO: 5806 - RNA, 18 nt, artificial
  Chemically synthesized
aauugcccaaucuaagca

SEQ ID NO: 5807 - RNA, 18 nt, artificial
  Chemically synthesized
uuuucaaagguggagcgu

SEQ ID NO: 5808 - RNA, 18 nt, artificial
  Chemically synthesized
cggucucgccuucccucg

SEQ ID NO: 5809 - RNA, 18 nt, artificial
  Chemically synthesized
aguguguuuauugaaugg

SEQ ID NO: 5810 - RNA, 18 nt, artificial
  Chemically synthesized
ucaaagguggagcgugaa

SEQ ID NO: 5811 - RNA, 18 nt, artificial
  Chemically synthesized
ugaaaccuugugaacucu

SEQ ID NO: 5812 - RNA, 18 nt, artificial
  Chemically synthesized
uauacuauucccaccaug

SEQ ID NO: 5813 - RNA, 18 nt, artificial
  Chemically synthesized
auggaaauccugcagcac

SEQ ID NO: 5814 - RNA, 18 nt, artificial
  Chemically synthesized
ucaaaugacagcaaagca

SEQ ID NO: 5815 - RNA, 18 nt, artificial
  Chemically synthesized
gucccgugagguccguua

SEQ ID NO: 5816 - RNA, 18 nt, artificial
  Chemically synthesized
gcagccagcucccucccg

SEQ ID NO: 5817 - RNA, 18 nt, artificial
  Chemically synthesized
uuauuucagaggaccagu

SEQ ID NO: 5818 - RNA, 18 nt, artificial
  Chemically synthesized
caucucccggagcaaaac

SEQ ID NO: 5819 - RNA, 18 nt, artificial
  Chemically synthesized
guuaaugucaaaugacag

SEQ ID NO: 5820 - RNA, 18 nt, artificial
  Chemically synthesized
uuucaaccauuucacaag

SEQ ID NO: 5821 - RNA, 18 nt, artificial
  Chemically synthesized
ucacaaggaggacaaguu

SEQ ID NO: 5822 - RNA, 18 nt, artificial
  Chemically synthesized
ugucaaaugacagcaaag

SEQ ID NO: 5823 - RNA, 18 nt, artificial
  Chemically synthesized
uugcccaaucuaagcaga

SEQ ID NO: 5824 - RNA, 18 nt, artificial
  Chemically synthesized
gagguccguuaggaaaaa

SEQ ID NO: 5825 - RNA, 18 nt, artificial
  Chemically synthesized
gcauccuguccuugcagg

SEQ ID NO: 5826 - RNA, 18 nt, artificial
  Chemically synthesized
ugcuacuccaagcucaag

SEQ ID NO: 5827 - RNA, 18 nt, artificial
  Chemically synthesized
gugagcaagauggaaauc

SEQ ID NO: 5828 - RNA, 18 nt, artificial
  Chemically synthesized
gaccacagccugggcauc

SEQ ID NO: 5829 - RNA, 18 nt, artificial
  Chemically synthesized
aaaaacagccugucggac

SEQ ID NO: 5830 - RNA, 18 nt, artificial
  Chemically synthesized
aaaugacagcaaagcacu

SEQ ID NO: 5831 - RNA, 18 nt, artificial
  Chemically synthesized
cgcagcuagcucagcagg

SEQ ID NO: 5832 - RNA, 18 nt, artificial
  Chemically synthesized
agacuuuuaaaugcccuu

SEQ ID NO: 5833 - RNA, 18 nt, artificial
  Chemically synthesized
auucccuucugaguuaau

SEQ ID NO: 5834 - RNA, 18 nt, artificial
  Chemically synthesized
agcaaagcacuguguggc

SEQ ID NO: 5835 - RNA, 18 nt, artificial
  Chemically synthesized
gacgccgcugaccacccu

SEQ ID NO: 5836 - RNA, 18 nt, artificial
  Chemically synthesized
cagggcagccagcucccu

SEQ ID NO: 5837 - RNA, 18 nt, artificial
  Chemically synthesized
cuuugccuuuuuucaaag

SEQ ID NO: 5838 - RNA, 18 nt, artificial
  Chemically synthesized
accuuuuugacacaagcc

SEQ ID NO: 5839 - RNA, 18 nt, artificial
  Chemically synthesized
cguuaggaaaaacagccu

SEQ ID NO: 5840 - RNA, 18 nt, artificial
  Chemically synthesized
augcccuuucugcaguug

SEQ ID NO: 5841 - RNA, 18 nt, artificial
  Chemically synthesized
cuuggaccugcagaucgc

SEQ ID NO: 5842 - RNA, 18 nt, artificial
  Chemically synthesized
cagcaaagcacugugugg

SEQ ID NO: 5843 - RNA, 18 nt, artificial
  Chemically synthesized
auacaacaugaacgacug

SEQ ID NO: 5844 - RNA, 18 nt, artificial
  Chemically synthesized
gugccaagcgcagcuagc

SEQ ID NO: 5845 - RNA, 18 nt, artificial
  Chemically synthesized
cuucagucccgugagguc

SEQ ID NO: 5846 - RNA, 18 nt, artificial
  Chemically synthesized
auuucagaggaccagugc

SEQ ID NO: 5847 - RNA, 18 nt, artificial
  Chemically synthesized
uguggacgacccgaugag

SEQ ID NO: 5848 - RNA, 18 nt, artificial
  Chemically synthesized
guuaggaaaaacagccug

SEQ ID NO: 5849 - RNA, 18 nt, artificial
  Chemically synthesized
ggcagccagcucccuccc

SEQ ID NO: 5850 - RNA, 18 nt, artificial
  Chemically synthesized
ugcaggcuucugaauucc

SEQ ID NO: 5851 - RNA, 18 nt, artificial
  Chemically synthesized
ccguuaggaaaaacagcc

SEQ ID NO: 5852 - RNA, 18 nt, artificial
  Chemically synthesized
uuaccuuuuugacacaag

SEQ ID NO: 5853 - RNA, 18 nt, artificial
  Chemically synthesized
cgcccuggacucgcaucc

SEQ ID NO: 5854 - RNA, 18 nt, artificial
  Chemically synthesized
uuggucagaaauuaccuu

SEQ ID NO: 5855 - RNA, 18 nt, artificial
  Chemically synthesized
ucacaaggaauugcccaa

SEQ ID NO: 5856 - RNA, 18 nt, artificial
  Chemically synthesized
ucccuucugaguuaaugu

SEQ ID NO: 5857 - RNA, 18 nt, artificial
  Chemically synthesized
guggacgacccgaugagc

SEQ ID NO: 5858 - RNA, 18 nt, artificial
  Chemically synthesized
gcucccucccggucucgc

SEQ ID NO: 5859 - RNA, 18 nt, artificial
  Chemically synthesized
cucccggucucgccuucc

SEQ ID NO: 5860 - RNA, 18 nt, artificial
  Chemically synthesized
gccuucccucgcggucag

SEQ ID NO: 5861 - RNA, 18 nt, artificial
  Chemically synthesized
acgacugcuacuccaagc

SEQ ID NO: 5862 - RNA, 18 nt, artificial
  Chemically synthesized
aaaaucacaaggaauugc

SEQ ID NO: 5863 - RNA, 18 nt, artificial
  Chemically synthesized
aucagcauccuguccuug

SEQ ID NO: 5864 - RNA, 18 nt, artificial
  Chemically synthesized
gaccugcagaucgcccug

SEQ ID NO: 5865 - RNA, 18 nt, artificial
  Chemically synthesized
aucgacuacaucuuggac

SEQ ID NO: 5866 - RNA, 18 nt, artificial
  Chemically synthesized
uggacgacccgaugagcc

SEQ ID NO: 5867 - RNA, 18 nt, artificial
  Chemically synthesized
acuuuuaaaugcccuuuc

SEQ ID NO: 5868 - RNA, 18 nt, artificial
  Chemically synthesized
gcuggugcccagcauccc

SEQ ID NO: 5869 - RNA, 18 nt, artificial
  Chemically synthesized
uguguggcugaauaagcg

SEQ ID NO: 5870 - RNA, 18 nt, artificial
  Chemically synthesized
ccuguccuugcaggcuuc

SEQ ID NO: 5871 - RNA, 18 nt, artificial
  Chemically synthesized
uggaccugcagaucgccc

SEQ ID NO: 5872 - RNA, 18 nt, artificial
  Chemically synthesized
augacagcaaagcacugu

SEQ ID NO: 5873 - RNA, 18 nt, artificial
  Chemically synthesized
ccucccggucucgccuuc

SEQ ID NO: 5874 - RNA, 18 nt, artificial
  Chemically synthesized
ugccaagcgcagcuagcu

SEQ ID NO: 5875 - RNA, 18 nt, artificial
  Chemically synthesized
cucgccuucccucgcggu

SEQ ID NO: 5876 - RNA, 18 nt, artificial
  Chemically synthesized
aucgcccuggacucgcau

SEQ ID NO: 5877 - RNA, 18 nt, artificial
  Chemically synthesized
uauaguggcagagauguc

SEQ ID NO: 5878 - RNA, 18 nt, artificial
  Chemically synthesized
gacgacccgaugagccug

SEQ ID NO: 5879 - RNA, 18 nt, artificial
  Chemically synthesized
uucuuguauaguggcaga

SEQ ID NO: 5880 - RNA, 18 nt, artificial
  Chemically synthesized
caagcgcagcuagcucag

SEQ ID NO: 5881 - RNA, 18 nt, artificial
  Chemically synthesized
aagguggagcgugaauac

SEQ ID NO: 5882 - RNA, 18 nt, artificial
  Chemically synthesized
cacagccugggcaucucc

SEQ ID NO: 5883 - RNA, 18 nt, artificial
  Chemically synthesized
gaucgcccuggacucgca

SEQ ID NO: 5884 - RNA, 18 nt, artificial
  Chemically synthesized
uucccuucugaguuaaug

SEQ ID NO: 5885 - RNA, 18 nt, artificial
  Chemically synthesized
cgcggucagcaugaaagc

SEQ ID NO: 5886 - RNA, 18 nt, artificial
  Chemically synthesized
uacuauucccaccauggg

SEQ ID NO: 5887 - RNA, 18 nt, artificial
  Chemically synthesized
uugcaggcuucugaauuc

SEQ ID NO: 5888 - RNA, 18 nt, artificial
  Chemically synthesized
aaacagccugucggacca

SEQ ID NO: 5889 - RNA, 18 nt, artificial
  Chemically synthesized
uaggaaaaacagccuguc

SEQ ID NO: 5890 - RNA, 18 nt, artificial
  Chemically synthesized
acucgcaucccacuauug

SEQ ID NO: 5891 - RNA, 18 nt, artificial
  Chemically synthesized
uuucagaggaccagugcu

SEQ ID NO: 5892 - RNA, 18 nt, artificial
  Chemically synthesized
ugacagcaaagcacugug

SEQ ID NO: 5893 - RNA, 18 nt, artificial
  Chemically synthesized
uucagaggaccagugcuu

SEQ ID NO: 5894 - RNA, 18 nt, artificial
  Chemically synthesized
auacuauucccaccaugg

SEQ ID NO: 5895 - RNA, 18 nt, artificial
  Chemically synthesized
uucccucgcggucagcau

SEQ ID NO: 5896 - RNA, 18 nt, artificial
  Chemically synthesized
gccuucagucccgugagg

SEQ ID NO: 5897 - RNA, 18 nt, artificial
  Chemically synthesized
caggcguccaggacgccg

SEQ ID NO: 5898 - RNA, 18 nt, artificial
  Chemically synthesized
uuuggucagaaauuaccu

SEQ ID NO: 5899 - RNA, 18 nt, artificial
  Chemically synthesized
uauugaauggugauugcc

SEQ ID NO: 5900 - RNA, 18 nt, artificial
  Chemically synthesized
cagccugggcaucucccg

SEQ ID NO: 5901 - RNA, 18 nt, artificial
  Chemically synthesized
uguggcugaauaagcggu

SEQ ID NO: 5902 - RNA, 18 nt, artificial
  Chemically synthesized
acagccugggcaucuccc

SEQ ID NO: 5903 - RNA, 18 nt, artificial
  Chemically synthesized
gcggccugagcuucaggg

SEQ ID NO: 5904 - RNA, 18 nt, artificial
  Chemically synthesized
cggcggccugagcuucag

SEQ ID NO: 5905 - RNA, 18 nt, artificial
  Chemically synthesized
agucacuuaaaugaaguc

SEQ ID NO: 5906 - RNA, 18 nt, artificial
  Chemically synthesized
aauaccagaaggauccag

SEQ ID NO: 5907 - RNA, 18 nt, artificial
  Chemically synthesized
ucgcggucagcaugaaag

SEQ ID NO: 5908 - RNA, 18 nt, artificial
  Chemically synthesized
ggcggccugagcuucagg

SEQ ID NO: 5909 - RNA, 18 nt, artificial
  Chemically synthesized
agcuucagggcagccagc

SEQ ID NO: 5910 - RNA, 18 nt, artificial
  Chemically synthesized
ugucggaccacagccugg

SEQ ID NO: 5911 - RNA, 18 nt, artificial
  Chemically synthesized
cagaucgcccuggacucg

SEQ ID NO: 5912 - RNA, 18 nt, artificial
  Chemically synthesized
uaccuuuuugacacaagc

SEQ ID NO: 5913 - RNA, 18 nt, artificial
  Chemically synthesized
aucucccggagcaaaacc

SEQ ID NO: 5914 - RNA, 18 nt, artificial
  Chemically synthesized
aaaucacaaggaauugcc

SEQ ID NO: 5915 - RNA, 18 nt, artificial
  Chemically synthesized
aucaucuucccagggugu

SEQ ID NO: 5916 - RNA, 18 nt, artificial
  Chemically synthesized
ccugagcuucagggcagc

SEQ ID NO: 5917 - RNA, 18 nt, artificial
  Chemically synthesized
uuuugacacaagccuacu

SEQ ID NO: 5918 - RNA, 18 nt, artificial
  Chemically synthesized
uaucagcauccuguccuu

SEQ ID NO: 5919 - RNA, 18 nt, artificial
  Chemically synthesized
gccagcucccucccgguc

SEQ ID NO: 5920 - RNA, 18 nt, artificial
  Chemically synthesized
agccagcucccucccggu

SEQ ID NO: 5921 - RNA, 18 nt, artificial
  Chemically synthesized
cagucccgugagguccgu

SEQ ID NO: 5922 - RNA, 18 nt, artificial
  Chemically synthesized
cauccuguccuugcaggc

SEQ ID NO: 5923 - RNA, 18 nt, artificial
  Chemically synthesized
aggacgccgcugaccacc

SEQ ID NO: 5924 - RNA, 18 nt, artificial
  Chemically synthesized
aaccaggcguccaggacg

SEQ ID NO: 5925 - RNA, 18 nt, artificial
  Chemically synthesized
aauucccuucugaguuaa

SEQ ID NO: 5926 - RNA, 18 nt, artificial
  Chemically synthesized
uuaggaaaaacagccugu

SEQ ID NO: 5927 - RNA, 18 nt, artificial
  Chemically synthesized
ugaaagccuucagucccg

SEQ ID NO: 5928 - RNA, 18 nt, artificial
  Chemically synthesized
uuuuuucaaagguggagc

SEQ ID NO: 5929 - RNA, 18 nt, artificial
  Chemically synthesized
ucucgccuucccucgcgg

SEQ ID NO: 5930 - RNA, 18 nt, artificial
  Chemically synthesized
uauuucagaggaccagug

SEQ ID NO: 5931 - RNA, 18 nt, artificial
  Chemically synthesized
aaugcccuuucugcaguu

SEQ ID NO: 5932 - RNA, 18 nt, artificial
  Chemically synthesized
uaguuguaaacuuaaccc

SEQ ID NO: 5933 - RNA, 18 nt, artificial
  Chemically synthesized
aagacuuuuaaaugcccu

SEQ ID NO: 5934 - RNA, 18 nt, artificial
  Chemically synthesized
caggacgccgcugaccac

SEQ ID NO: 5935 - RNA, 18 nt, artificial
  Chemically synthesized
ucucccggagcaaaaccc

SEQ ID NO: 5936 - RNA, 18 nt, artificial
  Chemically synthesized
augaucaucuucccaggg

SEQ ID NO: 5937 - RNA, 18 nt, artificial
  Chemically synthesized
guccaggacgccgcugac

SEQ ID NO: 5938 - RNA, 18 nt, artificial
  Chemically synthesized
ucgcccuggacucgcauc

SEQ ID NO: 5939 - RNA, 18 nt, artificial
  Chemically synthesized
caucccacuauugucagc

SEQ ID NO: 5940 - RNA, 18 nt, artificial
  Chemically synthesized
aagcacuguguggcugaa

SEQ ID NO: 5941 - RNA, 18 nt, artificial
  Chemically synthesized
ggcguccaggacgccgcu

SEQ ID NO: 5942 - RNA, 18 nt, artificial
  Chemically synthesized
uuuucuuguauaguggca

SEQ ID NO: 5943 - RNA, 18 nt, artificial
  Chemically synthesized
uuucacaaggaggacaag

SEQ ID NO: 5944 - RNA, 18 nt, artificial
  Chemically synthesized
auccugcagcacgucauc

SEQ ID NO: 5945 - RNA, 18 nt, artificial
  Chemically synthesized
cucccucccggucucgcc

SEQ ID NO: 5946 - RNA, 18 nt, artificial
  Chemically synthesized
uuuauuucagaggaccag

SEQ ID NO: 5947 - RNA, 18 nt, artificial
  Chemically synthesized
uacaacaugaacgacugc

SEQ ID NO: 5948 - RNA, 18 nt, artificial
  Chemically synthesized
uuaaaugcccuuucugca

SEQ ID NO: 5949 - RNA, 18 nt, artificial
  Chemically synthesized
uugaauggugauugccug

SEQ ID NO: 5950 - RNA, 18 nt, artificial
  Chemically synthesized
ucuucccaggguguucuc

SEQ ID NO: 5951 - RNA, 18 nt, artificial
  Chemically synthesized
aggcguccaggacgccgc

SEQ ID NO: 5952 - RNA, 18 nt, artificial
  Chemically synthesized
uccguuaggaaaaacagc

SEQ ID NO: 5953 - RNA, 18 nt, artificial
  Chemically synthesized
uuuuggucagaaauuacc

SEQ ID NO: 5954 - RNA, 18 nt, artificial
  Chemically synthesized
uuauugaauggugauugc

SEQ ID NO: 5955 - RNA, 18 nt, artificial
  Chemically synthesized
uucagucccgugaggucc

SEQ ID NO: 5956 - RNA, 18 nt, artificial
  Chemically synthesized
uucagggcagccagcucc

SEQ ID NO: 5957 - RNA, 18 nt, artificial
  Chemically synthesized
ucccucccggucucgccu

SEQ ID NO: 5958 - RNA, 18 nt, artificial
  Chemically synthesized
uuuuugacacaagccuac

SEQ ID NO: 5959 - RNA, 18 nt, artificial
  Chemically synthesized
aagauggaaauccugcag

SEQ ID NO: 5960 - RNA, 18 nt, artificial
  Chemically synthesized
aaugaucaucuucccagg

SEQ ID NO: 5961 - RNA, 18 nt, artificial
  Chemically synthesized
acgacccgaugagccugc

SEQ ID NO: 5962 - RNA, 18 nt, artificial
  Chemically synthesized
uuuuaaaugcccuuucug

SEQ ID NO: 5963 - RNA, 18 nt, artificial
  Chemically synthesized
uaaaugcccuuucugcag

SEQ ID NO: 5964 - RNA, 18 nt, artificial
  Chemically synthesized
ccaggcguccaggacgcc

SEQ ID NO: 5965 - RNA, 18 nt, artificial
  Chemically synthesized
ucccggucucgccuuccc

SEQ ID NO: 5966 - RNA, 18 nt, artificial
  Chemically synthesized
aaugacagcaaagcacug

SEQ ID NO: 5967 - RNA, 18 nt, artificial
  Chemically synthesized
aaagacuuuuaaaugccc

SEQ ID NO: 5968 - RNA, 18 nt, artificial
  Chemically synthesized
ugaauggugauugccugc

SEQ ID NO: 5969 - RNA, 18 nt, artificial
  Chemically synthesized
cagcucccucccggucuc

SEQ ID NO: 5970 - RNA, 18 nt, artificial
  Chemically synthesized
uuugccuuuuuucaaagg

SEQ ID NO: 5971 - RNA, 18 nt, artificial
  Chemically synthesized
ucagggcagccagcuccc

SEQ ID NO: 5972 - RNA, 18 nt, artificial
  Chemically synthesized
ucagucccgugagguccg

SEQ ID NO: 5973 - RNA, 18 nt, artificial
  Chemically synthesized
agcucccucccggucucg

SEQ ID NO: 5974 - RNA, 18 nt, artificial
  Chemically synthesized
ucccgugagguccguuag

SEQ ID NO: 5975 - RNA, 18 nt, artificial
  Chemically synthesized
uuggaccugcagaucgcc

SEQ ID NO: 5976 - RNA, 18 nt, artificial
  Chemically synthesized
uuuuucaaagguggagcg

SEQ ID NO: 5977 - RNA, 18 nt, artificial
  Chemically synthesized
accaggcguccaggacgc

SEQ ID NO: 5978 - RNA, 18 nt, artificial
  Chemically synthesized
uccuugugaaaugguuga

SEQ ID NO: 5979 - RNA, 18 nt, artificial
  Chemically synthesized
ugacgugcugcaggauuu

SEQ ID NO: 5980 - RNA, 18 nt, artificial
  Chemically synthesized
gauugggcaauuccuugu

SEQ ID NO: 5981 - RNA, 18 nt, artificial
  Chemically synthesized
agggaaggcgagaccggg

SEQ ID NO: 5982 - RNA, 18 nt, artificial
  Chemically synthesized
gaguccagggcgaucugc

SEQ ID NO: 5983 - RNA, 18 nt, artificial
  Chemically synthesized
ugcaaggacaggaugcug

SEQ ID NO: 5984 - RNA, 18 nt, artificial
  Chemically synthesized
guccagggcgaucugcag

SEQ ID NO: 5985 - RNA, 18 nt, artificial
  Chemically synthesized
agccacacagugcuuugc

SEQ ID NO: 5986 - RNA, 18 nt, artificial
  Chemically synthesized
agcauucaguaggcuugu

SEQ ID NO: 5987 - RNA, 18 nt, artificial
  Chemically synthesized
agccugcaaggacaggau

SEQ ID NO: 5988 - RNA, 18 nt, artificial
  Chemically synthesized
acgggacugaaggcuuuc

SEQ ID NO: 5989 - RNA, 18 nt, artificial
  Chemically synthesized
cuguuuuuccuaacggac

SEQ ID NO: 5990 - RNA, 18 nt, artificial
  Chemically synthesized
ccgccugcugagcuagcu

SEQ ID NO: 5991 - RNA, 18 nt, artificial
  Chemically synthesized
cgacaggcuguuuuuccu

SEQ ID NO: 5992 - RNA, 18 nt, artificial
  Chemically synthesized
accuuugaaaaaaggcaa

SEQ ID NO: 5993 - RNA, 18 nt, artificial
  Chemically synthesized
ugcaggauuuccaucuug

SEQ ID NO: 5994 - RNA, 18 nt, artificial
  Chemically synthesized
ggcaaagucugcuuagau

SEQ ID NO: 5995 - RNA, 18 nt, artificial
  Chemically synthesized
cugcaaggacaggaugcu

SEQ ID NO: 5996 - RNA, 18 nt, artificial
  Chemically synthesized
cacacagugcuuugcugu

SEQ ID NO: 5997 - RNA, 18 nt, artificial
  Chemically synthesized
ggagggagcuggcugccc

SEQ ID NO: 5998 - RNA, 18 nt, artificial
  Chemically synthesized
gagggaaggcgagaccgg

SEQ ID NO: 5999 - RNA, 18 nt, artificial
  Chemically synthesized
gucgaugacgugcugcag

SEQ ID NO: 6000 - RNA, 18 nt, artificial
  Chemically synthesized
acugcagaaagggcauuu

SEQ ID NO: 6001 - RNA, 18 nt, artificial
  Chemically synthesized
guagcagucguucauguu

SEQ ID NO: 6002 - RNA, 18 nt, artificial
  Chemically synthesized
guguugaggguggucagc

SEQ ID NO: 6003 - RNA, 18 nt, artificial
  Chemically synthesized
cuucauuuaagugacuga

SEQ ID NO: 6004 - RNA, 18 nt, artificial
  Chemically synthesized
gagcuggcugcccugaag

SEQ ID NO: 6005 - RNA, 18 nt, artificial
  Chemically synthesized
uccguguugagggugguc

SEQ ID NO: 6006 - RNA, 18 nt, artificial
  Chemically synthesized
aagcaggcaaucaccauu

SEQ ID NO: 6007 - RNA, 18 nt, artificial
  Chemically synthesized
caccgcuuauucagccac

SEQ ID NO: 6008 - RNA, 18 nt, artificial
  Chemically synthesized
ucagcggcguccuggacg

SEQ ID NO: 6009 - RNA, 18 nt, artificial
  Chemically synthesized
aaagcacugguccucuga

SEQ ID NO: 6010 - RNA, 18 nt, artificial
  Chemically synthesized
ccacuauacaagaaaacu

SEQ ID NO: 6011 - RNA, 18 nt, artificial
  Chemically synthesized
gacgccugguucugcccg

SEQ ID NO: 6012 - RNA, 18 nt, artificial
  Chemically synthesized
ggcugacaauagugggau

SEQ ID NO: 6013 - RNA, 18 nt, artificial
  Chemically synthesized
caggauuuccaucuugcu

SEQ ID NO: 6014 - RNA, 18 nt, artificial
  Chemically synthesized
ugaaauaaagcaggcaau

SEQ ID NO: 6015 - RNA, 18 nt, artificial
  Chemically synthesized
aacacccugggaagauga

SEQ ID NO: 6016 - RNA, 18 nt, artificial
  Chemically synthesized
augacgugcugcaggauu

SEQ ID NO: 6017 - RNA, 18 nt, artificial
  Chemically synthesized
uucagaagccugcaagga

SEQ ID NO: 6018 - RNA, 18 nt, artificial
  Chemically synthesized
uggugggaauaguauaua

SEQ ID NO: 6019 - RNA, 18 nt, artificial
  Chemically synthesized
gaucugcagguccaagau

SEQ ID NO: 6020 - RNA, 18 nt, artificial
  Chemically synthesized
acacagugcuuugcuguc

SEQ ID NO: 6021 - RNA, 18 nt, artificial
  Chemically synthesized
ggcuuucaugcugaccgc

SEQ ID NO: 6022 - RNA, 18 nt, artificial
  Chemically synthesized
accuuccaacugcagaaa

SEQ ID NO: 6023 - RNA, 18 nt, artificial
  Chemically synthesized
gcauucaguaggcuugug

SEQ ID NO: 6024 - RNA, 18 nt, artificial
  Chemically synthesized
ggguggucagcggcgucc

SEQ ID NO: 6025 - RNA, 18 nt, artificial
  Chemically synthesized
aggcugacaauaguggga

SEQ ID NO: 6026 - RNA, 18 nt, artificial
  Chemically synthesized
uccuggacgccugguucu

SEQ ID NO: 6027 - RNA, 18 nt, artificial
  Chemically synthesized
guucagcacuuaaaagau

SEQ ID NO: 6028 - RNA, 18 nt, artificial
  Chemically synthesized
uccuugagcuuggaguag

SEQ ID NO: 6029 - RNA, 18 nt, artificial
  Chemically synthesized
cgccugcugagcuagcug

SEQ ID NO: 6030 - RNA, 18 nt, artificial
  Chemically synthesized
aggcaaagucugcuuaga

SEQ ID NO: 6031 - RNA, 18 nt, artificial
  Chemically synthesized
cccaggcugugguccgac

SEQ ID NO: 6032 - RNA, 18 nt, artificial
  Chemically synthesized
cuccgggagaugcccagg

SEQ ID NO: 6033 - RNA, 18 nt, artificial
  Chemically synthesized
ugcuuagauugggcaauu

SEQ ID NO: 6034 - RNA, 18 nt, artificial
  Chemically synthesized
acgcuccaccuuugaaaa

SEQ ID NO: 6035 - RNA, 18 nt, artificial
  Chemically synthesized
cgagggaaggcgagaccg

SEQ ID NO: 6036 - RNA, 18 nt, artificial
  Chemically synthesized
ccauucaauaaacacacu

SEQ ID NO: 6037 - RNA, 18 nt, artificial
  Chemically synthesized
uucacgcuccaccuuuga

SEQ ID NO: 6038 - RNA, 18 nt, artificial
  Chemically synthesized
agaguucacaagguuuca

SEQ ID NO: 6039 - RNA, 18 nt, artificial
  Chemically synthesized
cauggugggaauaguaua

SEQ ID NO: 6040 - RNA, 18 nt, artificial
  Chemically synthesized
gugcugcaggauuuccau

SEQ ID NO: 6041 - RNA, 18 nt, artificial
  Chemically synthesized
ugcuuugcugucauuuga

SEQ ID NO: 6042 - RNA, 18 nt, artificial
  Chemically synthesized
uaacggaccucacgggac

SEQ ID NO: 6043 - RNA, 18 nt, artificial
  Chemically synthesized
cgggagggagcuggcugc

SEQ ID NO: 6044 - RNA, 18 nt, artificial
  Chemically synthesized
acugguccucugaaauaa

SEQ ID NO: 6045 - RNA, 18 nt, artificial
  Chemically synthesized
guuuugcuccgggagaug

SEQ ID NO: 6046 - RNA, 18 nt, artificial
  Chemically synthesized
cugucauuugacauuaac

SEQ ID NO: 6047 - RNA, 18 nt, artificial
  Chemically synthesized
cuugugaaaugguugaaa

SEQ ID NO: 6048 - RNA, 18 nt, artificial
  Chemically synthesized
aacuuguccuccuuguga

SEQ ID NO: 6049 - RNA, 18 nt, artificial
  Chemically synthesized
cuuugcugucauuugaca

SEQ ID NO: 6050 - RNA, 18 nt, artificial
  Chemically synthesized
ucugcuuagauugggcaa

SEQ ID NO: 6051 - RNA, 18 nt, artificial
  Chemically synthesized
uuuuuccuaacggaccuc

SEQ ID NO: 6052 - RNA, 18 nt, artificial
  Chemically synthesized
ccugcaaggacaggaugc

SEQ ID NO: 6053 - RNA, 18 nt, artificial
  Chemically synthesized
cuugagcuuggaguagca

SEQ ID NO: 6054 - RNA, 18 nt, artificial
  Chemically synthesized
gauuuccaucuugcucac

SEQ ID NO: 6055 - RNA, 18 nt, artificial
  Chemically synthesized
gaugcccaggcugugguc

SEQ ID NO: 6056 - RNA, 18 nt, artificial
  Chemically synthesized
guccgacaggcuguuuuu

SEQ ID NO: 6057 - RNA, 18 nt, artificial
  Chemically synthesized
agugcuuugcugucauuu

SEQ ID NO: 6058 - RNA, 18 nt, artificial
  Chemically synthesized
ccugcugagcuagcugcg

SEQ ID NO: 6059 - RNA, 18 nt, artificial
  Chemically synthesized
aagggcauuuaaaagucu

SEQ ID NO: 6060 - RNA, 18 nt, artificial
  Chemically synthesized
auuaacucagaagggaau

SEQ ID NO: 6061 - RNA, 18 nt, artificial
  Chemically synthesized
gccacacagugcuuugcu

SEQ ID NO: 6062 - RNA, 18 nt, artificial
  Chemically synthesized
aggguggucagcggcguc

SEQ ID NO: 6063 - RNA, 18 nt, artificial
  Chemically synthesized
agggagcuggcugcccug

SEQ ID NO: 6064 - RNA, 18 nt, artificial
  Chemically synthesized
cuuugaaaaaaggcaaag

SEQ ID NO: 6065 - RNA, 18 nt, artificial
  Chemically synthesized
ggcuugugucaaaaaggu

SEQ ID NO: 6066 - RNA, 18 nt, artificial
  Chemically synthesized
aggcuguuuuuccuaacg

SEQ ID NO: 6067 - RNA, 18 nt, artificial
  Chemically synthesized
caacugcagaaagggcau

SEQ ID NO: 6068 - RNA, 18 nt, artificial
  Chemically synthesized
gcgaucugcagguccaag

SEQ ID NO: 6069 - RNA, 18 nt, artificial
  Chemically synthesized
ccacacagugcuuugcug

SEQ ID NO: 6070 - RNA, 18 nt, artificial
  Chemically synthesized
cagucguucauguuguau

SEQ ID NO: 6071 - RNA, 18 nt, artificial
  Chemically synthesized
gcuagcugcgcuuggcac

SEQ ID NO: 6072 - RNA, 18 nt, artificial
  Chemically synthesized
gaccucacgggacugaag

SEQ ID NO: 6073 - RNA, 18 nt, artificial
  Chemically synthesized
gcacugguccucugaaau

SEQ ID NO: 6074 - RNA, 18 nt, artificial
  Chemically synthesized
cucaucgggucguccaca

SEQ ID NO: 6075 - RNA, 18 nt, artificial
  Chemically synthesized
caggcuguuuuuccuaac

SEQ ID NO: 6076 - RNA, 18 nt, artificial
  Chemically synthesized
gggagggagcuggcugcc

SEQ ID NO: 6077 - RNA, 18 nt, artificial
  Chemically synthesized
ggaauucagaagccugca

SEQ ID NO: 6078 - RNA, 18 nt, artificial
  Chemically synthesized
ggcuguuuuuccuaacgg

SEQ ID NO: 6079 - RNA, 18 nt, artificial
  Chemically synthesized
cuugugucaaaaagguaa

SEQ ID NO: 6080 - RNA, 18 nt, artificial
  Chemically synthesized
ggaugcgaguccagggcg

SEQ ID NO: 6081 - RNA, 18 nt, artificial
  Chemically synthesized
aagguaauuucugaccaa

SEQ ID NO: 6082 - RNA, 18 nt, artificial
  Chemically synthesized
uugggcaauuccuuguga

SEQ ID NO: 6083 - RNA, 18 nt, artificial
  Chemically synthesized
acauuaacucagaaggga

SEQ ID NO: 6084 - RNA, 18 nt, artificial
  Chemically synthesized
gcucaucgggucguccac

SEQ ID NO: 6085 - RNA, 18 nt, artificial
  Chemically synthesized
gcgagaccgggagggagc

SEQ ID NO: 6086 - RNA, 18 nt, artificial
  Chemically synthesized
ggaaggcgagaccgggag

SEQ ID NO: 6087 - RNA, 18 nt, artificial
  Chemically synthesized
cugaccgcgagggaaggc

SEQ ID NO: 6088 - RNA, 18 nt, artificial
  Chemically synthesized
gcuuggaguagcagucgu

SEQ ID NO: 6089 - RNA, 18 nt, artificial
  Chemically synthesized
gcaauuccuugugauuuu

SEQ ID NO: 6090 - RNA, 18 nt, artificial
  Chemically synthesized
caaggacaggaugcugau

SEQ ID NO: 6091 - RNA, 18 nt, artificial
  Chemically synthesized
cagggcgaucugcagguc

SEQ ID NO: 6092 - RNA, 18 nt, artificial
  Chemically synthesized
guccaagauguagucgau

SEQ ID NO: 6093 - RNA, 18 nt, artificial
  Chemically synthesized
ggcucaucgggucgucca

SEQ ID NO: 6094 - RNA, 18 nt, artificial
  Chemically synthesized
gaaagggcauuuaaaagu

SEQ ID NO: 6095 - RNA, 18 nt, artificial
  Chemically synthesized
gggaugcugggcaccagc

SEQ ID NO: 6096 - RNA, 18 nt, artificial
  Chemically synthesized
cgcuuauucagccacaca

SEQ ID NO: 6097 - RNA, 18 nt, artificial
  Chemically synthesized
gaagccugcaaggacagg

SEQ ID NO: 6098 - RNA, 18 nt, artificial
  Chemically synthesized
gggcgaucugcaggucca

SEQ ID NO: 6099 - RNA, 18 nt, artificial
  Chemically synthesized
acagugcuuugcugucau

SEQ ID NO: 6100 - RNA, 18 nt, artificial
  Chemically synthesized
gaaggcgagaccgggagg

SEQ ID NO: 6101 - RNA, 18 nt, artificial
  Chemically synthesized
agcuagcugcgcuuggca

SEQ ID NO: 6102 - RNA, 18 nt, artificial
  Chemically synthesized
accgcgagggaaggcgag

SEQ ID NO: 6103 - RNA, 18 nt, artificial
  Chemically synthesized
augcgaguccagggcgau

SEQ ID NO: 6104 - RNA, 18 nt, artificial
  Chemically synthesized
gacaucucugccacuaua

SEQ ID NO: 6105 - RNA, 18 nt, artificial
  Chemically synthesized
caggcucaucgggucguc

SEQ ID NO: 6106 - RNA, 18 nt, artificial
  Chemically synthesized
ucugccacuauacaagaa

SEQ ID NO: 6107 - RNA, 18 nt, artificial
  Chemically synthesized
cugagcuagcugcgcuug

SEQ ID NO: 6108 - RNA, 18 nt, artificial
  Chemically synthesized
guauucacgcuccaccuu

SEQ ID NO: 6109 - RNA, 18 nt, artificial
  Chemically synthesized
ggagaugcccaggcugug

SEQ ID NO: 6110 - RNA, 18 nt, artificial
  Chemically synthesized
ugcgaguccagggcgauc

SEQ ID NO: 6111 - RNA, 18 nt, artificial
  Chemically synthesized
cauuaacucagaagggaa

SEQ ID NO: 6112 - RNA, 18 nt, artificial
  Chemically synthesized
gcuuucaugcugaccgcg

SEQ ID NO: 6113 - RNA, 18 nt, artificial
  Chemically synthesized
cccauggugggaauagua

SEQ ID NO: 6114 - RNA, 18 nt, artificial
  Chemically synthesized
gaauucagaagccugcaa

SEQ ID NO: 6115 - RNA, 18 nt, artificial
  Chemically synthesized
ugguccgacaggcuguuu

SEQ ID NO: 6116 - RNA, 18 nt, artificial
  Chemically synthesized
gacaggcuguuuuuccua

SEQ ID NO: 6117 - RNA, 18 nt, artificial
  Chemically synthesized
caauagugggaugcgagu

SEQ ID NO: 6118 - RNA, 18 nt, artificial
  Chemically synthesized
agcacugguccucugaaa

SEQ ID NO: 6119 - RNA, 18 nt, artificial
  Chemically synthesized
cacagugcuuugcuguca

SEQ ID NO: 6120 - RNA, 18 nt, artificial
  Chemically synthesized
aagcacugguccucugaa

SEQ ID NO: 6121 - RNA, 18 nt, artificial
  Chemically synthesized
ccauggugggaauaguau

SEQ ID NO: 6122 - RNA, 18 nt, artificial
  Chemically synthesized
augcugaccgcgagggaa

SEQ ID NO: 6123 - RNA, 18 nt, artificial
  Chemically synthesized
ccucacgggacugaaggc

SEQ ID NO: 6124 - RNA, 18 nt, artificial
  Chemically synthesized
cggcguccuggacgccug

SEQ ID NO: 6125 - RNA, 18 nt, artificial
  Chemically synthesized
agguaauuucugaccaaa

SEQ ID NO: 6126 - RNA, 18 nt, artificial
  Chemically synthesized
ggcaaucaccauucaaua

SEQ ID NO: 6127 - RNA, 18 nt, artificial
  Chemically synthesized
cgggagaugcccaggcug

SEQ ID NO: 6128 - RNA, 18 nt, artificial
  Chemically synthesized
accgcuuauucagccaca

SEQ ID NO: 6129 - RNA, 18 nt, artificial
  Chemically synthesized
gggagaugcccaggcugu

SEQ ID NO: 6130 - RNA, 18 nt, artificial
  Chemically synthesized
cccugaagcucaggccgc

SEQ ID NO: 6131 - RNA, 18 nt, artificial
  Chemically synthesized
cugaagcucaggccgccg

SEQ ID NO: 6132 - RNA, 18 nt, artificial
  Chemically synthesized
gacuucauuuaagugacu

SEQ ID NO: 6133 - RNA, 18 nt, artificial
  Chemically synthesized
cuggauccuucugguauu

SEQ ID NO: 6134 - RNA, 18 nt, artificial
  Chemically synthesized
cuuucaugcugaccgcga

SEQ ID NO: 6135 - RNA, 18 nt, artificial
  Chemically synthesized
ccugaagcucaggccgcc

SEQ ID NO: 6136 - RNA, 18 nt, artificial
  Chemically synthesized
gcuggcugcccugaagcu

SEQ ID NO: 6137 - RNA, 18 nt, artificial
  Chemically synthesized
ccaggcugugguccgaca

SEQ ID NO: 6138 - RNA, 18 nt, artificial
  Chemically synthesized
cgaguccagggcgaucug

SEQ ID NO: 6139 - RNA, 18 nt, artificial
  Chemically synthesized
gcuugugucaaaaaggua

SEQ ID NO: 6140 - RNA, 18 nt, artificial
  Chemically synthesized
gguuuugcuccgggagau

SEQ ID NO: 6141 - RNA, 18 nt, artificial
  Chemically synthesized
ggcaauuccuugugauuu

SEQ ID NO: 6142 - RNA, 18 nt, artificial
  Chemically synthesized
acacccugggaagaugau

SEQ ID NO: 6143 - RNA, 18 nt, artificial
  Chemically synthesized
gcugcccugaagcucagg

SEQ ID NO: 6144 - RNA, 18 nt, artificial
  Chemically synthesized
aguaggcuugugucaaaa

SEQ ID NO: 6145 - RNA, 18 nt, artificial
  Chemically synthesized
aaggacaggaugcugaua

SEQ ID NO: 6146 - RNA, 18 nt, artificial
  Chemically synthesized
gaccgggagggagcuggc

SEQ ID NO: 6147 - RNA, 18 nt, artificial
  Chemically synthesized
accgggagggagcuggcu

SEQ ID NO: 6148 - RNA, 18 nt, artificial
  Chemically synthesized
acggaccucacgggacug

SEQ ID NO: 6149 - RNA, 18 nt, artificial
  Chemically synthesized
gccugcaaggacaggaug

SEQ ID NO: 6150 - RNA, 18 nt, artificial
  Chemically synthesized
gguggucagcggcguccu

SEQ ID NO: 6151 - RNA, 18 nt, artificial
  Chemically synthesized
cguccuggacgccugguu

SEQ ID NO: 6152 - RNA, 18 nt, artificial
  Chemically synthesized
uuaacucagaagggaauu

SEQ ID NO: 6153 - RNA, 18 nt, artificial
  Chemically synthesized
acaggcuguuuuuccuaa

SEQ ID NO: 6154 - RNA, 18 nt, artificial
  Chemically synthesized
cgggacugaaggcuuuca

SEQ ID NO: 6155 - RNA, 18 nt, artificial
  Chemically synthesized
gcuccaccuuugaaaaaa

SEQ ID NO: 6156 - RNA, 18 nt, artificial
  Chemically synthesized
ccgcgagggaaggcgaga

SEQ ID NO: 6157 - RNA, 18 nt, artificial
  Chemically synthesized
cacugguccucugaaaua

SEQ ID NO: 6158 - RNA, 18 nt, artificial
  Chemically synthesized
aacugcagaaagggcauu

SEQ ID NO: 6159 - RNA, 18 nt, artificial
  Chemically synthesized
ggguuaaguuuacaacua

SEQ ID NO: 6160 - RNA, 18 nt, artificial
  Chemically synthesized
agggcauuuaaaagucuu

SEQ ID NO: 6161 - RNA, 18 nt, artificial
  Chemically synthesized
guggucagcggcguccug

SEQ ID NO: 6162 - RNA, 18 nt, artificial
  Chemically synthesized
ggguuuugcuccgggaga

SEQ ID NO: 6163 - RNA, 18 nt, artificial
  Chemically synthesized
cccugggaagaugaucau

SEQ ID NO: 6164 - RNA, 18 nt, artificial
  Chemically synthesized
gucagcggcguccuggac

SEQ ID NO: 6165 - RNA, 18 nt, artificial
  Chemically synthesized
gaugcgaguccagggcga

SEQ ID NO: 6166 - RNA, 18 nt, artificial
  Chemically synthesized
gcugacaauagugggaug

SEQ ID NO: 6167 - RNA, 18 nt, artificial
  Chemically synthesized
uucagccacacagugcuu

SEQ ID NO: 6168 - RNA, 18 nt, artificial
  Chemically synthesized
agcggcguccuggacgcc

SEQ ID NO: 6169 - RNA, 18 nt, artificial
  Chemically synthesized
ugccacuauacaagaaaa

SEQ ID NO: 6170 - RNA, 18 nt, artificial
  Chemically synthesized
cuuguccuccuugugaaa

SEQ ID NO: 6171 - RNA, 18 nt, artificial
  Chemically synthesized
gaugacgugcugcaggau

SEQ ID NO: 6172 - RNA, 18 nt, artificial
  Chemically synthesized
ggcgagaccgggagggag

SEQ ID NO: 6173 - RNA, 18 nt, artificial
  Chemically synthesized
cugguccucugaaauaaa

SEQ ID NO: 6174 - RNA, 18 nt, artificial
  Chemically synthesized
gcagucguucauguugua

SEQ ID NO: 6175 - RNA, 18 nt, artificial
  Chemically synthesized
ugcagaaagggcauuuaa

SEQ ID NO: 6176 - RNA, 18 nt, artificial
  Chemically synthesized
caggcaaucaccauucaa

SEQ ID NO: 6177 - RNA, 18 nt, artificial
  Chemically synthesized
gagaacacccugggaaga

SEQ ID NO: 6178 - RNA, 18 nt, artificial
  Chemically synthesized
gcggcguccuggacgccu

SEQ ID NO: 6179 - RNA, 18 nt, artificial
  Chemically synthesized
gcuguuuuuccuaacgga

SEQ ID NO: 6180 - RNA, 18 nt, artificial
  Chemically synthesized
gguaauuucugaccaaaa

SEQ ID NO: 6181 - RNA, 18 nt, artificial
  Chemically synthesized
gcaaucaccauucaauaa

SEQ ID NO: 6182 - RNA, 18 nt, artificial
  Chemically synthesized
ggaccucacgggacugaa

SEQ ID NO: 6183 - RNA, 18 nt, artificial
  Chemically synthesized
ggagcuggcugcccugaa

SEQ ID NO: 6184 - RNA, 18 nt, artificial
  Chemically synthesized
aggcgagaccgggaggga

SEQ ID NO: 6185 - RNA, 18 nt, artificial
  Chemically synthesized
guaggcuugugucaaaaa

SEQ ID NO: 6186 - RNA, 18 nt, artificial
  Chemically synthesized
cugcaggauuuccaucuu

SEQ ID NO: 6187 - RNA, 18 nt, artificial
  Chemically synthesized
ccugggaagaugaucauu

SEQ ID NO: 6188 - RNA, 18 nt, artificial
  Chemically synthesized
gcaggcucaucgggucgu

SEQ ID NO: 6189 - RNA, 18 nt, artificial
  Chemically synthesized
cagaaagggcauuuaaaa

SEQ ID NO: 6190 - RNA, 18 nt, artificial
  Chemically synthesized
cugcagaaagggcauuua

SEQ ID NO: 6191 - RNA, 18 nt, artificial
  Chemically synthesized
ggcguccuggacgccugg

SEQ ID NO: 6192 - RNA, 18 nt, artificial
  Chemically synthesized
gggaaggcgagaccggga

SEQ ID NO: 6193 - RNA, 18 nt, artificial
  Chemically synthesized
cagugcuuugcugucauu

SEQ ID NO: 6194 - RNA, 18 nt, artificial
  Chemically synthesized
gggcauuuaaaagucuuu

SEQ ID NO: 6195 - RNA, 18 nt, artificial
  Chemically synthesized
gcaggcaaucaccauuca

SEQ ID NO: 6196 - RNA, 18 nt, artificial
  Chemically synthesized
gagaccgggagggagcug

SEQ ID NO: 6197 - RNA, 18 nt, artificial
  Chemically synthesized
ccuuugaaaaaaggcaaa

SEQ ID NO: 6198 - RNA, 18 nt, artificial
  Chemically synthesized
gggagcuggcugcccuga

SEQ ID NO: 6199 - RNA, 18 nt, artificial
  Chemically synthesized
cggaccucacgggacuga

SEQ ID NO: 6200 - RNA, 18 nt, artificial
  Chemically synthesized
cgagaccgggagggagcu

SEQ ID NO: 6201 - RNA, 18 nt, artificial
  Chemically synthesized
cuaacggaccucacggga

SEQ ID NO: 6202 - RNA, 18 nt, artificial
  Chemically synthesized
ggcgaucugcagguccaa

SEQ ID NO: 6203 - RNA, 18 nt, artificial
  Chemically synthesized
cgcuccaccuuugaaaaa

SEQ ID NO: 6204 - RNA, 18 nt, Artificial Sequence
  Chemically synthesized
gcguccuggacgccuggu

SEQ ID NO: 6205 - RNA, 19 nt, artificial
  Chemically synthesized
agcaaauucuggaaguuaa

SEQ ID NO: 6206 - RNA, 19 nt, artificial
  Chemically synthesized
aucccuuccuggagacuaa

SEQ ID NO: 6207 - RNA, 19 nt, artificial
  Chemically synthesized
ccugauuuaugaacucuau

SEQ ID NO: 6208 - RNA, 19 nt, artificial
  Chemically synthesized
guucuaaggucucuucaga

SEQ ID NO: 6209 - RNA, 19 nt, artificial
  Chemically synthesized
cccugauuuaugaacucua

SEQ ID NO: 6210 - RNA, 19 nt, artificial
  Chemically synthesized
gaagccuguuugcaauuua

SEQ ID NO: 6211 - RNA, 19 nt, artificial
  Chemically synthesized
ggaggaagccuguuugcaa

SEQ ID NO: 6212 - RNA, 19 nt, artificial
  Chemically synthesized
cggaacuugucaucuccaa

SEQ ID NO: 6213 - RNA, 19 nt, artificial
  Chemically synthesized
guaacaaugcgauguauau

SEQ ID NO: 6214 - RNA, 19 nt, artificial
  Chemically synthesized
cccacuugacuucaccaaa

SEQ ID NO: 6215 - RNA, 19 nt, artificial
  Chemically synthesized
aagccuguuugcaauuuaa

SEQ ID NO: 6216 - RNA, 19 nt, artificial
  Chemically synthesized
ggaguggcugcucuccaaa

SEQ ID NO: 6217 - RNA, 19 nt, artificial
  Chemically synthesized
gccugaagagccagagcua

SEQ ID NO: 6218 - RNA, 19 nt, artificial
  Chemically synthesized
cagggaagcucaaagaucu

SEQ ID NO: 6219 - RNA, 19 nt, artificial
  Chemically synthesized
aggaguggcugcucuccaa

SEQ ID NO: 6220 - RNA, 19 nt, artificial
  Chemically synthesized
ggugacuuucuguaacaau

SEQ ID NO: 6221 - RNA, 19 nt, artificial
  Chemically synthesized
cgcugagcuugcuggacga

SEQ ID NO: 6222 - RNA, 19 nt, artificial
  Chemically synthesized
ccaccuucccauccagaca

SEQ ID NO: 6223 - RNA, 19 nt, artificial
  Chemically synthesized
gcuugcuggacgacaugaa

SEQ ID NO: 6224 - RNA, 19 nt, artificial
  Chemically synthesized
gcuuccucauucuuugaau

SEQ ID NO: 6225 - RNA, 19 nt, artificial
  Chemically synthesized
ggcgggccauuuugaauaa

SEQ ID NO: 6226 - RNA, 19 nt, artificial
  Chemically synthesized
gaggaagccuguuugcaau

SEQ ID NO: 6227 - RNA, 19 nt, artificial
  Chemically synthesized
gcgucaucgacuacauucu

SEQ ID NO: 6228 - RNA, 19 nt, artificial
  Chemically synthesized
ugagcuugcuggacgacau

SEQ ID NO: 6229 - RNA, 19 nt, artificial
  Chemically synthesized
agccgagcucacuccggaa

SEQ ID NO: 6230 - RNA, 19 nt, artificial
  Chemically synthesized
gcaaauucuggaaguuaau

SEQ ID NO: 6231 - RNA, 19 nt, artificial
  Chemically synthesized
ccaaaucccuuccuggaga

SEQ ID NO: 6232 - RNA, 19 nt, artificial
  Chemically synthesized
gugacuuucuguaacaaug

SEQ ID NO: 6233 - RNA, 19 nt, artificial
  Chemically synthesized
gucuccuuggagaaagguu

SEQ ID NO: 6234 - RNA, 19 nt, artificial
  Chemically synthesized
ccaaguucuaaggucucuu

SEQ ID NO: 6235 - RNA, 19 nt, artificial
  Chemically synthesized
ggaagccuguuugcaauuu

SEQ ID NO: 6236 - RNA, 19 nt, artificial
  Chemically synthesized
cuuccaggcaggcucuaua

SEQ ID NO: 6237 - RNA, 19 nt, artificial
  Chemically synthesized
ggucuucggcgucagacca

SEQ ID NO: 6238 - RNA, 19 nt, artificial
  Chemically synthesized
agcuuagccagguggaaau

SEQ ID NO: 6239 - RNA, 19 nt, artificial
  Chemically synthesized
cuguaacaaugcgauguau

SEQ ID NO: 6240 - RNA, 19 nt, artificial
  Chemically synthesized
cgaaggacugugaacuugu

SEQ ID NO: 6241 - RNA, 19 nt, artificial
  Chemically synthesized
guggcugcucuccaaacua

SEQ ID NO: 6242 - RNA, 19 nt, artificial
  Chemically synthesized
ggaaaaagcaaauucugga

SEQ ID NO: 6243 - RNA, 19 nt, artificial
  Chemically synthesized
aggugacuuucuguaacaa

SEQ ID NO: 6244 - RNA, 19 nt, artificial
  Chemically synthesized
gggcagggaagcucaaaga

SEQ ID NO: 6245 - RNA, 19 nt, artificial
  Chemically synthesized
cgggacuucuuuugguuuu

SEQ ID NO: 6246 - RNA, 19 nt, artificial
  Chemically synthesized
gguucuguugcccugauuu

SEQ ID NO: 6247 - RNA, 19 nt, artificial
  Chemically synthesized
gggccauuuugaauaaaga

SEQ ID NO: 6248 - RNA, 19 nt, artificial
  Chemically synthesized
aguuaaugguuuugaguga

SEQ ID NO: 6249 - RNA, 19 nt, artificial
  Chemically synthesized
agcgaaggacugugaacuu

SEQ ID NO: 6250 - RNA, 19 nt, artificial
  Chemically synthesized
cggcgucagaccagccgga

SEQ ID NO: 6251 - RNA, 19 nt, artificial
  Chemically synthesized
cccaaguucuaaggucucu

SEQ ID NO: 6252 - RNA, 19 nt, artificial
  Chemically synthesized
agcucacuccggaacuugu

SEQ ID NO: 6253 - RNA, 19 nt, artificial
  Chemically synthesized
cgagcucacuccggaacuu

SEQ ID NO: 6254 - RNA, 19 nt, artificial
  Chemically synthesized
uggcugcucuccaaacuau

SEQ ID NO: 6255 - RNA, 19 nt, artificial
  Chemically synthesized
gucagaccagccggaggaa

SEQ ID NO: 6256 - RNA, 19 nt, artificial
  Chemically synthesized
cuucuggucuccuuggaga

SEQ ID NO: 6257 - RNA, 19 nt, artificial
  Chemically synthesized
cuccuuggagaaagguucu

SEQ ID NO: 6258 - RNA, 19 nt, artificial
  Chemically synthesized
gacuucuuuugguuuucuu

SEQ ID NO: 6259 - RNA, 19 nt, artificial
  Chemically synthesized
cuuggagaaagguucuguu

SEQ ID NO: 6260 - RNA, 19 nt, artificial
  Chemically synthesized
agcgcgucaucgacuacau

SEQ ID NO: 6261 - RNA, 19 nt, artificial
  Chemically synthesized
acacuuguguauaugauga

SEQ ID NO: 6262 - RNA, 19 nt, artificial
  Chemically synthesized
acgacaugaaccacugcua

SEQ ID NO: 6263 - RNA, 19 nt, artificial
  Chemically synthesized
ggcugcucuccaaacuaug

SEQ ID NO: 6264 - RNA, 19 nt, artificial
  Chemically synthesized
aguucuaaggucucuucag

SEQ ID NO: 6265 - RNA, 19 nt, artificial
  Chemically synthesized
gcgcuuccucauucuuuga

SEQ ID NO: 6266 - RNA, 19 nt, artificial
  Chemically synthesized
ccggaacuugucaucucca

SEQ ID NO: 6267 - RNA, 19 nt, artificial
  Chemically synthesized
cacuguagcgggacuucuu

SEQ ID NO: 6268 - RNA, 19 nt, artificial
  Chemically synthesized
guggagguguggaaggagu

SEQ ID NO: 6269 - RNA, 19 nt, artificial
  Chemically synthesized
ggcaggcucuauaagugac

SEQ ID NO: 6270 - RNA, 19 nt, artificial
  Chemically synthesized
guaucagcgcuuccucauu

SEQ ID NO: 6271 - RNA, 19 nt, artificial
  Chemically synthesized
guucuguugcccugauuua

SEQ ID NO: 6272 - RNA, 19 nt, artificial
  Chemically synthesized
cggagucccgagaggcacu

SEQ ID NO: 6273 - RNA, 19 nt, artificial
  Chemically synthesized
cgucagaccagccggagga

SEQ ID NO: 6274 - RNA, 19 nt, artificial
  Chemically synthesized
gcugccaggaaaaagcaaa

SEQ ID NO: 6275 - RNA, 19 nt, artificial
  Chemically synthesized
acuacauucucgaccugca

SEQ ID NO: 6276 - RNA, 19 nt, artificial
  Chemically synthesized
gggaacugguacccggagu

SEQ ID NO: 6277 - RNA, 19 nt, artificial
  Chemically synthesized
cagccgagcucacuccgga

SEQ ID NO: 6278 - RNA, 19 nt, artificial
  Chemically synthesized
ccaggcaggcucuauaagu

SEQ ID NO: 6279 - RNA, 19 nt, artificial
  Chemically synthesized
gguaucagcgcuuccucau

SEQ ID NO: 6280 - RNA, 19 nt, artificial
  Chemically synthesized
gcccacuugacuucaccaa

SEQ ID NO: 6281 - RNA, 19 nt, artificial
  Chemically synthesized
gaaaaagcaaauucuggaa

SEQ ID NO: 6282 - RNA, 19 nt, artificial
  Chemically synthesized
cuugucaucuccaacgaca

SEQ ID NO: 6283 - RNA, 19 nt, artificial
  Chemically synthesized
cuuuuuuacaggaagguga

SEQ ID NO: 6284 - RNA, 19 nt, artificial
  Chemically synthesized
uucuggucuccuuggagaa

SEQ ID NO: 6285 - RNA, 19 nt, artificial
  Chemically synthesized
cccggagucccgagaggca

SEQ ID NO: 6286 - RNA, 19 nt, artificial
  Chemically synthesized
ggacuucuuuugguuuucu

SEQ ID NO: 6287 - RNA, 19 nt, artificial
  Chemically synthesized
aggcaggcucuauaaguga

SEQ ID NO: 6288 - RNA, 19 nt, artificial
  Chemically synthesized
ggugcucaggagcgaagga

SEQ ID NO: 6289 - RNA, 19 nt, artificial
  Chemically synthesized
ggagcuuuugccacugacu

SEQ ID NO: 6290 - RNA, 19 nt, artificial
  Chemically synthesized
uguccugacaccuccagaa

SEQ ID NO: 6291 - RNA, 19 nt, artificial
  Chemically synthesized
gggacuucuuuugguuuuc

SEQ ID NO: 6292 - RNA, 19 nt, artificial
  Chemically synthesized
ggagacuaaaccuggugcu

SEQ ID NO: 6293 - RNA, 19 nt, artificial
  Chemically synthesized
cuuucuguaacaaugcgau

SEQ ID NO: 6294 - RNA, 19 nt, artificial
  Chemically synthesized
gcgcgucaucgacuacauu

SEQ ID NO: 6295 - RNA, 19 nt, artificial
  Chemically synthesized
gcgggacuucuuuugguuu

SEQ ID NO: 6296 - RNA, 19 nt, artificial
  Chemically synthesized
ccaggaaaaagcaaauucu

SEQ ID NO: 6297 - RNA, 19 nt, artificial
  Chemically synthesized
agagcguggagguguggaa

SEQ ID NO: 6298 - RNA, 19 nt, artificial
  Chemically synthesized
caacgacaaaaggagcuuu

SEQ ID NO: 6299 - RNA, 19 nt, artificial
  Chemically synthesized
ccgccugcgggaacuggua

SEQ ID NO: 6300 - RNA, 19 nt, artificial
  Chemically synthesized
ggcagggaagcucaaagau

SEQ ID NO: 6301 - RNA, 19 nt, artificial
  Chemically synthesized
gacaugaaccacugcuacu

SEQ ID NO: 6302 - RNA, 19 nt, artificial
  Chemically synthesized
caccaaaucccuuccugga

SEQ ID NO: 6303 - RNA, 19 nt, artificial
  Chemically synthesized
guauauagguuuuguaccu

SEQ ID NO: 6304 - RNA, 19 nt, artificial
  Chemically synthesized
agcgcuuccucauucuuug

SEQ ID NO: 6305 - RNA, 19 nt, artificial
  Chemically synthesized
cugugaacuuguggccuga

SEQ ID NO: 6306 - RNA, 19 nt, artificial
  Chemically synthesized
ccuggugcucaggagcgaa

SEQ ID NO: 6307 - RNA, 19 nt, artificial
  Chemically synthesized
gguacccggagucccgaga

SEQ ID NO: 6308 - RNA, 19 nt, artificial
  Chemically synthesized
cagcgcuuccucauucuuu

SEQ ID NO: 6309 - RNA, 19 nt, artificial
  Chemically synthesized
ccuggagacuaaaccuggu

SEQ ID NO: 6310 - RNA, 19 nt, artificial
  Chemically synthesized
cauucucgaccugcaggua

SEQ ID NO: 6311 - RNA, 19 nt, artificial
  Chemically synthesized
ggaacuugucaucuccaac

SEQ ID NO: 6312 - RNA, 19 nt, artificial
  Chemically synthesized
gaggcacucagcuuagcca

SEQ ID NO: 6313 - RNA, 19 nt, artificial
  Chemically synthesized
ggagcgaaggacugugaac

SEQ ID NO: 6314 - RNA, 19 nt, artificial
  Chemically synthesized
ugucaucuccaacgacaaa

SEQ ID NO: 6315 - RNA, 19 nt, artificial
  Chemically synthesized
gcgggaacugguacccgga

SEQ ID NO: 6316 - RNA, 19 nt, artificial
  Chemically synthesized
gagcgaaggacugugaacu

SEQ ID NO: 6317 - RNA, 19 nt, artificial
  Chemically synthesized
gccugucggaacgcagucu

SEQ ID NO: 6318 - RNA, 19 nt, artificial
  Chemically synthesized
caaguucuaaggucucuuc

SEQ ID NO: 6319 - RNA, 19 nt, artificial
  Chemically synthesized
gguuuuguaccuuuuuuac

SEQ ID NO: 6320 - RNA, 19 nt, artificial
  Chemically synthesized
cucacuccggaacuuguca

SEQ ID NO: 6321 - RNA, 19 nt, artificial
  Chemically synthesized
cuguugcccugauuuauga

SEQ ID NO: 6322 - RNA, 19 nt, artificial
  Chemically synthesized
ggaaggaguggcugcucuc

SEQ ID NO: 6323 - RNA, 19 nt, artificial
  Chemically synthesized
gcgcguugcaggucacugu

SEQ ID NO: 6324 - RNA, 19 nt, artificial
  Chemically synthesized
ggagaaagguucuguugcc

SEQ ID NO: 6325 - RNA, 19 nt, artificial
  Chemically synthesized
cgcguugcaggucacugua

SEQ ID NO: 6326 - RNA, 19 nt, artificial
  Chemically synthesized
gaaggugacuuucuguaac

SEQ ID NO: 6327 - RNA, 19 nt, artificial
  Chemically synthesized
ugcuggacgacaugaacca

SEQ ID NO: 6328 - RNA, 19 nt, artificial
  Chemically synthesized
gcagcugaggagccgcuga

SEQ ID NO: 6329 - RNA, 19 nt, artificial
  Chemically synthesized
gccagguggaaauccuaca

SEQ ID NO: 6330 - RNA, 19 nt, artificial
  Chemically synthesized
ccguguccugacaccucca

SEQ ID NO: 6331 - RNA, 19 nt, artificial
  Chemically synthesized
ggccgaggcgggccauuuu

SEQ ID NO: 6332 - RNA, 19 nt, artificial
  Chemically synthesized
ggugugcugccugucggaa

SEQ ID NO: 6333 - RNA, 19 nt, artificial
  Chemically synthesized
aggaagccuguuugcaauu

SEQ ID NO: 6334 - RNA, 19 nt, artificial
  Chemically synthesized
ccuccagaacgcaggugcu

SEQ ID NO: 6335 - RNA, 19 nt, artificial
  Chemically synthesized
uugucaucuccaacgacaa

SEQ ID NO: 6336 - RNA, 19 nt, artificial
  Chemically synthesized
gucuucuggucuccuugga

SEQ ID NO: 6337 - RNA, 19 nt, artificial
  Chemically synthesized
caggcaggcucuauaagug

SEQ ID NO: 6338 - RNA, 19 nt, artificial
  Chemically synthesized
ccuuccaggcaggcucuau

SEQ ID NO: 6339 - RNA, 19 nt, artificial
  Chemically synthesized
aaguucuaaggucucuuca

SEQ ID NO: 6340 - RNA, 19 nt, artificial
  Chemically synthesized
gggccgaggcgggccauuu

SEQ ID NO: 6341 - RNA, 19 nt, artificial
  Chemically synthesized
uggucuccuuggagaaagg

SEQ ID NO: 6342 - RNA, 19 nt, artificial
  Chemically synthesized
cugccugucggaacgcagu

SEQ ID NO: 6343 - RNA, 19 nt, artificial
  Chemically synthesized
aauuuaagcgggcugugaa

SEQ ID NO: 6344 - RNA, 19 nt, artificial
  Chemically synthesized
aggaaggugacuuucugua

SEQ ID NO: 6345 - RNA, 19 nt, artificial
  Chemically synthesized
gggaaccucuccugccgga

SEQ ID NO: 6346 - RNA, 19 nt, artificial
  Chemically synthesized
uuccaggcaggcucuauaa

SEQ ID NO: 6347 - RNA, 19 nt, artificial
  Chemically synthesized
gugcgcgcguugcagguca

SEQ ID NO: 6348 - RNA, 19 nt, artificial
  Chemically synthesized
cgguaucagcgcuuccuca

SEQ ID NO: 6349 - RNA, 19 nt, artificial
  Chemically synthesized
gcgaaggacugugaacuug

SEQ ID NO: 6350 - RNA, 19 nt, artificial
  Chemically synthesized
ugcucaggagcgaaggacu

SEQ ID NO: 6351 - RNA, 19 nt, artificial
  Chemically synthesized
ccuuggagaaagguucugu

SEQ ID NO: 6352 - RNA, 19 nt, artificial
  Chemically synthesized
agccggaggaagccuguuu

SEQ ID NO: 6353 - RNA, 19 nt, artificial
  Chemically synthesized
aguggcugcucuccaaacu

SEQ ID NO: 6354 - RNA, 19 nt, artificial
  Chemically synthesized
aggagcgaaggacugugaa

SEQ ID NO: 6355 - RNA, 19 nt, artificial
  Chemically synthesized
ucccuuccuggagacuaaa

SEQ ID NO: 6356 - RNA, 19 nt, artificial
  Chemically synthesized
caauuuaagcgggcuguga

SEQ ID NO: 6357 - RNA, 19 nt, artificial
  Chemically synthesized
cuuuugguuuucuuucucu

SEQ ID NO: 6358 - RNA, 19 nt, artificial
  Chemically synthesized
agcgggacuucuuuugguu

SEQ ID NO: 6359 - RNA, 19 nt, artificial
  Chemically synthesized
cugccaggaaaaagcaaau

SEQ ID NO: 6360 - RNA, 19 nt, artificial
  Chemically synthesized
cggugugcugccugucgga

SEQ ID NO: 6361 - RNA, 19 nt, artificial
  Chemically synthesized
gaguauauagguuuuguac

SEQ ID NO: 6362 - RNA, 19 nt, artificial
  Chemically synthesized
cuuccuggagacuaaaccu

SEQ ID NO: 6363 - RNA, 19 nt, artificial
  Chemically synthesized
cccgagaggcacucagcuu

SEQ ID NO: 6364 - RNA, 19 nt, artificial
  Chemically synthesized
agguguggaaggaguggcu

SEQ ID NO: 6365 - RNA, 19 nt, artificial
  Chemically synthesized
ggaaccucuccugccggaa

SEQ ID NO: 6366 - RNA, 19 nt, artificial
  Chemically synthesized
ucuggucuccuuggagaaa

SEQ ID NO: 6367 - RNA, 19 nt, artificial
  Chemically synthesized
agacuaaaccuggugcuca

SEQ ID NO: 6368 - RNA, 19 nt, artificial
  Chemically synthesized
uuaacuuccagaauuugcu

SEQ ID NO: 6369 - RNA, 19 nt, artificial
  Chemically synthesized
uuagucuccaggaagggau

SEQ ID NO: 6370 - RNA, 19 nt, artificial
  Chemically synthesized
auagaguucauaaaucagg

SEQ ID NO: 6371 - RNA, 19 nt, artificial
  Chemically synthesized
ucugaagagaccuuagaac

SEQ ID NO: 6372 - RNA, 19 nt, artificial
  Chemically synthesized
uagaguucauaaaucaggg

SEQ ID NO: 6373 - RNA, 19 nt, artificial
  Chemically synthesized
uaaauugcaaacaggcuuc

SEQ ID NO: 6374 - RNA, 19 nt, artificial
  Chemically synthesized
uugcaaacaggcuuccucc

SEQ ID NO: 6375 - RNA, 19 nt, artificial
  Chemically synthesized
uuggagaugacaaguuccg

SEQ ID NO: 6376 - RNA, 19 nt, artificial
  Chemically synthesized
auauacaucgcauuguuac

SEQ ID NO: 6377 - RNA, 19 nt, artificial
  Chemically synthesized
uuuggugaagucaaguggg

SEQ ID NO: 6378 - RNA, 19 nt, artificial
  Chemically synthesized
uuaaauugcaaacaggcuu

SEQ ID NO: 6379 - RNA, 19 nt, artificial
  Chemically synthesized
uuuggagagcagccacucc

SEQ ID NO: 6380 - RNA, 19 nt, artificial
  Chemically synthesized
uagcucuggcucuucaggc

SEQ ID NO: 6381 - RNA, 19 nt, artificial
  Chemically synthesized
agaucuuugagcuucccug

SEQ ID NO: 6382 - RNA, 19 nt, artificial
  Chemically synthesized
uuggagagcagccacuccu

SEQ ID NO: 6383 - RNA, 19 nt, artificial
  Chemically synthesized
auuguuacagaaagucacc

SEQ ID NO: 6384 - RNA, 19 nt, artificial
  Chemically synthesized
ucguccagcaagcucagcg

SEQ ID NO: 6385 - RNA, 19 nt, artificial
  Chemically synthesized
ugucuggaugggaaggugg

SEQ ID NO: 6386 - RNA, 19 nt, artificial
  Chemically synthesized
uucaugucguccagcaagc

SEQ ID NO: 6387 - RNA, 19 nt, artificial
  Chemically synthesized
auucaaagaaugaggaagc

SEQ ID NO: 6388 - RNA, 19 nt, artificial
  Chemically synthesized
uuauucaaaauggcccgcc

SEQ ID NO: 6389 - RNA, 19 nt, artificial
  Chemically synthesized
auugcaaacaggcuuccuc

SEQ ID NO: 6390 - RNA, 19 nt, artificial
  Chemically synthesized
agaauguagucgaugacgc

SEQ ID NO: 6391 - RNA, 19 nt, artificial
  Chemically synthesized
augucguccagcaagcuca

SEQ ID NO: 6392 - RNA, 19 nt, artificial
  Chemically synthesized
uuccggagugagcucggcu

SEQ ID NO: 6393 - RNA, 19 nt, artificial
  Chemically synthesized
auuaacuuccagaauuugc

SEQ ID NO: 6394 - RNA, 19 nt, artificial
  Chemically synthesized
ucuccaggaagggauuugg

SEQ ID NO: 6395 - RNA, 19 nt, artificial
  Chemically synthesized
cauuguuacagaaagucac

SEQ ID NO: 6396 - RNA, 19 nt, artificial
  Chemically synthesized
aaccuuucuccaaggagac

SEQ ID NO: 6397 - RNA, 19 nt, artificial
  Chemically synthesized
aagagaccuuagaacuugg

SEQ ID NO: 6398 - RNA, 19 nt, artificial
  Chemically synthesized
aaauugcaaacaggcuucc

SEQ ID NO: 6399 - RNA, 19 nt, artificial
  Chemically synthesized
uauagagccugccuggaag

SEQ ID NO: 6400 - RNA, 19 nt, artificial
  Chemically synthesized
uggucugacgccgaagacc

SEQ ID NO: 6401 - RNA, 19 nt, artificial
  Chemically synthesized
auuuccaccuggcuaagcu

SEQ ID NO: 6402 - RNA, 19 nt, artificial
  Chemically synthesized
auacaucgcauuguuacag

SEQ ID NO: 6403 - RNA, 19 nt, artificial
  Chemically synthesized
acaaguucacaguccuucg

SEQ ID NO: 6404 - RNA, 19 nt, artificial
  Chemically synthesized
uaguuuggagagcagccac

SEQ ID NO: 6405 - RNA, 19 nt, artificial
  Chemically synthesized
uccagaauuugcuuuuucc

SEQ ID NO: 6406 - RNA, 19 nt, artificial
  Chemically synthesized
uuguuacagaaagucaccu

SEQ ID NO: 6407 - RNA, 19 nt, artificial
  Chemically synthesized
ucuuugagcuucccugccc

SEQ ID NO: 6408 - RNA, 19 nt, artificial
  Chemically synthesized
aaaaccaaaagaagucccg

SEQ ID NO: 6409 - RNA, 19 nt, artificial
  Chemically synthesized
aaaucagggcaacagaacc

SEQ ID NO: 6410 - RNA, 19 nt, artificial
  Chemically synthesized
ucuuuauucaaaauggccc

SEQ ID NO: 6411 - RNA, 19 nt, artificial
  Chemically synthesized
ucacucaaaaccauuaacu

SEQ ID NO: 6412 - RNA, 19 nt, artificial
  Chemically synthesized
aaguucacaguccuucgcu

SEQ ID NO: 6413 - RNA, 19 nt, artificial
  Chemically synthesized
uccggcuggucugacgccg

SEQ ID NO: 6414 - RNA, 19 nt, artificial
  Chemically synthesized
agagaccuuagaacuuggg

SEQ ID NO: 6415 - RNA, 19 nt, artificial
  Chemically synthesized
acaaguuccggagugagcu

SEQ ID NO: 6416 - RNA, 19 nt, artificial
  Chemically synthesized
aaguuccggagugagcucg

SEQ ID NO: 6417 - RNA, 19 nt, artificial
  Chemically synthesized
auaguuuggagagcagcca

SEQ ID NO: 6418 - RNA, 19 nt, artificial
  Chemically synthesized
uuccuccggcuggucugac

SEQ ID NO: 6419 - RNA, 19 nt, artificial
  Chemically synthesized
ucuccaaggagaccagaag

SEQ ID NO: 6420 - RNA, 19 nt, artificial
  Chemically synthesized
agaaccuuucuccaaggag

SEQ ID NO: 6421 - RNA, 19 nt, artificial
  Chemically synthesized
aagaaaaccaaaagaaguc

SEQ ID NO: 6422 - RNA, 19 nt, artificial
  Chemically synthesized
aacagaaccuuucuccaag

SEQ ID NO: 6423 - RNA, 19 nt, artificial
  Chemically synthesized
auguagucgaugacgcgcu

SEQ ID NO: 6424 - RNA, 19 nt, artificial
  Chemically synthesized
ucaucauauacacaagugu

SEQ ID NO: 6425 - RNA, 19 nt, artificial
  Chemically synthesized
uagcagugguucaugucgu

SEQ ID NO: 6426 - RNA, 19 nt, artificial
  Chemically synthesized
cauaguuuggagagcagcc

SEQ ID NO: 6427 - RNA, 19 nt, artificial
  Chemically synthesized
cugaagagaccuuagaacu

SEQ ID NO: 6428 - RNA, 19 nt, artificial
  Chemically synthesized
ucaaagaaugaggaagcgc

SEQ ID NO: 6429 - RNA, 19 nt, artificial
  Chemically synthesized
uggagaugacaaguuccgg

SEQ ID NO: 6430 - RNA, 19 nt, artificial
  Chemically synthesized
aagaagucccgcuacagug

SEQ ID NO: 6431 - RNA, 19 nt, artificial
  Chemically synthesized
acuccuuccacaccuccac

SEQ ID NO: 6432 - RNA, 19 nt, artificial
  Chemically synthesized
gucacuuauagagccugcc

SEQ ID NO: 6433 - RNA, 19 nt, artificial
  Chemically synthesized
aaugaggaagcgcugauac

SEQ ID NO: 6434 - RNA, 19 nt, artificial
  Chemically synthesized
uaaaucagggcaacagaac

SEQ ID NO: 6435 - RNA, 19 nt, artificial
  Chemically synthesized
agugccucucgggacuccg

SEQ ID NO: 6436 - RNA, 19 nt, artificial
  Chemically synthesized
uccuccggcuggucugacg

SEQ ID NO: 6437 - RNA, 19 nt, artificial
  Chemically synthesized
uuugcuuuuuccuggcagc

SEQ ID NO: 6438 - RNA, 19 nt, artificial
  Chemically synthesized
ugcaggucgagaauguagu

SEQ ID NO: 6439 - RNA, 19 nt, artificial
  Chemically synthesized
acuccggguaccaguuccc

SEQ ID NO: 6440 - RNA, 19 nt, artificial
  Chemically synthesized
uccggagugagcucggcug

SEQ ID NO: 6441 - RNA, 19 nt, artificial
  Chemically synthesized
acuuauagagccugccugg

SEQ ID NO: 6442 - RNA, 19 nt, artificial
  Chemically synthesized
augaggaagcgcugauacc

SEQ ID NO: 6443 - RNA, 19 nt, artificial
  Chemically synthesized
uuggugaagucaagugggc

SEQ ID NO: 6444 - RNA, 19 nt, artificial
  Chemically synthesized
uuccagaauuugcuuuuuc

SEQ ID NO: 6445 - RNA, 19 nt, artificial
  Chemically synthesized
ugucguuggagaugacaag

SEQ ID NO: 6446 - RNA, 19 nt, artificial
  Chemically synthesized
ucaccuuccuguaaaaaag

SEQ ID NO: 6447 - RNA, 19 nt, artificial
  Chemically synthesized
uucuccaaggagaccagaa

SEQ ID NO: 6448 - RNA, 19 nt, artificial
  Chemically synthesized
ugccucucgggacuccggg

SEQ ID NO: 6449 - RNA, 19 nt, artificial
  Chemically synthesized
agaaaaccaaaagaagucc

SEQ ID NO: 6450 - RNA, 19 nt, artificial
  Chemically synthesized
ucacuuauagagccugccu

SEQ ID NO: 6451 - RNA, 19 nt, artificial
  Chemically synthesized
uccuucgcuccugagcacc

SEQ ID NO: 6452 - RNA, 19 nt, artificial
  Chemically synthesized
agucaguggcaaaagcucc

SEQ ID NO: 6453 - RNA, 19 nt, artificial
  Chemically synthesized
uucuggaggugucaggaca

SEQ ID NO: 6454 - RNA, 19 nt, artificial
  Chemically synthesized
gaaaaccaaaagaaguccc

SEQ ID NO: 6455 - RNA, 19 nt, artificial
  Chemically synthesized
agcaccagguuuagucucc

SEQ ID NO: 6456 - RNA, 19 nt, artificial
  Chemically synthesized
aucgcauuguuacagaaag

SEQ ID NO: 6457 - RNA, 19 nt, artificial
  Chemically synthesized
aauguagucgaugacgcgc

SEQ ID NO: 6458 - RNA, 19 nt, artificial
  Chemically synthesized
aaaccaaaagaagucccgc

SEQ ID NO: 6459 - RNA, 19 nt, artificial
  Chemically synthesized
agaauuugcuuuuuccugg

SEQ ID NO: 6460 - RNA, 19 nt, artificial
  Chemically synthesized
uuccacaccuccacgcucu

SEQ ID NO: 6461 - RNA, 19 nt, artificial
  Chemically synthesized
aaagcuccuuuugucguug

SEQ ID NO: 6462 - RNA, 19 nt, artificial
  Chemically synthesized
uaccaguucccgcaggcgg

SEQ ID NO: 6463 - RNA, 19 nt, artificial
  Chemically synthesized
aucuuugagcuucccugcc

SEQ ID NO: 6464 - RNA, 19 nt, artificial
  Chemically synthesized
aguagcagugguucauguc

SEQ ID NO: 6465 - RNA, 19 nt, artificial
  Chemically synthesized
uccaggaagggauuuggug

SEQ ID NO: 6466 - RNA, 19 nt, artificial
  Chemically synthesized
agguacaaaaccuauauac

SEQ ID NO: 6467 - RNA, 19 nt, artificial
  Chemically synthesized
caaagaaugaggaagcgcu

SEQ ID NO: 6468 - RNA, 19 nt, artificial
  Chemically synthesized
ucaggccacaaguucacag

SEQ ID NO: 6469 - RNA, 19 nt, artificial
  Chemically synthesized
uucgcuccugagcaccagg

SEQ ID NO: 6470 - RNA, 19 nt, artificial
  Chemically synthesized
ucucgggacuccggguacc

SEQ ID NO: 6471 - RNA, 19 nt, artificial
  Chemically synthesized
aaagaaugaggaagcgcug

SEQ ID NO: 6472 - RNA, 19 nt, artificial
  Chemically synthesized
accagguuuagucuccagg

SEQ ID NO: 6473 - RNA, 19 nt, artificial
  Chemically synthesized
uaccugcaggucgagaaug

SEQ ID NO: 6474 - RNA, 19 nt, artificial
  Chemically synthesized
guuggagaugacaaguucc

SEQ ID NO: 6475 - RNA, 19 nt, artificial
  Chemically synthesized
uggcuaagcugagugccuc

SEQ ID NO: 6476 - RNA, 19 nt, artificial
  Chemically synthesized
guucacaguccuucgcucc

SEQ ID NO: 6477 - RNA, 19 nt, artificial
  Chemically synthesized
uuugucguuggagaugaca

SEQ ID NO: 6478 - RNA, 19 nt, artificial
  Chemically synthesized
uccggguaccaguucccgc

SEQ ID NO: 6479 - RNA, 19 nt, artificial
  Chemically synthesized
aguucacaguccuucgcuc

SEQ ID NO: 6480 - RNA, 19 nt, artificial
  Chemically synthesized
agacugcguuccgacaggc

SEQ ID NO: 6481 - RNA, 19 nt, artificial
  Chemically synthesized
gaagagaccuuagaacuug

SEQ ID NO: 6482 - RNA, 19 nt, artificial
  Chemically synthesized
guaaaaaagguacaaaacc

SEQ ID NO: 6483 - RNA, 19 nt, artificial
  Chemically synthesized
ugacaaguuccggagugag

SEQ ID NO: 6484 - RNA, 19 nt, artificial
  Chemically synthesized
ucauaaaucagggcaacag

SEQ ID NO: 6485 - RNA, 19 nt, artificial
  Chemically synthesized
gagagcagccacuccuucc

SEQ ID NO: 6486 - RNA, 19 nt, artificial
  Chemically synthesized
acagugaccugcaacgcgc

SEQ ID NO: 6487 - RNA, 19 nt, artificial
  Chemically synthesized
ggcaacagaaccuuucucc

SEQ ID NO: 6488 - RNA, 19 nt, artificial
  Chemically synthesized
uacagugaccugcaacgcg

SEQ ID NO: 6489 - RNA, 19 nt, artificial
  Chemically synthesized
guuacagaaagucaccuuc

SEQ ID NO: 6490 - RNA, 19 nt, artificial
  Chemically synthesized
ugguucaugucguccagca

SEQ ID NO: 6491 - RNA, 19 nt, artificial
  Chemically synthesized
ucagcggcuccucagcugc

SEQ ID NO: 6492 - RNA, 19 nt, artificial
  Chemically synthesized
uguaggauuuccaccuggc

SEQ ID NO: 6493 - RNA, 19 nt, artificial
  Chemically synthesized
uggaggugucaggacacgg

SEQ ID NO: 6494 - RNA, 19 nt, artificial
  Chemically synthesized
aaaauggcccgccucggcc

SEQ ID NO: 6495 - RNA, 19 nt, artificial
  Chemically synthesized
uuccgacaggcagcacacc

SEQ ID NO: 6496 - RNA, 19 nt, artificial
  Chemically synthesized
aauugcaaacaggcuuccu

SEQ ID NO: 6497 - RNA, 19 nt, artificial
  Chemically synthesized
agcaccugcguucuggagg

SEQ ID NO: 6498 - RNA, 19 nt, artificial
  Chemically synthesized
uugucguuggagaugacaa

SEQ ID NO: 6499 - RNA, 19 nt, artificial
  Chemically synthesized
uccaaggagaccagaagac

SEQ ID NO: 6500 - RNA, 19 nt, artificial
  Chemically synthesized
cacuuauagagccugccug

SEQ ID NO: 6501 - RNA, 19 nt, artificial
  Chemically synthesized
auagagccugccuggaagg

SEQ ID NO: 6502 - RNA, 19 nt, artificial
  Chemically synthesized
ugaagagaccuuagaacuu

SEQ ID NO: 6503 - RNA, 19 nt, artificial
  Chemically synthesized
aaauggcccgccucggccc

SEQ ID NO: 6504 - RNA, 19 nt, artificial
  Chemically synthesized
ccuuucuccaaggagacca

SEQ ID NO: 6505 - RNA, 19 nt, artificial
  Chemically synthesized
acugcguuccgacaggcag

SEQ ID NO: 6506 - RNA, 19 nt, artificial
  Chemically synthesized
uucacagcccgcuuaaauu

SEQ ID NO: 6507 - RNA, 19 nt, artificial
  Chemically synthesized
uacagaaagucaccuuccu

SEQ ID NO: 6508 - RNA, 19 nt, artificial
  Chemically synthesized
uccggcaggagagguuccc

SEQ ID NO: 6509 - RNA, 19 nt, artificial
  Chemically synthesized
uuauagagccugccuggaa

SEQ ID NO: 6510 - RNA, 19 nt, artificial
  Chemically synthesized
ugaccugcaacgcgcgcac

SEQ ID NO: 6511 - RNA, 19 nt, artificial
  Chemically synthesized
ugaggaagcgcugauaccg

SEQ ID NO: 6512 - RNA, 19 nt, artificial
  Chemically synthesized
caaguucacaguccuucgc

SEQ ID NO: 6513 - RNA, 19 nt, artificial
  Chemically synthesized
aguccuucgcuccugagca

SEQ ID NO: 6514 - RNA, 19 nt, artificial
  Chemically synthesized
acagaaccuuucuccaagg

SEQ ID NO: 6515 - RNA, 19 nt, artificial
  Chemically synthesized
aaacaggcuuccuccggcu

SEQ ID NO: 6516 - RNA, 19 nt, artificial
  Chemically synthesized
aguuuggagagcagccacu

SEQ ID NO: 6517 - RNA, 19 nt, artificial
  Chemically synthesized
uucacaguccuucgcuccu

SEQ ID NO: 6518 - RNA, 19 nt, artificial
  Chemically synthesized
uuuagucuccaggaaggga

SEQ ID NO: 6519 - RNA, 19 nt, artificial
  Chemically synthesized
ucacagcccgcuuaaauug

SEQ ID NO: 6520 - RNA, 19 nt, artificial
  Chemically synthesized
agagaaagaaaaccaaaag

SEQ ID NO: 6521 - RNA, 19 nt, artificial
  Chemically synthesized
aaccaaaagaagucccgcu

SEQ ID NO: 6522 - RNA, 19 nt, artificial
  Chemically synthesized
auuugcuuuuuccuggcag

SEQ ID NO: 6523 - RNA, 19 nt, artificial
  Chemically synthesized
uccgacaggcagcacaccg

SEQ ID NO: 6524 - RNA, 19 nt, artificial
  Chemically synthesized
guacaaaaccuauauacuc

SEQ ID NO: 6525 - RNA, 19 nt, artificial
  Chemically synthesized
agguuuagucuccaggaag

SEQ ID NO: 6526 - RNA, 19 nt, artificial
  Chemically synthesized
aagcugagugccucucggg

SEQ ID NO: 6527 - RNA, 19 nt, artificial
  Chemically synthesized
agccacuccuuccacaccu

SEQ ID NO: 6528 - RNA, 19 nt, artificial
  Chemically synthesized
uuccggcaggagagguucc

SEQ ID NO: 6529 - RNA, 19 nt, artificial
  Chemically synthesized
uuucuccaaggagaccaga

SEQ ID NO: 6530 - RNA, 19 nt, Artificial Sequence
  Chemically synthesized
ugagcaccagguuuagucu

SEQ ID NO: 6531 - RNA, 19 nt, artificial
  Chemically synthesized
cucagcuuagccaggugga

SEQ ID NO: 6532 - RNA, 19 nt, artificial
  Chemically synthesized
gcaugaaggcgcugagccc

SEQ ID NO: 6533 - RNA, 19 nt, artificial
  Chemically synthesized
cuggacgacaugaaccacu

SEQ ID NO: 6534 - RNA, 19 nt, artificial
  Chemically synthesized
ucagcuuagccagguggaa

SEQ ID NO: 6535 - RNA, 19 nt, artificial
  Chemically synthesized
caggaaggugacuuucugu

SEQ ID NO: 6536 - RNA, 19 nt, artificial
  Chemically synthesized
uagccagguggaaauccua

SEQ ID NO: 6537 - RNA, 19 nt, artificial
  Chemically synthesized
gacgacaugaaccacugcu

SEQ ID NO: 6538 - RNA, 19 nt, artificial
  Chemically synthesized
uggacgacaugaaccacug

SEQ ID NO: 6539 - RNA, 19 nt, artificial
  Chemically synthesized
ggacgacaugaaccacugc

SEQ ID NO: 6540 - RNA, 19 nt, artificial
  Chemically synthesized
ggcacucagcuuagccagg

SEQ ID NO: 6541 - RNA, 19 nt, artificial
  Chemically synthesized
cacucagcuuagccaggug

SEQ ID NO: 6542 - RNA, 19 nt, artificial
  Chemically synthesized
gcucacuccggaacuuguc

SEQ ID NO: 6543 - RNA, 19 nt, artificial
  Chemically synthesized
cgacaugaaccacugcuac

SEQ ID NO: 6544 - RNA, 19 nt, artificial
  Chemically synthesized
cagcgcgucaucgacuaca

SEQ ID NO: 6545 - RNA, 19 nt, artificial
  Chemically synthesized
gcacucagcuuagccaggu

SEQ ID NO: 6546 - RNA, 19 nt, artificial
  Chemically synthesized
uuuacaggaaggugacuuu

SEQ ID NO: 6547 - RNA, 19 nt, artificial
  Chemically synthesized
gugugcugccugucggaac

SEQ ID NO: 6548 - RNA, 19 nt, artificial
  Chemically synthesized
gagcucacuccggaacuug

SEQ ID NO: 6549 - RNA, 19 nt, artificial
  Chemically synthesized
gcggcugcuacgaggcggu

SEQ ID NO: 6550 - RNA, 19 nt, artificial
  Chemically synthesized
ugugcugccugucggaacg

SEQ ID NO: 6551 - RNA, 19 nt, artificial
  Chemically synthesized
gaggcggugugcugccugu

SEQ ID NO: 6552 - RNA, 19 nt, artificial
  Chemically synthesized
ggcugcuacgaggcggugu

SEQ ID NO: 6553 - RNA, 19 nt, artificial
  Chemically synthesized
gcaggugcuggcgcccguu

SEQ ID NO: 6554 - RNA, 19 nt, artificial
  Chemically synthesized
aggcacucagcuuagccag

SEQ ID NO: 6555 - RNA, 19 nt, artificial
  Chemically synthesized
cggugcgcggcugcuacga

SEQ ID NO: 6556 - RNA, 19 nt, artificial
  Chemically synthesized
aggugcuggcgcccguucu

SEQ ID NO: 6557 - RNA, 19 nt, artificial
  Chemically synthesized
uacaggaaggugacuuucu

SEQ ID NO: 6558 - RNA, 19 nt, artificial
  Chemically synthesized
ggugcgcggcugcuacgag

SEQ ID NO: 6559 - RNA, 19 nt, artificial
  Chemically synthesized
acaugaaccacugcuacuc

SEQ ID NO: 6560 - RNA, 19 nt, artificial
  Chemically synthesized
gcuuagccagguggaaauc

SEQ ID NO: 6561 - RNA, 19 nt, artificial
  Chemically synthesized
gcugcuacgaggcggugug

SEQ ID NO: 6562 - RNA, 19 nt, artificial
  Chemically synthesized
gugcgcggcugcuacgagg

SEQ ID NO: 6563 - RNA, 19 nt, artificial
  Chemically synthesized
cagagcuggucuucugguc

SEQ ID NO: 6564 - RNA, 19 nt, artificial
  Chemically synthesized
gcuacgaggcggugugcug

SEQ ID NO: 6565 - RNA, 19 nt, artificial
  Chemically synthesized
gaacgcaggugcuggcgcc

SEQ ID NO: 6566 - RNA, 19 nt, artificial
  Chemically synthesized
caugaaccacugcuacucc

SEQ ID NO: 6567 - RNA, 19 nt, artificial
  Chemically synthesized
ccagaacgcaggugcuggc

SEQ ID NO: 6568 - RNA, 19 nt, artificial
  Chemically synthesized
uuagccagguggaaauccu

SEQ ID NO: 6569 - RNA, 19 nt, artificial
  Chemically synthesized
caugaaggcgcugagcccg

SEQ ID NO: 6570 - RNA, 19 nt, artificial
  Chemically synthesized
ggcggugugcugccugucg

SEQ ID NO: 6571 - RNA, 19 nt, artificial
  Chemically synthesized
cuccagaacgcaggugcug

SEQ ID NO: 6572 - RNA, 19 nt, artificial
  Chemically synthesized
ugaaggcgcugagcccggu

SEQ ID NO: 6573 - RNA, 19 nt, artificial
  Chemically synthesized
gcggugugcugccugucgg

SEQ ID NO: 6574 - RNA, 19 nt, artificial
  Chemically synthesized
accuccagaacgcaggugc

SEQ ID NO: 6575 - RNA, 19 nt, artificial
  Chemically synthesized
gaaggcgcugagcccggug

SEQ ID NO: 6576 - RNA, 19 nt, artificial
  Chemically synthesized
caggugcuggcgcccguuc

SEQ ID NO: 6577 - RNA, 19 nt, artificial
  Chemically synthesized
acagcgcgucaucgacuac

SEQ ID NO: 6578 - RNA, 19 nt, artificial
  Chemically synthesized
agaggcacucagcuuagcc

SEQ ID NO: 6579 - RNA, 19 nt, artificial
  Chemically synthesized
uccagaacgcaggugcugg

SEQ ID NO: 6580 - RNA, 19 nt, artificial
  Chemically synthesized
acucagcuuagccaggugg

SEQ ID NO: 6581 - RNA, 19 nt, artificial
  Chemically synthesized
uuuuuuacaggaaggugac

SEQ ID NO: 6582 - RNA, 19 nt, artificial
  Chemically synthesized
ugcuacgaggcggugugcu

SEQ ID NO: 6583 - RNA, 19 nt, artificial
  Chemically synthesized
uuuuacaggaaggugacuu

SEQ ID NO: 6584 - RNA, 19 nt, artificial
  Chemically synthesized
agaacgcaggugcuggcgc

SEQ ID NO: 6585 - RNA, 19 nt, artificial
  Chemically synthesized
cagaacgcaggugcuggcg

SEQ ID NO: 6586 - RNA, 19 nt, artificial
  Chemically synthesized
gugcugccugucggaacgc

SEQ ID NO: 6587 - RNA, 19 nt, artificial
  Chemically synthesized
uuuuuacaggaaggugacu

SEQ ID NO: 6588 - RNA, 19 nt, artificial
  Chemically synthesized
cuacgaggcggugugcugc

SEQ ID NO: 6589 - RNA, 19 nt, artificial
  Chemically synthesized
ugcgcggcugcuacgaggc

SEQ ID NO: 6590 - RNA, 19 nt, artificial
  Chemically synthesized
cuuagccagguggaaaucc

SEQ ID NO: 6591 - RNA, 19 nt, artificial
  Chemically synthesized
augaaggcgcugagcccgg

SEQ ID NO: 6592 - RNA, 19 nt, artificial
  Chemically synthesized
uuacaggaaggugacuuuc

SEQ ID NO: 6593 - RNA, 19 nt, artificial
  Chemically synthesized
cugcuacgaggcggugugc

SEQ ID NO: 6594 - RNA, 19 nt, artificial
  Chemically synthesized
aggcggugugcugccuguc

SEQ ID NO: 6595 - RNA, 19 nt, artificial
  Chemically synthesized
cgaggcggugugcugccug

SEQ ID NO: 6596 - RNA, 19 nt, artificial
  Chemically synthesized
acgaggcggugugcugccu

SEQ ID NO: 6597 - RNA, 19 nt, artificial
  Chemically synthesized
cggcugcuacgaggcggug

SEQ ID NO: 6598 - RNA, 19 nt, artificial
  Chemically synthesized
aaggcgcugagcccggugc

SEQ ID NO: 6599 - RNA, 19 nt, artificial
  Chemically synthesized
aacgcaggugcuggcgccc

SEQ ID NO: 6600 - RNA, 19 nt, artificial
  Chemically synthesized
uacgaggcggugugcugcc

SEQ ID NO: 6601 - RNA, 19 nt, artificial
  Chemically synthesized
uccaccuggcuaagcugag

SEQ ID NO: 6602 - RNA, 19 nt, artificial
  Chemically synthesized
gggcucagcgccuucaugc

SEQ ID NO: 6603 - RNA, 19 nt, artificial
  Chemically synthesized
agugguucaugucguccag

SEQ ID NO: 6604 - RNA, 19 nt, artificial
  Chemically synthesized
uuccaccuggcuaagcuga

SEQ ID NO: 6605 - RNA, 19 nt, artificial
  Chemically synthesized
acagaaagucaccuuccug

SEQ ID NO: 6606 - RNA, 19 nt, artificial
  Chemically synthesized
uaggauuuccaccuggcua

SEQ ID NO: 6607 - RNA, 19 nt, artificial
  Chemically synthesized
agcagugguucaugucguc

SEQ ID NO: 6608 - RNA, 19 nt, artificial
  Chemically synthesized
cagugguucaugucgucca

SEQ ID NO: 6609 - RNA, 19 nt, artificial
  Chemically synthesized
gcagugguucaugucgucc

SEQ ID NO: 6610 - RNA, 19 nt, artificial
  Chemically synthesized
ccuggcuaagcugagugcc

SEQ ID NO: 6611 - RNA, 19 nt, artificial
  Chemically synthesized
caccuggcuaagcugagug

SEQ ID NO: 6612 - RNA, 19 nt, artificial
  Chemically synthesized
gacaaguuccggagugagc

SEQ ID NO: 6613 - RNA, 19 nt, artificial
  Chemically synthesized
guagcagugguucaugucg

SEQ ID NO: 6614 - RNA, 19 nt, artificial
  Chemically synthesized
uguagucgaugacgcgcug

SEQ ID NO: 6615 - RNA, 19 nt, artificial
  Chemically synthesized
accuggcuaagcugagugc

SEQ ID NO: 6616 - RNA, 19 nt, artificial
  Chemically synthesized
aaagucaccuuccuguaaa

SEQ ID NO: 6617 - RNA, 19 nt, artificial
  Chemically synthesized
guuccgacaggcagcacac

SEQ ID NO: 6618 - RNA, 19 nt, artificial
  Chemically synthesized
caaguuccggagugagcuc

SEQ ID NO: 6619 - RNA, 19 nt, artificial
  Chemically synthesized
accgccucguagcagccgc

SEQ ID NO: 6620 - RNA, 19 nt, artificial
  Chemically synthesized
cguuccgacaggcagcaca

SEQ ID NO: 6621 - RNA, 19 nt, artificial
  Chemically synthesized
acaggcagcacaccgccuc

SEQ ID NO: 6622 - RNA, 19 nt, artificial
  Chemically synthesized
acaccgccucguagcagcc

SEQ ID NO: 6623 - RNA, 19 nt, artificial
  Chemically synthesized
aacgggcgccagcaccugc

SEQ ID NO: 6624 - RNA, 19 nt, artificial
  Chemically synthesized
cuggcuaagcugagugccu

SEQ ID NO: 6625 - RNA, 19 nt, artificial
  Chemically synthesized
ucguagcagccgcgcaccg

SEQ ID NO: 6626 - RNA, 19 nt, artificial
  Chemically synthesized
agaacgggcgccagcaccu

SEQ ID NO: 6627 - RNA, 19 nt, artificial
  Chemically synthesized
agaaagucaccuuccugua

SEQ ID NO: 6628 - RNA, 19 nt, artificial
  Chemically synthesized
cucguagcagccgcgcacc

SEQ ID NO: 6629 - RNA, 19 nt, artificial
  Chemically synthesized
gaguagcagugguucaugu

SEQ ID NO: 6630 - RNA, 19 nt, artificial
  Chemically synthesized
gauuuccaccuggcuaagc

SEQ ID NO: 6631 - RNA, 19 nt, artificial
  Chemically synthesized
cacaccgccucguagcagc

SEQ ID NO: 6632 - RNA, 19 nt, artificial
  Chemically synthesized
ccucguagcagccgcgcac

SEQ ID NO: 6633 - RNA, 19 nt, artificial
  Chemically synthesized
gaccagaagaccagcucug

SEQ ID NO: 6634 - RNA, 19 nt, artificial
  Chemically synthesized
cagcacaccgccucguagc

SEQ ID NO: 6635 - RNA, 19 nt, artificial
  Chemically synthesized
ggcgccagcaccugcguuc

SEQ ID NO: 6636 - RNA, 19 nt, artificial
  Chemically synthesized
ggaguagcagugguucaug

SEQ ID NO: 6637 - RNA, 19 nt, artificial
  Chemically synthesized
gccagcaccugcguucugg

SEQ ID NO: 6638 - RNA, 19 nt, artificial
  Chemically synthesized
aggauuuccaccuggcuaa

SEQ ID NO: 6639 - RNA, 19 nt, artificial
  Chemically synthesized
cgggcucagcgccuucaug

SEQ ID NO: 6640 - RNA, 19 nt, artificial
  Chemically synthesized
cgacaggcagcacaccgcc

SEQ ID NO: 6641 - RNA, 19 nt, artificial
  Chemically synthesized
cagcaccugcguucuggag

SEQ ID NO: 6642 - RNA, 19 nt, artificial
  Chemically synthesized
accgggcucagcgccuuca

SEQ ID NO: 6643 - RNA, 19 nt, artificial
  Chemically synthesized
ccgacaggcagcacaccgc

SEQ ID NO: 6644 - RNA, 19 nt, artificial
  Chemically synthesized
gcaccugcguucuggaggu

SEQ ID NO: 6645 - RNA, 19 nt, artificial
  Chemically synthesized
caccgggcucagcgccuuc

SEQ ID NO: 6646 - RNA, 19 nt, artificial
  Chemically synthesized
gaacgggcgccagcaccug

SEQ ID NO: 6647 - RNA, 19 nt, artificial
  Chemically synthesized
guagucgaugacgcgcugu

SEQ ID NO: 6648 - RNA, 19 nt, artificial
  Chemically synthesized
ggcuaagcugagugccucu

SEQ ID NO: 6649 - RNA, 19 nt, artificial
  Chemically synthesized
ccagcaccugcguucugga

SEQ ID NO: 6650 - RNA, 19 nt, artificial
  Chemically synthesized
ccaccuggcuaagcugagu

SEQ ID NO: 6651 - RNA, 19 nt, artificial
  Chemically synthesized
gucaccuuccuguaaaaaa

SEQ ID NO: 6652 - RNA, 19 nt, artificial
  Chemically synthesized
agcacaccgccucguagca

SEQ ID NO: 6653 - RNA, 19 nt, artificial
  Chemically synthesized
aagucaccuuccuguaaaa

SEQ ID NO: 6654 - RNA, 19 nt, artificial
  Chemically synthesized
gcgccagcaccugcguucu

SEQ ID NO: 6655 - RNA, 19 nt, artificial
  Chemically synthesized
cgccagcaccugcguucug

SEQ ID NO: 6656 - RNA, 19 nt, artificial
  Chemically synthesized
gcguuccgacaggcagcac

SEQ ID NO: 6657 - RNA, 19 nt, artificial
  Chemically synthesized
agucaccuuccuguaaaaa

SEQ ID NO: 6658 - RNA, 19 nt, artificial
  Chemically synthesized
gcagcacaccgccucguag

SEQ ID NO: 6659 - RNA, 19 nt, artificial
  Chemically synthesized
gccucguagcagccgcgca

SEQ ID NO: 6660 - RNA, 19 nt, artificial
  Chemically synthesized
ggauuuccaccuggcuaag

SEQ ID NO: 6661 - RNA, 19 nt, artificial
  Chemically synthesized
ccgggcucagcgccuucau

SEQ ID NO: 6662 - RNA, 19 nt, artificial
  Chemically synthesized
gaaagucaccuuccuguaa

SEQ ID NO: 6663 - RNA, 19 nt, artificial
  Chemically synthesized
gcacaccgccucguagcag

SEQ ID NO: 6664 - RNA, 19 nt, artificial
  Chemically synthesized
gacaggcagcacaccgccu

SEQ ID NO: 6665 - RNA, 19 nt, artificial
  Chemically synthesized
caggcagcacaccgccucg

SEQ ID NO: 6666 - RNA, 19 nt, artificial
  Chemically synthesized
aggcagcacaccgccucgu

SEQ ID NO: 6667 - RNA, 19 nt, artificial
  Chemically synthesized
caccgccucguagcagccg

SEQ ID NO: 6668 - RNA, 19 nt, artificial
  Chemically synthesized
gcaccgggcucagcgccuu

SEQ ID NO: 6669 - RNA, 19 nt, artificial
  Chemically synthesized
gggcgccagcaccugcguu

SEQ ID NO: 6670 - RNA, 19 nt, Artificial Sequence
  Chemically synthesized
ggcagcacaccgccucgua

SEQ ID NO: 6671 - RNA, 18 nt, artificial
  Chemically synthesized
ccugauuuaugaacucua

SEQ ID NO: 6672 - RNA, 18 nt, artificial
  Chemically synthesized
gugacuuucuguaacaau

SEQ ID NO: 6673 - RNA, 18 nt, artificial
  Chemically synthesized
ggcaggcucuauaaguga

SEQ ID NO: 6674 - RNA, 18 nt, artificial
  Chemically synthesized
ggaaggaguggcugcucu

SEQ ID NO: 6675 - RNA, 18 nt, artificial
  Chemically synthesized
aguucuaaggucucuuca

SEQ ID NO: 6676 - RNA, 18 nt, artificial
  Chemically synthesized
ggagaaagguucuguugc

SEQ ID NO: 6677 - RNA, 18 nt, artificial
  Chemically synthesized
ggcugcucuccaaacuau

SEQ ID NO: 6678 - RNA, 18 nt, artificial
  Chemically synthesized
ccacuugacuucaccaaa

SEQ ID NO: 6679 - RNA, 18 nt, artificial
  Chemically synthesized
guaacaaugcgauguaua

SEQ ID NO: 6680 - RNA, 18 nt, artificial
  Chemically synthesized
gggacuucuuuugguuuu

SEQ ID NO: 6681 - RNA, 18 nt, artificial
  Chemically synthesized
ggaacuugucaucuccaa

SEQ ID NO: 6682 - RNA, 18 nt, artificial
  Chemically synthesized
cuccggaacuugucaucu

SEQ ID NO: 6683 - RNA, 18 nt, artificial
  Chemically synthesized
gaaggacugugaacuugu

SEQ ID NO: 6684 - RNA, 18 nt, artificial
  Chemically synthesized
agcgcuuccucauucuuu

SEQ ID NO: 6685 - RNA, 18 nt, artificial
  Chemically synthesized
caaguucuaaggucucuu

SEQ ID NO: 6686 - RNA, 18 nt, artificial
  Chemically synthesized
ggugacuuucuguaacaa

SEQ ID NO: 6687 - RNA, 18 nt, artificial
  Chemically synthesized
cagggaagcucaaagauc

SEQ ID NO: 6688 - RNA, 18 nt, artificial
  Chemically synthesized
gaggaagccuguuugcaa

SEQ ID NO: 6689 - RNA, 18 nt, artificial
  Chemically synthesized
gcgucagaccagccggag

SEQ ID NO: 6690 - RNA, 18 nt, artificial
  Chemically synthesized
ggagcgaaggacugugaa

SEQ ID NO: 6691 - RNA, 18 nt, artificial
  Chemically synthesized
gaguggcugcucuccaaa

SEQ ID NO: 6692 - RNA, 18 nt, artificial
  Chemically synthesized
ugagcuugcuggacgaca

SEQ ID NO: 6693 - RNA, 18 nt, artificial
  Chemically synthesized
gcgucaucgacuacauuc

SEQ ID NO: 6694 - RNA, 18 nt, artificial
  Chemically synthesized
caggcaggcucuauaagu

SEQ ID NO: 6695 - RNA, 18 nt, artificial
  Chemically synthesized
cuggucuccuuggagaaa

SEQ ID NO: 6696 - RNA, 18 nt, artificial
  Chemically synthesized
gcgaaggacugugaacuu

SEQ ID NO: 6697 - RNA, 18 nt, artificial
  Chemically synthesized
cuuccucauucuuugaau

SEQ ID NO: 6698 - RNA, 18 nt, artificial
  Chemically synthesized
gcaugaaggcgcugagcc

SEQ ID NO: 6699 - RNA, 18 nt, artificial
  Chemically synthesized
ggaaguuaaugguuuuga

SEQ ID NO: 6700 - RNA, 18 nt, artificial
  Chemically synthesized
cacuugacuucaccaaau

SEQ ID NO: 6701 - RNA, 18 nt, artificial
  Chemically synthesized
gacuucuuuugguuuucu

SEQ ID NO: 6702 - RNA, 18 nt, artificial
  Chemically synthesized
cggcagagcuggucuucu

SEQ ID NO: 6703 - RNA, 18 nt, artificial
  Chemically synthesized
agcuuagccagguggaaa

SEQ ID NO: 6704 - RNA, 18 nt, artificial
  Chemically synthesized
cuguaacaaugcgaugua

SEQ ID NO: 6705 - RNA, 18 nt, artificial
  Chemically synthesized
ggcucuauaagugaccgc

SEQ ID NO: 6706 - RNA, 18 nt, artificial
  Chemically synthesized
gcuuccucauucuuugaa

SEQ ID NO: 6707 - RNA, 18 nt, artificial
  Chemically synthesized
gacuaaaccuggugcuca

SEQ ID NO: 6708 - RNA, 18 nt, artificial
  Chemically synthesized
cacuguagcgggacuucu

SEQ ID NO: 6709 - RNA, 18 nt, artificial
  Chemically synthesized
gagcuggucuucuggucu

SEQ ID NO: 6710 - RNA, 18 nt, artificial
  Chemically synthesized
gccggaagccggacggca

SEQ ID NO: 6711 - RNA, 18 nt, artificial
  Chemically synthesized
gccuguuugcaauuuaag

SEQ ID NO: 6712 - RNA, 18 nt, artificial
  Chemically synthesized
gucuccuuggagaaaggu

SEQ ID NO: 6713 - RNA, 18 nt, artificial
  Chemically synthesized
uggcugcucuccaaacua

SEQ ID NO: 6714 - RNA, 18 nt, artificial
  Chemically synthesized
gaaggugacuuucuguaa

SEQ ID NO: 6715 - RNA, 18 nt, artificial
  Chemically synthesized
ccaaguucuaaggucucu

SEQ ID NO: 6716 - RNA, 18 nt, artificial
  Chemically synthesized
cgaaggacugugaacuug

SEQ ID NO: 6717 - RNA, 18 nt, artificial
  Chemically synthesized
ggaagccuguuugcaauu

SEQ ID NO: 6718 - RNA, 18 nt, artificial
  Chemically synthesized
ggaacugguacccggagu

SEQ ID NO: 6719 - RNA, 18 nt, artificial
  Chemically synthesized
gcagggaagcucaaagau

SEQ ID NO: 6720 - RNA, 18 nt, artificial
  Chemically synthesized
ccugucggaacgcagucu

SEQ ID NO: 6721 - RNA, 18 nt, artificial
  Chemically synthesized
cgagaggcacucagcuua

SEQ ID NO: 6722 - RNA, 18 nt, artificial
  Chemically synthesized
cccaaguucuaaggucuc

SEQ ID NO: 6723 - RNA, 18 nt, artificial
  Chemically synthesized
uggucuccuuggagaaag

SEQ ID NO: 6724 - RNA, 18 nt, artificial
  Chemically synthesized
cccuuccuggagacuaaa

SEQ ID NO: 6725 - RNA, 18 nt, artificial
  Chemically synthesized
agcgcgucaucgacuaca

SEQ ID NO: 6726 - RNA, 18 nt, artificial
  Chemically synthesized
ggcagggaagcucaaaga

SEQ ID NO: 6727 - RNA, 18 nt, artificial
  Chemically synthesized
caggaaaaagcaaauucu

SEQ ID NO: 6728 - RNA, 18 nt, artificial
  Chemically synthesized
agcucacuccggaacuug

SEQ ID NO: 6729 - RNA, 18 nt, artificial
  Chemically synthesized
ggucuucuggucuccuug

SEQ ID NO: 6730 - RNA, 18 nt, artificial
  Chemically synthesized
cuccuuggagaaagguuc

SEQ ID NO: 6731 - RNA, 18 nt, artificial
  Chemically synthesized
cgacaugaaccacugcua

SEQ ID NO: 6732 - RNA, 18 nt, artificial
  Chemically synthesized
ggacgacaugaaccacug

SEQ ID NO: 6733 - RNA, 18 nt, artificial
  Chemically synthesized
cgucaucgacuacauucu

SEQ ID NO: 6734 - RNA, 18 nt, artificial
  Chemically synthesized
cacuccggaacuugucau

SEQ ID NO: 6735 - RNA, 18 nt, artificial
  Chemically synthesized
caaaucccuuccuggaga

SEQ ID NO: 6736 - RNA, 18 nt, artificial
  Chemically synthesized
ccagcaugaaggcgcuga

SEQ ID NO: 6737 - RNA, 18 nt, artificial
  Chemically synthesized
cgggacuucuuuugguuu

SEQ ID NO: 6738 - RNA, 18 nt, artificial
  Chemically synthesized
gguucuguugcccugauu

SEQ ID NO: 6739 - RNA, 18 nt, artificial
  Chemically synthesized
agcgaaggacugugaacu

SEQ ID NO: 6740 - RNA, 18 nt, artificial
  Chemically synthesized
caccuucccauccagaca

SEQ ID NO: 6741 - RNA, 18 nt, artificial
  Chemically synthesized
ggccauuuugaauaaaga

SEQ ID NO: 6742 - RNA, 18 nt, artificial
  Chemically synthesized
gccggaggaagccuguuu

SEQ ID NO: 6743 - RNA, 18 nt, artificial
  Chemically synthesized
ggcacucagcuuagccag

SEQ ID NO: 6744 - RNA, 18 nt, artificial
  Chemically synthesized
cgcgucaucgacuacauu

SEQ ID NO: 6745 - RNA, 18 nt, artificial
  Chemically synthesized
gcucacuccggaacuugu

SEQ ID NO: 6746 - RNA, 18 nt, artificial
  Chemically synthesized
uggacgacaugaaccacu

SEQ ID NO: 6747 - RNA, 18 nt, artificial
  Chemically synthesized
cgagcucacuccggaacu

SEQ ID NO: 6748 - RNA, 18 nt, artificial
  Chemically synthesized
agggaagcucaaagaucu

SEQ ID NO: 6749 - RNA, 18 nt, artificial
  Chemically synthesized
gguaucagcgcuuccuca

SEQ ID NO: 6750 - RNA, 18 nt, artificial
  Chemically synthesized
aauccuugcuggcggaga

SEQ ID NO: 6751 - RNA, 18 nt, artificial
  Chemically synthesized
acaggaaggugacuuucu

SEQ ID NO: 6752 - RNA, 18 nt, artificial
  Chemically synthesized
ugguuuucuuucucuuug

SEQ ID NO: 6753 - RNA, 18 nt, artificial
  Chemically synthesized
gggcaccucuggacucac

SEQ ID NO: 6754 - RNA, 18 nt, artificial
  Chemically synthesized
guggagguguggaaggag

SEQ ID NO: 6755 - RNA, 18 nt, artificial
  Chemically synthesized
ggccgaggcgggccauuu

SEQ ID NO: 6756 - RNA, 18 nt, artificial
  Chemically synthesized
cggagucccgagaggcac

SEQ ID NO: 6757 - RNA, 18 nt, artificial
  Chemically synthesized
cacuuguguauaugauga

SEQ ID NO: 6758 - RNA, 18 nt, artificial
  Chemically synthesized
ggugcuggcgcccguucu

SEQ ID NO: 6759 - RNA, 18 nt, artificial
  Chemically synthesized
ggcgucagaccagccgga

SEQ ID NO: 6760 - RNA, 18 nt, artificial
  Chemically synthesized
cacucagcuuagccaggu

SEQ ID NO: 6761 - RNA, 18 nt, artificial
  Chemically synthesized
gcaaauucuggaaguuaa

SEQ ID NO: 6762 - RNA, 18 nt, artificial
  Chemically synthesized
cccaccuucccauccaga

SEQ ID NO: 6763 - RNA, 18 nt, artificial
  Chemically synthesized
ccucauucuuugaauccg

SEQ ID NO: 6764 - RNA, 18 nt, artificial
  Chemically synthesized
cuuggagaaagguucugu

SEQ ID NO: 6765 - RNA, 18 nt, artificial
  Chemically synthesized
gggaacugguacccggag

SEQ ID NO: 6766 - RNA, 18 nt, artificial
  Chemically synthesized
cuuucuguaacaaugcga

SEQ ID NO: 6767 - RNA, 18 nt, artificial
  Chemically synthesized
gggugcugccaggaaaaa

SEQ ID NO: 6768 - RNA, 18 nt, artificial
  Chemically synthesized
ccaggcaggcucuauaag

SEQ ID NO: 6769 - RNA, 18 nt, artificial
  Chemically synthesized
cuccaacgacaaaaggag

SEQ ID NO: 6770 - RNA, 18 nt, artificial
  Chemically synthesized
ccugaagagccagagcua

SEQ ID NO: 6771 - RNA, 18 nt, artificial
  Chemically synthesized
ggacuucuuuugguuuuc

SEQ ID NO: 6772 - RNA, 18 nt, artificial
  Chemically synthesized
gccaggaaaaagcaaauu

SEQ ID NO: 6773 - RNA, 18 nt, artificial
  Chemically synthesized
gcucaggagcgaaggacu

SEQ ID NO: 6774 - RNA, 18 nt, artificial
  Chemically synthesized
guguggaaggaguggcug

SEQ ID NO: 6775 - RNA, 18 nt, artificial
  Chemically synthesized
ggagcuuuugccacugac

SEQ ID NO: 6776 - RNA, 18 nt, artificial
  Chemically synthesized
gucucuucagagcgugga

SEQ ID NO: 6777 - RNA, 18 nt, artificial
  Chemically synthesized
uucuaaggucucuucaga

SEQ ID NO: 6778 - RNA, 18 nt, artificial
  Chemically synthesized
guaucagcgcuuccucau

SEQ ID NO: 6779 - RNA, 18 nt, artificial
  Chemically synthesized
guacccggagucccgaga

SEQ ID NO: 6780 - RNA, 18 nt, artificial
  Chemically synthesized
ucuccuuggagaaagguu

SEQ ID NO: 6781 - RNA, 18 nt, artificial
  Chemically synthesized
ucaucuccaacgacaaaa

SEQ ID NO: 6782 - RNA, 18 nt, artificial
  Chemically synthesized
ggagacuaaaccuggugc

SEQ ID NO: 6783 - RNA, 18 nt, artificial
  Chemically synthesized
gcugcucuccaaacuaug

SEQ ID NO: 6784 - RNA, 18 nt, artificial
  Chemically synthesized
cucuauaagugaccgccg

SEQ ID NO: 6785 - RNA, 18 nt, artificial
  Chemically synthesized
gagcuugcuggacgacau

SEQ ID NO: 6786 - RNA, 18 nt, artificial
  Chemically synthesized
ccaggaaaaagcaaauuc

SEQ ID NO: 6787 - RNA, 18 nt, artificial
  Chemically synthesized
cggucuucggcgucagac

SEQ ID NO: 6788 - RNA, 18 nt, artificial
  Chemically synthesized
guaccuuuuuuacaggaa

SEQ ID NO: 6789 - RNA, 18 nt, artificial
  Chemically synthesized
cuugcuggacgacaugaa

SEQ ID NO: 6790 - RNA, 18 nt, artificial
  Chemically synthesized
gacuucaccaaaucccuu

SEQ ID NO: 6791 - RNA, 18 nt, artificial
  Chemically synthesized
ucuaaggucucuucagag

SEQ ID NO: 6792 - RNA, 18 nt, artificial
  Chemically synthesized
gcuaaaggcggacuggca

SEQ ID NO: 6793 - RNA, 18 nt, artificial
  Chemically synthesized
ccugacaccuccagaacg

SEQ ID NO: 6794 - RNA, 18 nt, artificial
  Chemically synthesized
gacaugaaccacugcuac

SEQ ID NO: 6795 - RNA, 18 nt, artificial
  Chemically synthesized
cgacuacauucucgaccu

SEQ ID NO: 6796 - RNA, 18 nt, artificial
  Chemically synthesized
gcaccucuggacucacuc

SEQ ID NO: 6797 - RNA, 18 nt, artificial
  Chemically synthesized
caucgacuacauucucga

SEQ ID NO: 6798 - RNA, 18 nt, artificial
  Chemically synthesized
guauauagguuuuguacc

SEQ ID NO: 6799 - RNA, 18 nt, artificial
  Chemically synthesized
gucggaacgcagucuggc

SEQ ID NO: 6800 - RNA, 18 nt, artificial
  Chemically synthesized
agccuguuugcaauuuaa

SEQ ID NO: 6801 - RNA, 18 nt, artificial
  Chemically synthesized
gaacuuguggccugaaga

SEQ ID NO: 6802 - RNA, 18 nt, artificial
  Chemically synthesized
cuacauucucgaccugca

SEQ ID NO: 6803 - RNA, 18 nt, artificial
  Chemically synthesized
gaacuugucaucuccaac

SEQ ID NO: 6804 - RNA, 18 nt, artificial
  Chemically synthesized
uggucuucuggucuccuu

SEQ ID NO: 6805 - RNA, 18 nt, artificial
  Chemically synthesized
gacuuucuguaacaaugc

SEQ ID NO: 6806 - RNA, 18 nt, artificial
  Chemically synthesized
ucuggaaguuaaugguuu

SEQ ID NO: 6807 - RNA, 18 nt, artificial
  Chemically synthesized
gguuuucuuucucuuugg

SEQ ID NO: 6808 - RNA, 18 nt, artificial
  Chemically synthesized
ggugcugccaggaaaaag

SEQ ID NO: 6809 - RNA, 18 nt, artificial
  Chemically synthesized
ggcaccucuggacucacu

SEQ ID NO: 6810 - RNA, 18 nt, artificial
  Chemically synthesized
gcuggacgacaugaacca

SEQ ID NO: 6811 - RNA, 18 nt, artificial
  Chemically synthesized
gcguugcaggucacugua

SEQ ID NO: 6812 - RNA, 18 nt, artificial
  Chemically synthesized
aggcacucagcuuagcca

SEQ ID NO: 6813 - RNA, 18 nt, artificial
  Chemically synthesized
cuguagcgggacuucuuu

SEQ ID NO: 6814 - RNA, 18 nt, artificial
  Chemically synthesized
gagcucacuccggaacuu

SEQ ID NO: 6815 - RNA, 18 nt, artificial
  Chemically synthesized
gugugcugccugucggaa

SEQ ID NO: 6816 - RNA, 18 nt, artificial
  Chemically synthesized
cgaccugcagguaguccu

SEQ ID NO: 6817 - RNA, 18 nt, artificial
  Chemically synthesized
gcgcgucaucgacuacau

SEQ ID NO: 6818 - RNA, 18 nt, artificial
  Chemically synthesized
ccuggagacuaaaccugg

SEQ ID NO: 6819 - RNA, 18 nt, artificial
  Chemically synthesized
gugcgcggcugcuacgag

SEQ ID NO: 6820 - RNA, 18 nt, artificial
  Chemically synthesized
gagcgaaggacugugaac

SEQ ID NO: 6821 - RNA, 18 nt, artificial
  Chemically synthesized
ggagguguggaaggagug

SEQ ID NO: 6822 - RNA, 18 nt, artificial
  Chemically synthesized
gccugucggaacgcaguc

SEQ ID NO: 6823 - RNA, 18 nt, artificial
  Chemically synthesized
cagaccagccggaggaag

SEQ ID NO: 6824 - RNA, 18 nt, artificial
  Chemically synthesized
uccggaacuugucaucuc

SEQ ID NO: 6825 - RNA, 18 nt, artificial
  Chemically synthesized
ccggagucccgagaggca

SEQ ID NO: 6826 - RNA, 18 nt, artificial
  Chemically synthesized
gucuucggcgucagacca

SEQ ID NO: 6827 - RNA, 18 nt, artificial
  Chemically synthesized
caacgacaaaaggagcuu

SEQ ID NO: 6828 - RNA, 18 nt, artificial
  Chemically synthesized
gcucuauaagugaccgcc

SEQ ID NO: 6829 - RNA, 18 nt, artificial
  Chemically synthesized
gcaggcucuauaagugac

SEQ ID NO: 6830 - RNA, 18 nt, artificial
  Chemically synthesized
ccuuccaggcaggcucua

SEQ ID NO: 6831 - RNA, 18 nt, artificial
  Chemically synthesized
gccguguccugacaccuc

SEQ ID NO: 6832 - RNA, 18 nt, artificial
  Chemically synthesized
gcgcguugcaggucacug

SEQ ID NO: 6833 - RNA, 18 nt, artificial
  Chemically synthesized
ggacugugaacuuguggc

SEQ ID NO: 6834 - RNA, 18 nt, artificial
  Chemically synthesized
cugucggaacgcagucug

SEQ ID NO: 6835 - RNA, 18 nt, artificial
  Chemically synthesized
gguguggaaggaguggcu

SEQ ID NO: 6836 - RNA, 18 nt, artificial
  Chemically synthesized
cagcgcuuccucauucuu

SEQ ID NO: 6837 - RNA, 18 nt, artificial
  Chemically synthesized
gguggaaauccuacagcg

SEQ ID NO: 6838 - RNA, 18 nt, artificial
  Chemically synthesized
ccuccagaacgcaggugc

SEQ ID NO: 6839 - RNA, 18 nt, artificial
  Chemically synthesized
ggugcgcggcugcuacga

SEQ ID NO: 6840 - RNA, 18 nt, artificial
  Chemically synthesized
ggccguguccugacaccu

SEQ ID NO: 6841 - RNA, 18 nt, artificial
  Chemically synthesized
gucaucgacuacauucuc

SEQ ID NO: 6842 - RNA, 18 nt, artificial
  Chemically synthesized
agagccagagcuagcucu

SEQ ID NO: 6843 - RNA, 18 nt, artificial
  Chemically synthesized
cuggucuucuggucuccu

SEQ ID NO: 6844 - RNA, 18 nt, artificial
  Chemically synthesized
ccuacagcgcgucaucga

SEQ ID NO: 6845 - RNA, 18 nt, artificial
  Chemically synthesized
uggagguguggaaggagu

SEQ ID NO: 6846 - RNA, 18 nt, artificial
  Chemically synthesized
ggaacgcagucuggccau

SEQ ID NO: 6847 - RNA, 18 nt, artificial
  Chemically synthesized
cauccagacagccgagcu

SEQ ID NO: 6848 - RNA, 18 nt, artificial
  Chemically synthesized
uggagaaagguucuguug

SEQ ID NO: 6849 - RNA, 18 nt, artificial
  Chemically synthesized
ugacuuucuguaacaaug

SEQ ID NO: 6850 - RNA, 18 nt, artificial
  Chemically synthesized
ccuguuugcaauuuaagc

SEQ ID NO: 6851 - RNA, 18 nt, artificial
  Chemically synthesized
gagacuaaaccuggugcu

SEQ ID NO: 6852 - RNA, 18 nt, artificial
  Chemically synthesized
ucuccaacgacaaaagga

SEQ ID NO: 6853 - RNA, 18 nt, artificial
  Chemically synthesized
cugccaggaaaaagcaaa

SEQ ID NO: 6854 - RNA, 18 nt, artificial
  Chemically synthesized
gccgagcucacuccggaa

SEQ ID NO: 6855 - RNA, 18 nt, artificial
  Chemically synthesized
ugcucaggagcgaaggac

SEQ ID NO: 6856 - RNA, 18 nt, artificial
  Chemically synthesized
guccugacaccuccagaa

SEQ ID NO: 6857 - RNA, 18 nt, artificial
  Chemically synthesized
ccuuccuggagacuaaac

SEQ ID NO: 6858 - RNA, 18 nt, artificial
  Chemically synthesized
ccgcugagcuugcuggac

SEQ ID NO: 6859 - RNA, 18 nt, artificial
  Chemically synthesized
ggcgugccuuccaggcag

SEQ ID NO: 6860 - RNA, 18 nt, artificial
  Chemically synthesized
uccagacagccgagcuca

SEQ ID NO: 6861 - RNA, 18 nt, artificial
  Chemically synthesized
ugugcugccugucggaac

SEQ ID NO: 6862 - RNA, 18 nt, artificial
  Chemically synthesized
gcugccugucggaacgca

SEQ ID NO: 6863 - RNA, 18 nt, artificial
  Chemically synthesized
aguggcugcucuccaaac

SEQ ID NO: 6864 - RNA, 18 nt, artificial
  Chemically synthesized
gccauuuugaauaaagag

SEQ ID NO: 6865 - RNA, 18 nt, artificial
  Chemically synthesized
acaugaaccacugcuacu

SEQ ID NO: 6866 - RNA, 18 nt, artificial
  Chemically synthesized
gcaauuuaagcgggcugu

SEQ ID NO: 6867 - RNA, 18 nt, artificial
  Chemically synthesized
gacaccuccagaacgcag

SEQ ID NO: 6868 - RNA, 18 nt, artificial
  Chemically synthesized
ccuuggagaaagguucug

SEQ ID NO: 6869 - RNA, 18 nt, artificial
  Chemically synthesized
caaacuaugccaaggcgg

SEQ ID NO: 6870 - RNA, 18 nt, artificial
  Chemically synthesized
cuuuugguuuucuuucuc

SEQ ID NO: 6871 - RNA, 18 nt, artificial
  Chemically synthesized
cgggccauuuugaauaaa

SEQ ID NO: 6872 - RNA, 18 nt, artificial
  Chemically synthesized
aggaagccuguuugcaau

SEQ ID NO: 6873 - RNA, 18 nt, artificial
  Chemically synthesized
gcuuagccagguggaaau

SEQ ID NO: 6874 - RNA, 18 nt, artificial
  Chemically synthesized
guggaaggaguggcugcu

SEQ ID NO: 6875 - RNA, 18 nt, artificial
  Chemically synthesized
ggcagagcuggucuucug

SEQ ID NO: 6876 - RNA, 18 nt, artificial
  Chemically synthesized
cuuccuggagacuaaacc

SEQ ID NO: 6877 - RNA, 18 nt, artificial
  Chemically synthesized
guuaaugguuuugaguga

SEQ ID NO: 6878 - RNA, 18 nt, artificial
  Chemically synthesized
agguguggaaggaguggc

SEQ ID NO: 6879 - RNA, 18 nt, artificial
  Chemically synthesized
cagacagccgagcucacu

SEQ ID NO: 6880 - RNA, 18 nt, artificial
  Chemically synthesized
caggcucuauaagugacc

SEQ ID NO: 6881 - RNA, 18 nt, artificial
  Chemically synthesized
ggaagcucaaagaucugg

SEQ ID NO: 6882 - RNA, 18 nt, artificial
  Chemically synthesized
cucuccaaacuaugccaa

SEQ ID NO: 6883 - RNA, 18 nt, artificial
  Chemically synthesized
ccuuuuuuacaggaaggu

SEQ ID NO: 6884 - RNA, 18 nt, artificial
  Chemically synthesized
gggccgaggcgggccauu

SEQ ID NO: 6885 - RNA, 18 nt, artificial
  Chemically synthesized
ccgagcucacuccggaac

SEQ ID NO: 6886 - RNA, 18 nt, artificial
  Chemically synthesized
ccaacuucgcccugccca

SEQ ID NO: 6887 - RNA, 18 nt, artificial
  Chemically synthesized
gggcgacgucacccugcu

SEQ ID NO: 6888 - RNA, 18 nt, artificial
  Chemically synthesized
ccaccagcugggcgacgu

SEQ ID NO: 6889 - RNA, 18 nt, artificial
  Chemically synthesized
ucccauccagacagccga

SEQ ID NO: 6890 - RNA, 18 nt, artificial
  Chemically synthesized
cugaagagccagagcuag

SEQ ID NO: 6891 - RNA, 18 nt, artificial
  Chemically synthesized
gcccugauuuaugaacuc

SEQ ID NO: 6892 - RNA, 18 nt, artificial
  Chemically synthesized
gcggcugcuacgaggcgg

SEQ ID NO: 6893 - RNA, 18 nt, artificial
  Chemically synthesized
cagagcuggucuucuggu

SEQ ID NO: 6894 - RNA, 18 nt, artificial
  Chemically synthesized
cggcggcagagcuggucu

SEQ ID NO: 6895 - RNA, 18 nt, artificial
  Chemically synthesized
agcuggucuucuggucuc

SEQ ID NO: 6896 - RNA, 18 nt, artificial
  Chemically synthesized
agccagguggaaauccua

SEQ ID NO: 6897 - RNA, 18 nt, artificial
  Chemically synthesized
gagaggcacucagcuuag

SEQ ID NO: 6898 - RNA, 18 nt, artificial
  Chemically synthesized
agacagccgagcucacuc

SEQ ID NO: 6899 - RNA, 18 nt, artificial
  Chemically synthesized
cuaaggucucuucagagc

SEQ ID NO: 6900 - RNA, 18 nt, artificial
  Chemically synthesized
cgacaaaaggagcuuuug

SEQ ID NO: 6901 - RNA, 18 nt, artificial
  Chemically synthesized
ccauccagacagccgagc

SEQ ID NO: 6902 - RNA, 18 nt, artificial
  Chemically synthesized
cuggacgacaugaaccac

SEQ ID NO: 6903 - RNA, 18 nt, artificial
  Chemically synthesized
uguuugcaauuuaagcgg

SEQ ID NO: 6904 - RNA, 18 nt, artificial
  Chemically synthesized
gaacgcaggugcuggcgc

SEQ ID NO: 6905 - RNA, 18 nt, artificial
  Chemically synthesized
ggcggcagagcuggucuu

SEQ ID NO: 6906 - RNA, 18 nt, artificial
  Chemically synthesized
gcugcuacgaggcggugu

SEQ ID NO: 6907 - RNA, 18 nt, artificial
  Chemically synthesized
ccagcugggcgacgucac

SEQ ID NO: 6908 - RNA, 18 nt, artificial
  Chemically synthesized
agcgggacuucuuuuggu

SEQ ID NO: 6909 - RNA, 18 nt, artificial
  Chemically synthesized
uggaaggaguggcugcuc

SEQ ID NO: 6910 - RNA, 18 nt, artificial
  Chemically synthesized
gccugcgggaacugguac

SEQ ID NO: 6911 - RNA, 18 nt, artificial
  Chemically synthesized
gaaagguucuguugcccu

SEQ ID NO: 6912 - RNA, 18 nt, artificial
  Chemically synthesized
gugaacuuguggccugaa

SEQ ID NO: 6913 - RNA, 18 nt, artificial
  Chemically synthesized
cccgagaggcacucagcu

SEQ ID NO: 6914 - RNA, 18 nt, artificial
  Chemically synthesized
agguggaaauccuacagc

SEQ ID NO: 6915 - RNA, 18 nt, artificial
  Chemically synthesized
cauucuuugaauccgcgg

SEQ ID NO: 6916 - RNA, 18 nt, artificial
  Chemically synthesized
ccggaggaagccuguuug

SEQ ID NO: 6917 - RNA, 18 nt, artificial
  Chemically synthesized
cgcccugcccacuugacu

SEQ ID NO: 6918 - RNA, 18 nt, artificial
  Chemically synthesized
gaaccucuccugccggaa

SEQ ID NO: 6919 - RNA, 18 nt, artificial
  Chemically synthesized
ggagccgcugagcuugcu

SEQ ID NO: 6920 - RNA, 18 nt, artificial
  Chemically synthesized
gaaggaguggcugcucuc

SEQ ID NO: 6921 - RNA, 18 nt, artificial
  Chemically synthesized
cagcaugaaggcgcugag

SEQ ID NO: 6922 - RNA, 18 nt, artificial
  Chemically synthesized
gacaaaaggagcuuuugc

SEQ ID NO: 6923 - RNA, 18 nt, artificial
  Chemically synthesized
ggaaauccuacagcgcgu

SEQ ID NO: 6924 - RNA, 18 nt, artificial
  Chemically synthesized
aggucacuguagcgggac

SEQ ID NO: 6925 - RNA, 18 nt, artificial
  Chemically synthesized
cuguuugcaauuuaagcg

SEQ ID NO: 6926 - RNA, 18 nt, artificial
  Chemically synthesized
ugcccugauuuaugaacu

SEQ ID NO: 6927 - RNA, 18 nt, artificial
  Chemically synthesized
caugaaccacugcuacuc

SEQ ID NO: 6928 - RNA, 18 nt, artificial
  Chemically synthesized
gcccugcccacuugacuu

SEQ ID NO: 6929 - RNA, 18 nt, artificial
  Chemically synthesized
acuugacuucaccaaauc

SEQ ID NO: 6930 - RNA, 18 nt, artificial
  Chemically synthesized
cucuccugccggaagccg

SEQ ID NO: 6931 - RNA, 18 nt, artificial
  Chemically synthesized
gggaagcucaaagaucug

SEQ ID NO: 6932 - RNA, 18 nt, artificial
  Chemically synthesized
gaagccggacggcaggga

SEQ ID NO: 6933 - RNA, 18 nt, artificial
  Chemically synthesized
gagccgcugagcuugcug

SEQ ID NO: 6934 - RNA, 18 nt, artificial
  Chemically synthesized
cuaaaggcggacuggcag

SEQ ID NO: 6935 - RNA, 18 nt, artificial
  Chemically synthesized
cguggagguguggaagga

SEQ ID NO: 6936 - RNA, 18 nt, artificial
  Chemically synthesized
ggagucccgagaggcacu

SEQ ID NO: 6937 - RNA, 18 nt, artificial
  Chemically synthesized
ugcgcgcguugcagguca

SEQ ID NO: 6938 - RNA, 18 nt, artificial
  Chemically synthesized
caggaaggugacuuucug

SEQ ID NO: 6939 - RNA, 18 nt, artificial
  Chemically synthesized
caugaaggcgcugagccc

SEQ ID NO: 6940 - RNA, 18 nt, artificial
  Chemically synthesized
aaagcaaauucuggaagu

SEQ ID NO: 6941 - RNA, 18 nt, artificial
  Chemically synthesized
ucgacuacauucucgacc

SEQ ID NO: 6942 - RNA, 18 nt, artificial
  Chemically synthesized
ccagaacgcaggugcugg

SEQ ID NO: 6943 - RNA, 18 nt, artificial
  Chemically synthesized
cguugcaggucacuguag

SEQ ID NO: 6944 - RNA, 18 nt, artificial
  Chemically synthesized
acuugucaucuccaacga

SEQ ID NO: 6945 - RNA, 18 nt, artificial
  Chemically synthesized
aggucucuucagagcgug

SEQ ID NO: 6946 - RNA, 18 nt, artificial
  Chemically synthesized
gcuacgaggcggugugcu

SEQ ID NO: 6947 - RNA, 18 nt, artificial
  Chemically synthesized
agcuuuugccacugacuc

SEQ ID NO: 6948 - RNA, 18 nt, artificial
  Chemically synthesized
ccuugcuggcggagaggc

SEQ ID NO: 6949 - RNA, 18 nt, artificial
  Chemically synthesized
aggcgugccuuccaggca

SEQ ID NO: 6950 - RNA, 18 nt, artificial
  Chemically synthesized
acgucacccugcucccac

SEQ ID NO: 6951 - RNA, 18 nt, artificial
  Chemically synthesized
gccgcugagcuugcugga

SEQ ID NO: 6952 - RNA, 18 nt, artificial
  Chemically synthesized
gcgggacuucuuuugguu

SEQ ID NO: 6953 - RNA, 18 nt, artificial
  Chemically synthesized
ccgcggucuucggcguca

SEQ ID NO: 6954 - RNA, 18 nt, artificial
  Chemically synthesized
gugccuuccaggcaggcu

SEQ ID NO: 6955 - RNA, 18 nt, artificial
  Chemically synthesized
accagcugggcgacguca

SEQ ID NO: 6956 - RNA, 18 nt, artificial
  Chemically synthesized
aggcucuauaagugaccg

SEQ ID NO: 6957 - RNA, 18 nt, artificial
  Chemically synthesized
ccgguaucagcgcuuccu

SEQ ID NO: 6958 - RNA, 18 nt, artificial
  Chemically synthesized
ccggaagccggacggcag

SEQ ID NO: 6959 - RNA, 18 nt, artificial
  Chemically synthesized
agguucuguugcccugau

SEQ ID NO: 6960 - RNA, 18 nt, artificial
  Chemically synthesized
ggucacuguagcgggacu

SEQ ID NO: 6961 - RNA, 18 nt, artificial
  Chemically synthesized
cugaggagccgcugagcu

SEQ ID NO: 6962 - RNA, 18 nt, artificial
  Chemically synthesized
ggccugaagagccagagc

SEQ ID NO: 6963 - RNA, 18 nt, artificial
  Chemically synthesized
ccugcccacuugacuuca

SEQ ID NO: 6964 - RNA, 18 nt, artificial
  Chemically synthesized
cggaacgcagucuggcca

SEQ ID NO: 6965 - RNA, 18 nt, artificial
  Chemically synthesized
gcagguaguccuggccga

SEQ ID NO: 6966 - RNA, 18 nt, artificial
  Chemically synthesized
ccagguggaaauccuaca

SEQ ID NO: 6967 - RNA, 18 nt, artificial
  Chemically synthesized
ggucuccuuggagaaagg

SEQ ID NO: 6968 - RNA, 18 nt, artificial
  Chemically synthesized
uucucgaccugcagguag

SEQ ID NO: 6969 - RNA, 18 nt, artificial
  Chemically synthesized
gucccgagaggcacucag

SEQ ID NO: 6970 - RNA, 18 nt, artificial
  Chemically synthesized
acgacaaaaggagcuuuu

SEQ ID NO: 6971 - RNA, 18 nt, artificial
  Chemically synthesized
cagcugaggagccgcuga

SEQ ID NO: 6972 - RNA, 18 nt, artificial
  Chemically synthesized
gacgacaugaaccacugc

SEQ ID NO: 6973 - RNA, 18 nt, artificial
  Chemically synthesized
ggcgagcgugcgcgcguu

SEQ ID NO: 6974 - RNA, 18 nt, artificial
  Chemically synthesized
cugccugucggaacgcag

SEQ ID NO: 6975 - RNA, 18 nt, artificial
  Chemically synthesized
gagguguggaaggagugg

SEQ ID NO: 6976 - RNA, 18 nt, artificial
  Chemically synthesized
cuugacuucaccaaaucc

SEQ ID NO: 6977 - RNA, 18 nt, artificial
  Chemically synthesized
auuuaagcgggcugugaa

SEQ ID NO: 6978 - RNA, 18 nt, artificial
  Chemically synthesized
gagcuuuugccacugacu

SEQ ID NO: 6979 - RNA, 18 nt, artificial
  Chemically synthesized
aggaaaaagcaaauucug

SEQ ID NO: 6980 - RNA, 18 nt, artificial
  Chemically synthesized
cccggugcgcggcugcua

SEQ ID NO: 6981 - RNA, 18 nt, artificial
  Chemically synthesized
cuggagacuaaaccuggu

SEQ ID NO: 6982 - RNA, 18 nt, artificial
  Chemically synthesized
ccaacgacaaaaggagcu

SEQ ID NO: 6983 - RNA, 18 nt, artificial
  Chemically synthesized
accaaaucccuuccugga

SEQ ID NO: 6984 - RNA, 18 nt, artificial
  Chemically synthesized
gcugagcuugcuggacga

SEQ ID NO: 6985 - RNA, 18 nt, artificial
  Chemically synthesized
gucacuguagcgggacuu

SEQ ID NO: 6986 - RNA, 18 nt, artificial
  Chemically synthesized
cgccugcgggaacuggua

SEQ ID NO: 6987 - RNA, 18 nt, artificial
  Chemically synthesized
gcccguucugccugggac

SEQ ID NO: 6988 - RNA, 18 nt, artificial
  Chemically synthesized
accuucccauccagacag

SEQ ID NO: 6989 - RNA, 18 nt, artificial
  Chemically synthesized
aacgacaaaaggagcuuu

SEQ ID NO: 6990 - RNA, 18 nt, artificial
  Chemically synthesized
gagcgugcgcgcguugca

SEQ ID NO: 6991 - RNA, 18 nt, artificial
  Chemically synthesized
uccuuggagaaagguucu

SEQ ID NO: 6992 - RNA, 18 nt, artificial
  Chemically synthesized
uaaggucucuucagagcg

SEQ ID NO: 6993 - RNA, 18 nt, artificial
  Chemically synthesized
gcggagaggcccgccucu

SEQ ID NO: 6994 - RNA, 18 nt, artificial
  Chemically synthesized
uccugacaccuccagaac

SEQ ID NO: 6995 - RNA, 18 nt, artificial
  Chemically synthesized
cuucccauccagacagcc

SEQ ID NO: 6996 - RNA, 18 nt, artificial
  Chemically synthesized
gaaguuaaugguuuugag

SEQ ID NO: 6997 - RNA, 18 nt, artificial
  Chemically synthesized
ugaggagccgcugagcuu

SEQ ID NO: 6998 - RNA, 18 nt, artificial
  Chemically synthesized
cucauucuuugaauccgc

SEQ ID NO: 6999 - RNA, 18 nt, artificial
  Chemically synthesized
aucagcgcuuccucauuc

SEQ ID NO: 7000 - RNA, 18 nt, artificial
  Chemically synthesized
gaagcucaaagaucuggg

SEQ ID NO: 7001 - RNA, 18 nt, artificial
  Chemically synthesized
gagcguggagguguggaa

SEQ ID NO: 7002 - RNA, 18 nt, artificial
  Chemically synthesized
cuggugcucaggagcgaa

SEQ ID NO: 7003 - RNA, 18 nt, artificial
  Chemically synthesized
gcugggcgacgucacccu

SEQ ID NO: 7004 - RNA, 18 nt, artificial
  Chemically synthesized
acugugaacuuguggccu

SEQ ID NO: 7005 - RNA, 18 nt, artificial
  Chemically synthesized
aaggucucuucagagcgu

SEQ ID NO: 7006 - RNA, 18 nt, artificial
  Chemically synthesized
agcaugaaggcgcugagc

SEQ ID NO: 7007 - RNA, 18 nt, artificial
  Chemically synthesized
ugacuucaccaaaucccu

SEQ ID NO: 7008 - RNA, 18 nt, artificial
  Chemically synthesized
aaaagcaaauucuggaag

SEQ ID NO: 7009 - RNA, 18 nt, artificial
  Chemically synthesized
ugccugucggaacgcagu

SEQ ID NO: 7010 - RNA, 18 nt, artificial
  Chemically synthesized
aauccuacagcgcgucau

SEQ ID NO: 7011 - RNA, 18 nt, artificial
  Chemically synthesized
cccauccagacagccgag

SEQ ID NO: 7012 - RNA, 18 nt, artificial
  Chemically synthesized
uagaguucauaaaucagg

SEQ ID NO: 7013 - RNA, 18 nt, artificial
  Chemically synthesized
auuguuacagaaagucac

SEQ ID NO: 7014 - RNA, 18 nt, artificial
  Chemically synthesized
ucacuuauagagccugcc

SEQ ID NO: 7015 - RNA, 18 nt, artificial
  Chemically synthesized
agagcagccacuccuucc

SEQ ID NO: 7016 - RNA, 18 nt, artificial
  Chemically synthesized
ugaagagaccuuagaacu

SEQ ID NO: 7017 - RNA, 18 nt, artificial
  Chemically synthesized
gcaacagaaccuuucucc

SEQ ID NO: 7018 - RNA, 18 nt, artificial
  Chemically synthesized
auaguuuggagagcagcc

SEQ ID NO: 7019 - RNA, 18 nt, artificial
  Chemically synthesized
uuuggugaagucaagugg

SEQ ID NO: 7020 - RNA, 18 nt, artificial
  Chemically synthesized
uauacaucgcauuguuac

SEQ ID NO: 7021 - RNA, 18 nt, artificial
  Chemically synthesized
aaaaccaaaagaaguccc

SEQ ID NO: 7022 - RNA, 18 nt, artificial
  Chemically synthesized
uuggagaugacaaguucc

SEQ ID NO: 7023 - RNA, 18 nt, artificial
  Chemically synthesized
agaugacaaguuccggag

SEQ ID NO: 7024 - RNA, 18 nt, artificial
  Chemically synthesized
acaaguucacaguccuuc

SEQ ID NO: 7025 - RNA, 18 nt, artificial
  Chemically synthesized
aaagaaugaggaagcgcu

SEQ ID NO: 7026 - RNA, 18 nt, artificial
  Chemically synthesized
aagagaccuuagaacuug

SEQ ID NO: 7027 - RNA, 18 nt, artificial
  Chemically synthesized
uuguuacagaaagucacc

SEQ ID NO: 7028 - RNA, 18 nt, artificial
  Chemically synthesized
gaucuuugagcuucccug

SEQ ID NO: 7029 - RNA, 18 nt, artificial
  Chemically synthesized
uugcaaacaggcuuccuc

SEQ ID NO: 7030 - RNA, 18 nt, artificial
  Chemically synthesized
cuccggcuggucugacgc

SEQ ID NO: 7031 - RNA, 18 nt, artificial
  Chemically synthesized
uucacaguccuucgcucc

SEQ ID NO: 7032 - RNA, 18 nt, artificial
  Chemically synthesized
uuuggagagcagccacuc

SEQ ID NO: 7033 - RNA, 18 nt, artificial
  Chemically synthesized
ugucguccagcaagcuca

SEQ ID NO: 7034 - RNA, 18 nt, artificial
  Chemically synthesized
gaauguagucgaugacgc

SEQ ID NO: 7035 - RNA, 18 nt, artificial
  Chemically synthesized
acuuauagagccugccug

SEQ ID NO: 7036 - RNA, 18 nt, artificial
  Chemically synthesized
uuucuccaaggagaccag

SEQ ID NO: 7037 - RNA, 18 nt, artificial
  Chemically synthesized
aaguucacaguccuucgc

SEQ ID NO: 7038 - RNA, 18 nt, artificial
  Chemically synthesized
auucaaagaaugaggaag

SEQ ID NO: 7039 - RNA, 18 nt, artificial
  Chemically synthesized
ggcucagcgccuucaugc

SEQ ID NO: 7040 - RNA, 18 nt, artificial
  Chemically synthesized
ucaaaaccauuaacuucc

SEQ ID NO: 7041 - RNA, 18 nt, artificial
  Chemically synthesized
auuuggugaagucaagug

SEQ ID NO: 7042 - RNA, 18 nt, artificial
  Chemically synthesized
agaaaaccaaaagaaguc

SEQ ID NO: 7043 - RNA, 18 nt, artificial
  Chemically synthesized
agaagaccagcucugccg

SEQ ID NO: 7044 - RNA, 18 nt, artificial
  Chemically synthesized
uuuccaccuggcuaagcu

SEQ ID NO: 7045 - RNA, 18 nt, artificial
  Chemically synthesized
uacaucgcauuguuacag

SEQ ID NO: 7046 - RNA, 18 nt, artificial
  Chemically synthesized
gcggucacuuauagagcc

SEQ ID NO: 7047 - RNA, 18 nt, artificial
  Chemically synthesized
uucaaagaaugaggaagc

SEQ ID NO: 7048 - RNA, 18 nt, artificial
  Chemically synthesized
ugagcaccagguuuaguc

SEQ ID NO: 7049 - RNA, 18 nt, artificial
  Chemically synthesized
agaagucccgcuacagug

SEQ ID NO: 7050 - RNA, 18 nt, artificial
  Chemically synthesized
agaccagaagaccagcuc

SEQ ID NO: 7051 - RNA, 18 nt, artificial
  Chemically synthesized
ugccguccggcuuccggc

SEQ ID NO: 7052 - RNA, 18 nt, artificial
  Chemically synthesized
cuuaaauugcaaacaggc

SEQ ID NO: 7053 - RNA, 18 nt, artificial
  Chemically synthesized
accuuucuccaaggagac

SEQ ID NO: 7054 - RNA, 18 nt, artificial
  Chemically synthesized
uaguuuggagagcagcca

SEQ ID NO: 7055 - RNA, 18 nt, artificial
  Chemically synthesized
uuacagaaagucaccuuc

SEQ ID NO: 7056 - RNA, 18 nt, artificial
  Chemically synthesized
agagaccuuagaacuugg

SEQ ID NO: 7057 - RNA, 18 nt, artificial
  Chemically synthesized
caaguucacaguccuucg

SEQ ID NO: 7058 - RNA, 18 nt, artificial
  Chemically synthesized
aauugcaaacaggcuucc

SEQ ID NO: 7059 - RNA, 18 nt, artificial
  Chemically synthesized
acuccggguaccaguucc

SEQ ID NO: 7060 - RNA, 18 nt, artificial
  Chemically synthesized
aucuuugagcuucccugc

SEQ ID NO: 7061 - RNA, 18 nt, artificial
  Chemically synthesized
agacugcguuccgacagg

SEQ ID NO: 7062 - RNA, 18 nt, artificial
  Chemically synthesized
uaagcugagugccucucg

SEQ ID NO: 7063 - RNA, 18 nt, artificial
  Chemically synthesized
gagaccuuagaacuuggg

SEQ ID NO: 7064 - RNA, 18 nt, artificial
  Chemically synthesized
cuuucuccaaggagacca

SEQ ID NO: 7065 - RNA, 18 nt, artificial
  Chemically synthesized
uuuagucuccaggaaggg

SEQ ID NO: 7066 - RNA, 18 nt, artificial
  Chemically synthesized
uguagucgaugacgcgcu

SEQ ID NO: 7067 - RNA, 18 nt, artificial
  Chemically synthesized
ucuuugagcuucccugcc

SEQ ID NO: 7068 - RNA, 18 nt, artificial
  Chemically synthesized
agaauuugcuuuuuccug

SEQ ID NO: 7069 - RNA, 18 nt, artificial
  Chemically synthesized
caaguuccggagugagcu

SEQ ID NO: 7070 - RNA, 18 nt, artificial
  Chemically synthesized
caaggagaccagaagacc

SEQ ID NO: 7071 - RNA, 18 nt, artificial
  Chemically synthesized
gaaccuuucuccaaggag

SEQ ID NO: 7072 - RNA, 18 nt, artificial
  Chemically synthesized
uagcagugguucaugucg

SEQ ID NO: 7073 - RNA, 18 nt, artificial
  Chemically synthesized
cagugguucaugucgucc

SEQ ID NO: 7074 - RNA, 18 nt, artificial
  Chemically synthesized
agaauguagucgaugacg

SEQ ID NO: 7075 - RNA, 18 nt, artificial
  Chemically synthesized
augacaaguuccggagug

SEQ ID NO: 7076 - RNA, 18 nt, artificial
  Chemically synthesized
ucuccaggaagggauuug

SEQ ID NO: 7077 - RNA, 18 nt, artificial
  Chemically synthesized
ucagcgccuucaugcugg

SEQ ID NO: 7078 - RNA, 18 nt, artificial
  Chemically synthesized
aaaccaaaagaagucccg

SEQ ID NO: 7079 - RNA, 18 nt, artificial
  Chemically synthesized
aaucagggcaacagaacc

SEQ ID NO: 7080 - RNA, 18 nt, artificial
  Chemically synthesized
aguucacaguccuucgcu

SEQ ID NO: 7081 - RNA, 18 nt, artificial
  Chemically synthesized
ugucuggaugggaaggug

SEQ ID NO: 7082 - RNA, 18 nt, artificial
  Chemically synthesized
ucuuuauucaaaauggcc

SEQ ID NO: 7083 - RNA, 18 nt, artificial
  Chemically synthesized
aaacaggcuuccuccggc

SEQ ID NO: 7084 - RNA, 18 nt, artificial
  Chemically synthesized
cuggcuaagcugagugcc

SEQ ID NO: 7085 - RNA, 18 nt, artificial
  Chemically synthesized
aauguagucgaugacgcg

SEQ ID NO: 7086 - RNA, 18 nt, artificial
  Chemically synthesized
acaaguuccggagugagc

SEQ ID NO: 7087 - RNA, 18 nt, artificial
  Chemically synthesized
agugguucaugucgucca

SEQ ID NO: 7088 - RNA, 18 nt, artificial
  Chemically synthesized
aguuccggagugagcucg

SEQ ID NO: 7089 - RNA, 18 nt, artificial
  Chemically synthesized
agaucuuugagcuucccu

SEQ ID NO: 7090 - RNA, 18 nt, artificial
  Chemically synthesized
ugaggaagcgcugauacc

SEQ ID NO: 7091 - RNA, 18 nt, artificial
  Chemically synthesized
ucuccgccagcaaggauu

SEQ ID NO: 7092 - RNA, 18 nt, artificial
  Chemically synthesized
agaaagucaccuuccugu

SEQ ID NO: 7093 - RNA, 18 nt, artificial
  Chemically synthesized
caaagagaaagaaaacca

SEQ ID NO: 7094 - RNA, 18 nt, artificial
  Chemically synthesized
gugaguccagaggugccc

SEQ ID NO: 7095 - RNA, 18 nt, artificial
  Chemically synthesized
cuccuuccacaccuccac

SEQ ID NO: 7096 - RNA, 18 nt, artificial
  Chemically synthesized
aaauggcccgccucggcc

SEQ ID NO: 7097 - RNA, 18 nt, artificial
  Chemically synthesized
gugccucucgggacuccg

SEQ ID NO: 7098 - RNA, 18 nt, artificial
  Chemically synthesized
ucaucauauacacaagug

SEQ ID NO: 7099 - RNA, 18 nt, artificial
  Chemically synthesized
agaacgggcgccagcacc

SEQ ID NO: 7100 - RNA, 18 nt, artificial
  Chemically synthesized
uccggcuggucugacgcc

SEQ ID NO: 7101 - RNA, 18 nt, artificial
  Chemically synthesized
accuggcuaagcugagug

SEQ ID NO: 7102 - RNA, 18 nt, artificial
  Chemically synthesized
uuaacuuccagaauuugc

SEQ ID NO: 7103 - RNA, 18 nt, artificial
  Chemically synthesized
ucuggaugggaagguggg

SEQ ID NO: 7104 - RNA, 18 nt, artificial
  Chemically synthesized
cggauucaaagaaugagg

SEQ ID NO: 7105 - RNA, 18 nt, artificial
  Chemically synthesized
acagaaccuuucuccaag

SEQ ID NO: 7106 - RNA, 18 nt, artificial
  Chemically synthesized
cuccggguaccaguuccc

SEQ ID NO: 7107 - RNA, 18 nt, artificial
  Chemically synthesized
ucgcauuguuacagaaag

SEQ ID NO: 7108 - RNA, 18 nt, artificial
  Chemically synthesized
uuuuuccuggcagcaccc

SEQ ID NO: 7109 - RNA, 18 nt, artificial
  Chemically synthesized
cuuauagagccugccugg

SEQ ID NO: 7110 - RNA, 18 nt, artificial
  Chemically synthesized
cuccuuuugucguuggag

SEQ ID NO: 7111 - RNA, 18 nt, artificial
  Chemically synthesized
uagcucuggcucuucagg

SEQ ID NO: 7112 - RNA, 18 nt, artificial
  Chemically synthesized
gaaaaccaaaagaagucc

SEQ ID NO: 7113 - RNA, 18 nt, artificial
  Chemically synthesized
aauuugcuuuuuccuggc

SEQ ID NO: 7114 - RNA, 18 nt, artificial
  Chemically synthesized
aguccuucgcuccugagc

SEQ ID NO: 7115 - RNA, 18 nt, artificial
  Chemically synthesized
cagccacuccuuccacac

SEQ ID NO: 7116 - RNA, 18 nt, artificial
  Chemically synthesized
gucaguggcaaaagcucc

SEQ ID NO: 7117 - RNA, 18 nt, artificial
  Chemically synthesized
uccacgcucugaagagac

SEQ ID NO: 7118 - RNA, 18 nt, artificial
  Chemically synthesized
ucugaagagaccuuagaa

SEQ ID NO: 7119 - RNA, 18 nt, artificial
  Chemically synthesized
augaggaagcgcugauac

SEQ ID NO: 7120 - RNA, 18 nt, artificial
  Chemically synthesized
ucucgggacuccggguac

SEQ ID NO: 7121 - RNA, 18 nt, artificial
  Chemically synthesized
aaccuuucuccaaggaga

SEQ ID NO: 7122 - RNA, 18 nt, artificial
  Chemically synthesized
uuuugucguuggagauga

SEQ ID NO: 7123 - RNA, 18 nt, artificial
  Chemically synthesized
gcaccagguuuagucucc

SEQ ID NO: 7124 - RNA, 18 nt, artificial
  Chemically synthesized
cauaguuuggagagcagc

SEQ ID NO: 7125 - RNA, 18 nt, artificial
  Chemically synthesized
cggcggucacuuauagag

SEQ ID NO: 7126 - RNA, 18 nt, artificial
  Chemically synthesized
augucguccagcaagcuc

SEQ ID NO: 7127 - RNA, 18 nt, artificial
  Chemically synthesized
gaauuugcuuuuuccugg

SEQ ID NO: 7128 - RNA, 18 nt, artificial
  Chemically synthesized
gucugacgccgaagaccg

SEQ ID NO: 7129 - RNA, 18 nt, artificial
  Chemically synthesized
uuccuguaaaaaagguac

SEQ ID NO: 7130 - RNA, 18 nt, artificial
  Chemically synthesized
uucaugucguccagcaag

SEQ ID NO: 7131 - RNA, 18 nt, artificial
  Chemically synthesized
aagggauuuggugaaguc

SEQ ID NO: 7132 - RNA, 18 nt, artificial
  Chemically synthesized
cucugaagagaccuuaga

SEQ ID NO: 7133 - RNA, 18 nt, artificial
  Chemically synthesized
ugccaguccgccuuuagc

SEQ ID NO: 7134 - RNA, 18 nt, artificial
  Chemically synthesized
cguucuggaggugucagg

SEQ ID NO: 7135 - RNA, 18 nt, artificial
  Chemically synthesized
guagcagugguucauguc

SEQ ID NO: 7136 - RNA, 18 nt, artificial
  Chemically synthesized
aggucgagaauguagucg

SEQ ID NO: 7137 - RNA, 18 nt, artificial
  Chemically synthesized
gagugaguccagaggugc

SEQ ID NO: 7138 - RNA, 18 nt, artificial
  Chemically synthesized
ucgagaauguagucgaug

SEQ ID NO: 7139 - RNA, 18 nt, artificial
  Chemically synthesized
gguacaaaaccuauauac

SEQ ID NO: 7140 - RNA, 18 nt, artificial
  Chemically synthesized
gccagacugcguuccgac

SEQ ID NO: 7141 - RNA, 18 nt, artificial
  Chemically synthesized
uuaaauugcaaacaggcu

SEQ ID NO: 7142 - RNA, 18 nt, artificial
  Chemically synthesized
ucuucaggccacaaguuc

SEQ ID NO: 7143 - RNA, 18 nt, artificial
  Chemically synthesized
ugcaggucgagaauguag

SEQ ID NO: 7144 - RNA, 18 nt, artificial
  Chemically synthesized
guuggagaugacaaguuc

SEQ ID NO: 7145 - RNA, 18 nt, artificial
  Chemically synthesized
aaggagaccagaagacca

SEQ ID NO: 7146 - RNA, 18 nt, artificial
  Chemically synthesized
gcauuguuacagaaaguc

SEQ ID NO: 7147 - RNA, 18 nt, artificial
  Chemically synthesized
aaaccauuaacuuccaga

SEQ ID NO: 7148 - RNA, 18 nt, artificial
  Chemically synthesized
ccaaagagaaagaaaacc

SEQ ID NO: 7149 - RNA, 18 nt, artificial
  Chemically synthesized
cuuuuuccuggcagcacc

SEQ ID NO: 7150 - RNA, 18 nt, artificial
  Chemically synthesized
agugaguccagaggugcc

SEQ ID NO: 7151 - RNA, 18 nt, artificial
  Chemically synthesized
ugguucaugucguccagc

SEQ ID NO: 7152 - RNA, 18 nt, artificial
  Chemically synthesized
uacagugaccugcaacgc

SEQ ID NO: 7153 - RNA, 18 nt, artificial
  Chemically synthesized
uggcuaagcugagugccu

SEQ ID NO: 7154 - RNA, 18 nt, artificial
  Chemically synthesized
aaagaagucccgcuacag

SEQ ID NO: 7155 - RNA, 18 nt, artificial
  Chemically synthesized
aaguuccggagugagcuc

SEQ ID NO: 7156 - RNA, 18 nt, artificial
  Chemically synthesized
uuccgacaggcagcacac

SEQ ID NO: 7157 - RNA, 18 nt, artificial
  Chemically synthesized
aggacuaccugcaggucg

SEQ ID NO: 7158 - RNA, 18 nt, artificial
  Chemically synthesized
auguagucgaugacgcgc

SEQ ID NO: 7159 - RNA, 18 nt, artificial
  Chemically synthesized
ccagguuuagucuccagg

SEQ ID NO: 7160 - RNA, 18 nt, artificial
  Chemically synthesized
cucguagcagccgcgcac

SEQ ID NO: 7161 - RNA, 18 nt, artificial
  Chemically synthesized
guucacaguccuucgcuc

SEQ ID NO: 7162 - RNA, 18 nt, artificial
  Chemically synthesized
cacuccuuccacaccucc

SEQ ID NO: 7163 - RNA, 18 nt, artificial
  Chemically synthesized
gacugcguuccgacaggc

SEQ ID NO: 7164 - RNA, 18 nt, artificial
  Chemically synthesized
cuuccuccggcuggucug

SEQ ID NO: 7165 - RNA, 18 nt, artificial
  Chemically synthesized
gagaugacaaguuccgga

SEQ ID NO: 7166 - RNA, 18 nt, artificial
  Chemically synthesized
ugccucucgggacuccgg

SEQ ID NO: 7167 - RNA, 18 nt, artificial
  Chemically synthesized
uggucugacgccgaagac

SEQ ID NO: 7168 - RNA, 18 nt, artificial
  Chemically synthesized
aagcuccuuuugucguug

SEQ ID NO: 7169 - RNA, 18 nt, artificial
  Chemically synthesized
ggcggucacuuauagagc

SEQ ID NO: 7170 - RNA, 18 nt, artificial
  Chemically synthesized
gucacuuauagagccugc

SEQ ID NO: 7171 - RNA, 18 nt, artificial
  Chemically synthesized
uagagccugccuggaagg

SEQ ID NO: 7172 - RNA, 18 nt, artificial
  Chemically synthesized
gaggugucaggacacggc

SEQ ID NO: 7173 - RNA, 18 nt, artificial
  Chemically synthesized
cagugaccugcaacgcgc

SEQ ID NO: 7174 - RNA, 18 nt, artificial
  Chemically synthesized
gccacaaguucacagucc

SEQ ID NO: 7175 - RNA, 18 nt, artificial
  Chemically synthesized
cagacugcguuccgacag

SEQ ID NO: 7176 - RNA, 18 nt, artificial
  Chemically synthesized
agccacuccuuccacacc

SEQ ID NO: 7177 - RNA, 18 nt, artificial
  Chemically synthesized
aagaaugaggaagcgcug

SEQ ID NO: 7178 - RNA, 18 nt, artificial
  Chemically synthesized
cgcuguaggauuuccacc

SEQ ID NO: 7179 - RNA, 18 nt, artificial
  Chemically synthesized
gcaccugcguucuggagg

SEQ ID NO: 7180 - RNA, 18 nt, artificial
  Chemically synthesized
ucguagcagccgcgcacc

SEQ ID NO: 7181 - RNA, 18 nt, artificial
  Chemically synthesized
aggugucaggacacggcc

SEQ ID NO: 7182 - RNA, 18 nt, artificial
  Chemically synthesized
gagaauguagucgaugac

SEQ ID NO: 7183 - RNA, 18 nt, artificial
  Chemically synthesized
agagcuagcucuggcucu

SEQ ID NO: 7184 - RNA, 18 nt, artificial
  Chemically synthesized
aggagaccagaagaccag

SEQ ID NO: 7185 - RNA, 18 nt, artificial
  Chemically synthesized
ucgaugacgcgcuguagg

SEQ ID NO: 7186 - RNA, 18 nt, artificial
  Chemically synthesized
acuccuuccacaccucca

SEQ ID NO: 7187 - RNA, 18 nt, artificial
  Chemically synthesized
auggccagacugcguucc

SEQ ID NO: 7188 - RNA, 18 nt, artificial
  Chemically synthesized
agcucggcugucuggaug

SEQ ID NO: 7189 - RNA, 18 nt, artificial
  Chemically synthesized
caacagaaccuuucucca

SEQ ID NO: 7190 - RNA, 18 nt, artificial
  Chemically synthesized
cauuguuacagaaaguca

SEQ ID NO: 7191 - RNA, 18 nt, artificial
  Chemically synthesized
gcuuaaauugcaaacagg

SEQ ID NO: 7192 - RNA, 18 nt, artificial
  Chemically synthesized
agcaccagguuuagucuc

SEQ ID NO: 7193 - RNA, 18 nt, artificial
  Chemically synthesized
uccuuuugucguuggaga

SEQ ID NO: 7194 - RNA, 18 nt, artificial
  Chemically synthesized
uuugcuuuuuccuggcag

SEQ ID NO: 7195 - RNA, 18 nt, artificial
  Chemically synthesized
uuccggagugagcucggc

SEQ ID NO: 7196 - RNA, 18 nt, artificial
  Chemically synthesized
guccuucgcuccugagca

SEQ ID NO: 7197 - RNA, 18 nt, artificial
  Chemically synthesized
uucuggaggugucaggac

SEQ ID NO: 7198 - RNA, 18 nt, artificial
  Chemically synthesized
guuuagucuccaggaagg

SEQ ID NO: 7199 - RNA, 18 nt, artificial
  Chemically synthesized
guccagcaagcucagcgg

SEQ ID NO: 7200 - RNA, 18 nt, artificial
  Chemically synthesized
cugccuggaaggcacgcc

SEQ ID NO: 7201 - RNA, 18 nt, artificial
  Chemically synthesized
ugagcucggcugucugga

SEQ ID NO: 7202 - RNA, 18 nt, artificial
  Chemically synthesized
guuccgacaggcagcaca

SEQ ID NO: 7203 - RNA, 18 nt, artificial
  Chemically synthesized
ugcguuccgacaggcagc

SEQ ID NO: 7204 - RNA, 18 nt, artificial
  Chemically synthesized
guuuggagagcagccacu

SEQ ID NO: 7205 - RNA, 18 nt, artificial
  Chemically synthesized
cucuuuauucaaaauggc

SEQ ID NO: 7206 - RNA, 18 nt, artificial
  Chemically synthesized
aguagcagugguucaugu

SEQ ID NO: 7207 - RNA, 18 nt, artificial
  Chemically synthesized
acagcccgcuuaaauugc

SEQ ID NO: 7208 - RNA, 18 nt, artificial
  Chemically synthesized
cugcguucuggagguguc

SEQ ID NO: 7209 - RNA, 18 nt, artificial
  Chemically synthesized
cagaaccuuucuccaagg

SEQ ID NO: 7210 - RNA, 18 nt, artificial
  Chemically synthesized
ccgccuuggcauaguuug

SEQ ID NO: 7211 - RNA, 18 nt, artificial
  Chemically synthesized
gagaaagaaaaccaaaag

SEQ ID NO: 7212 - RNA, 18 nt, artificial
  Chemically synthesized
uuuauucaaaauggcccg

SEQ ID NO: 7213 - RNA, 18 nt, artificial
  Chemically synthesized
auugcaaacaggcuuccu

SEQ ID NO: 7214 - RNA, 18 nt, artificial
  Chemically synthesized
auuuccaccuggcuaagc

SEQ ID NO: 7215 - RNA, 18 nt, artificial
  Chemically synthesized
agcagccacuccuuccac

SEQ ID NO: 7216 - RNA, 18 nt, artificial
  Chemically synthesized
cagaagaccagcucugcc

SEQ ID NO: 7217 - RNA, 18 nt, artificial
  Chemically synthesized
gguuuagucuccaggaag

SEQ ID NO: 7218 - RNA, 18 nt, artificial
  Chemically synthesized
ucacucaaaaccauuaac

SEQ ID NO: 7219 - RNA, 18 nt, artificial
  Chemically synthesized
gccacuccuuccacaccu

SEQ ID NO: 7220 - RNA, 18 nt, artificial
  Chemically synthesized
agugagcucggcugucug

SEQ ID NO: 7221 - RNA, 18 nt, artificial
  Chemically synthesized
ggucacuuauagagccug

SEQ ID NO: 7222 - RNA, 18 nt, artificial
  Chemically synthesized
ccagaucuuugagcuucc

SEQ ID NO: 7223 - RNA, 18 nt, artificial
  Chemically synthesized
uuggcauaguuuggagag

SEQ ID NO: 7224 - RNA, 18 nt, artificial
  Chemically synthesized
accuuccuguaaaaaagg

SEQ ID NO: 7225 - RNA, 18 nt, artificial
  Chemically synthesized
aauggcccgccucggccc

SEQ ID NO: 7226 - RNA, 18 nt, artificial
  Chemically synthesized
guuccggagugagcucgg

SEQ ID NO: 7227 - RNA, 18 nt, artificial
  Chemically synthesized
ugggcagggcgaaguugg

SEQ ID NO: 7228 - RNA, 18 nt, artificial
  Chemically synthesized
agcagggugacgucgccc

SEQ ID NO: 7229 - RNA, 18 nt, artificial
  Chemically synthesized
acgucgcccagcuggugg

SEQ ID NO: 7230 - RNA, 18 nt, artificial
  Chemically synthesized
ucggcugucuggauggga

SEQ ID NO: 7231 - RNA, 18 nt, artificial
  Chemically synthesized
cuagcucuggcucuucag

SEQ ID NO: 7232 - RNA, 18 nt, artificial
  Chemically synthesized
gaguucauaaaucagggc

SEQ ID NO: 7233 - RNA, 18 nt, artificial
  Chemically synthesized
ccgccucguagcagccgc

SEQ ID NO: 7234 - RNA, 18 nt, artificial
  Chemically synthesized
accagaagaccagcucug

SEQ ID NO: 7235 - RNA, 18 nt, artificial
  Chemically synthesized
agaccagcucugccgccg

SEQ ID NO: 7236 - RNA, 18 nt, artificial
  Chemically synthesized
gagaccagaagaccagcu

SEQ ID NO: 7237 - RNA, 18 nt, artificial
  Chemically synthesized
uaggauuuccaccuggcu

SEQ ID NO: 7238 - RNA, 18 nt, artificial
  Chemically synthesized
cuaagcugagugccucuc

SEQ ID NO: 7239 - RNA, 18 nt, artificial
  Chemically synthesized
gagugagcucggcugucu

SEQ ID NO: 7240 - RNA, 18 nt, artificial
  Chemically synthesized
gcucugaagagaccuuag

SEQ ID NO: 7241 - RNA, 18 nt, artificial
  Chemically synthesized
caaaagcuccuuuugucg

SEQ ID NO: 7242 - RNA, 18 nt, artificial
  Chemically synthesized
gcucggcugucuggaugg

SEQ ID NO: 7243 - RNA, 18 nt, artificial
  Chemically synthesized
gugguucaugucguccag

SEQ ID NO: 7244 - RNA, 18 nt, artificial
  Chemically synthesized
ccgcuuaaauugcaaaca

SEQ ID NO: 7245 - RNA, 18 nt, artificial
  Chemically synthesized
gcgccagcaccugcguuc

SEQ ID NO: 7246 - RNA, 18 nt, artificial
  Chemically synthesized
aagaccagcucugccgcc

SEQ ID NO: 7247 - RNA, 18 nt, artificial
  Chemically synthesized
acaccgccucguagcagc

SEQ ID NO: 7248 - RNA, 18 nt, artificial
  Chemically synthesized
gugacgucgcccagcugg

SEQ ID NO: 7249 - RNA, 18 nt, artificial
  Chemically synthesized
accaaaagaagucccgcu

SEQ ID NO: 7250 - RNA, 18 nt, artificial
  Chemically synthesized
gagcagccacuccuucca

SEQ ID NO: 7251 - RNA, 18 nt, artificial
  Chemically synthesized
guaccaguucccgcaggc

SEQ ID NO: 7252 - RNA, 18 nt, artificial
  Chemically synthesized
agggcaacagaaccuuuc

SEQ ID NO: 7253 - RNA, 18 nt, artificial
  Chemically synthesized
uucaggccacaaguucac

SEQ ID NO: 7254 - RNA, 18 nt, artificial
  Chemically synthesized
agcugagugccucucggg

SEQ ID NO: 7255 - RNA, 18 nt, artificial
  Chemically synthesized
gcuguaggauuuccaccu

SEQ ID NO: 7256 - RNA, 18 nt, artificial
  Chemically synthesized
ccgcggauucaaagaaug

SEQ ID NO: 7257 - RNA, 18 nt, artificial
  Chemically synthesized
caaacaggcuuccuccgg

SEQ ID NO: 7258 - RNA, 18 nt, artificial
  Chemically synthesized
agucaagugggcagggcg

SEQ ID NO: 7259 - RNA, 18 nt, artificial
  Chemically synthesized
uuccggcaggagagguuc

SEQ ID NO: 7260 - RNA, 18 nt, artificial
  Chemically synthesized
agcaagcucagcggcucc

SEQ ID NO: 7261 - RNA, 18 nt, artificial
  Chemically synthesized
gagagcagccacuccuuc

SEQ ID NO: 7262 - RNA, 18 nt, artificial
  Chemically synthesized
cucagcgccuucaugcug

SEQ ID NO: 7263 - RNA, 18 nt, artificial
  Chemically synthesized
gcaaaagcuccuuuuguc

SEQ ID NO: 7264 - RNA, 18 nt, artificial
  Chemically synthesized
acgcgcuguaggauuucc

SEQ ID NO: 7265 - RNA, 18 nt, artificial
  Chemically synthesized
gucccgcuacagugaccu

SEQ ID NO: 7266 - RNA, 18 nt, artificial
  Chemically synthesized
cgcuuaaauugcaaacag

SEQ ID NO: 7267 - RNA, 18 nt, artificial
  Chemically synthesized
aguucauaaaucagggca

SEQ ID NO: 7268 - RNA, 18 nt, artificial
  Chemically synthesized
gaguagcagugguucaug

SEQ ID NO: 7269 - RNA, 18 nt, artificial
  Chemically synthesized
aagucaagugggcagggc

SEQ ID NO: 7270 - RNA, 18 nt, artificial
  Chemically synthesized
gauuuggugaagucaagu

SEQ ID NO: 7271 - RNA, 18 nt, artificial
  Chemically synthesized
cggcuuccggcaggagag

SEQ ID NO: 7272 - RNA, 18 nt, artificial
  Chemically synthesized
cagaucuuugagcuuccc

SEQ ID NO: 7273 - RNA, 18 nt, artificial
  Chemically synthesized
ucccugccguccggcuuc

SEQ ID NO: 7274 - RNA, 18 nt, artificial
  Chemically synthesized
cagcaagcucagcggcuc

SEQ ID NO: 7275 - RNA, 18 nt, artificial
  Chemically synthesized
cugccaguccgccuuuag

SEQ ID NO: 7276 - RNA, 18 nt, artificial
  Chemically synthesized
uccuuccacaccuccacg

SEQ ID NO: 7277 - RNA, 18 nt, artificial
  Chemically synthesized
agugccucucgggacucc

SEQ ID NO: 7278 - RNA, 18 nt, artificial
  Chemically synthesized
ugaccugcaacgcgcgca

SEQ ID NO: 7279 - RNA, 18 nt, artificial
  Chemically synthesized
cagaaagucaccuuccug

SEQ ID NO: 7280 - RNA, 18 nt, artificial
  Chemically synthesized
gggcucagcgccuucaug

SEQ ID NO: 7281 - RNA, 18 nt, artificial
  Chemically synthesized
acuuccagaauuugcuuu

SEQ ID NO: 7282 - RNA, 18 nt, artificial
  Chemically synthesized
ggucgagaauguagucga

SEQ ID NO: 7283 - RNA, 18 nt, artificial
  Chemically synthesized
ccagcaccugcguucugg

SEQ ID NO: 7284 - RNA, 18 nt, artificial
  Chemically synthesized
cuacagugaccugcaacg

SEQ ID NO: 7285 - RNA, 18 nt, artificial
  Chemically synthesized
ucguuggagaugacaagu

SEQ ID NO: 7286 - RNA, 18 nt, artificial
  Chemically synthesized
cacgcucugaagagaccu

SEQ ID NO: 7287 - RNA, 18 nt, artificial
  Chemically synthesized
agcacaccgccucguagc

SEQ ID NO: 7288 - RNA, 18 nt, artificial
  Chemically synthesized
gagucaguggcaaaagcu

SEQ ID NO: 7289 - RNA, 18 nt, artificial
  Chemically synthesized
gccucuccgccagcaagg

SEQ ID NO: 7290 - RNA, 18 nt, artificial
  Chemically synthesized
ugccuggaaggcacgccu

SEQ ID NO: 7291 - RNA, 18 nt, artificial
  Chemically synthesized
gugggagcagggugacgu

SEQ ID NO: 7292 - RNA, 18 nt, artificial
  Chemically synthesized
uccagcaagcucagcggc

SEQ ID NO: 7293 - RNA, 18 nt, artificial
  Chemically synthesized
aaccaaaagaagucccgc

SEQ ID NO: 7294 - RNA, 18 nt, artificial
  Chemically synthesized
ugacgccgaagaccgcgg

SEQ ID NO: 7295 - RNA, 18 nt, artificial
  Chemically synthesized
agccugccuggaaggcac

SEQ ID NO: 7296 - RNA, 18 nt, artificial
  Chemically synthesized
ugacgucgcccagcuggu

SEQ ID NO: 7297 - RNA, 18 nt, artificial
  Chemically synthesized
cggucacuuauagagccu

SEQ ID NO: 7298 - RNA, 18 nt, artificial
  Chemically synthesized
aggaagcgcugauaccgg

SEQ ID NO: 7299 - RNA, 18 nt, artificial
  Chemically synthesized
cugccguccggcuuccgg

SEQ ID NO: 7300 - RNA, 18 nt, artificial
  Chemically synthesized
aucagggcaacagaaccu

SEQ ID NO: 7301 - RNA, 18 nt, artificial
  Chemically synthesized
agucccgcuacagugacc

SEQ ID NO: 7302 - RNA, 18 nt, artificial
  Chemically synthesized
agcucagcggcuccucag

SEQ ID NO: 7303 - RNA, 18 nt, artificial
  Chemically synthesized
gcucuggcucuucaggcc

SEQ ID NO: 7304 - RNA, 18 nt, artificial
  Chemically synthesized
ugaagucaagugggcagg

SEQ ID NO: 7305 - RNA, 18 nt, artificial
  Chemically synthesized
uggccagacugcguuccg

SEQ ID NO: 7306 - RNA, 18 nt, artificial
  Chemically synthesized
ucggccaggacuaccugc

SEQ ID NO: 7307 - RNA, 18 nt, artificial
  Chemically synthesized
uguaggauuuccaccugg

SEQ ID NO: 7308 - RNA, 18 nt, artificial
  Chemically synthesized
ccuuucuccaaggagacc

SEQ ID NO: 7309 - RNA, 18 nt, artificial
  Chemically synthesized
cuaccugcaggucgagaa

SEQ ID NO: 7310 - RNA, 18 nt, artificial
  Chemically synthesized
cugagugccucucgggac

SEQ ID NO: 7311 - RNA, 18 nt, artificial
  Chemically synthesized
aaaagcuccuuuugucgu

SEQ ID NO: 7312 - RNA, 18 nt, artificial
  Chemically synthesized
ucagcggcuccucagcug

SEQ ID NO: 7313 - RNA, 18 nt, artificial
  Chemically synthesized
gcagugguucaugucguc

SEQ ID NO: 7314 - RNA, 18 nt, artificial
  Chemically synthesized
aacgcgcgcacgcucgcc

SEQ ID NO: 7315 - RNA, 18 nt, artificial
  Chemically synthesized
cugcguuccgacaggcag

SEQ ID NO: 7316 - RNA, 18 nt, artificial
  Chemically synthesized
ccacuccuuccacaccuc

SEQ ID NO: 7317 - RNA, 18 nt, artificial
  Chemically synthesized
ggauuuggugaagucaag

SEQ ID NO: 7318 - RNA, 18 nt, artificial
  Chemically synthesized
uucacagcccgcuuaaau

SEQ ID NO: 7319 - RNA, 18 nt, artificial
  Chemically synthesized
agucaguggcaaaagcuc

SEQ ID NO: 7320 - RNA, 18 nt, artificial
  Chemically synthesized
cagaauuugcuuuuuccu

SEQ ID NO: 7321 - RNA, 18 nt, artificial
  Chemically synthesized
uagcagccgcgcaccggg

SEQ ID NO: 7322 - RNA, 18 nt, artificial
  Chemically synthesized
accagguuuagucuccag

SEQ ID NO: 7323 - RNA, 18 nt, artificial
  Chemically synthesized
agcuccuuuugucguugg

SEQ ID NO: 7324 - RNA, 18 nt, artificial
  Chemically synthesized
uccaggaagggauuuggu

SEQ ID NO: 7325 - RNA, 18 nt, artificial
  Chemically synthesized
ucguccagcaagcucagc

SEQ ID NO: 7326 - RNA, 18 nt, artificial
  Chemically synthesized
aagucccgcuacagugac

SEQ ID NO: 7327 - RNA, 18 nt, artificial
  Chemically synthesized
uaccaguucccgcaggcg

SEQ ID NO: 7328 - RNA, 18 nt, artificial
  Chemically synthesized
gucccaggcagaacgggc

SEQ ID NO: 7329 - RNA, 18 nt, artificial
  Chemically synthesized
cugucuggaugggaaggu

SEQ ID NO: 7330 - RNA, 18 nt, artificial
  Chemically synthesized
aaagcuccuuuugucguu

SEQ ID NO: 7331 - RNA, 18 nt, artificial
  Chemically synthesized
ugcaacgcgcgcacgcuc

SEQ ID NO: 7332 - RNA, 18 nt, artificial
  Chemically synthesized
agaaccuuucuccaagga

SEQ ID NO: 7333 - RNA, 18 nt, artificial
  Chemically synthesized
cgcucugaagagaccuua

SEQ ID NO: 7334 - RNA, 18 nt, artificial
  Chemically synthesized
agaggcgggccucuccgc

SEQ ID NO: 7335 - RNA, 18 nt, artificial
  Chemically synthesized
guucuggaggugucagga

SEQ ID NO: 7336 - RNA, 18 nt, artificial
  Chemically synthesized
ggcugucuggaugggaag

SEQ ID NO: 7337 - RNA, 18 nt, artificial
  Chemically synthesized
cucaaaaccauuaacuuc

SEQ ID NO: 7338 - RNA, 18 nt, artificial
  Chemically synthesized
aagcucagcggcuccuca

SEQ ID NO: 7339 - RNA, 18 nt, artificial
  Chemically synthesized
gcggauucaaagaaugag

SEQ ID NO: 7340 - RNA, 18 nt, artificial
  Chemically synthesized
gaaugaggaagcgcugau

SEQ ID NO: 7341 - RNA, 18 nt, artificial
  Chemically synthesized
cccagaucuuugagcuuc

SEQ ID NO: 7342 - RNA, 18 nt, artificial
  Chemically synthesized
uuccacaccuccacgcuc

SEQ ID NO: 7343 - RNA, 18 nt, artificial
  Chemically synthesized
uucgcuccugagcaccag

SEQ ID NO: 7344 - RNA, 18 nt, artificial
  Chemically synthesized
agggugacgucgcccagc

SEQ ID NO: 7345 - RNA, 18 nt, artificial
  Chemically synthesized
aggccacaaguucacagu

SEQ ID NO: 7346 - RNA, 18 nt, artificial
  Chemically synthesized
acgcucugaagagaccuu

SEQ ID NO: 7347 - RNA, 18 nt, artificial
  Chemically synthesized
gcucagcgccuucaugcu

SEQ ID NO: 7348 - RNA, 18 nt, artificial
  Chemically synthesized
agggauuuggugaaguca

SEQ ID NO: 7349 - RNA, 18 nt, artificial
  Chemically synthesized
cuuccagaauuugcuuuu

SEQ ID NO: 7350 - RNA, 18 nt, artificial
  Chemically synthesized
acugcguuccgacaggca

SEQ ID NO: 7351 - RNA, 18 nt, artificial
  Chemically synthesized
augacgcgcuguaggauu

SEQ ID NO: 7352 - RNA, 18 nt, artificial
  Chemically synthesized
cucggcugucuggauggg

SEQ ID NO: 7353 - RNA, 18 nt, artificial
  Chemically synthesized
cuccagaacgcaggugcu

SEQ ID NO: 7354 - RNA, 18 nt, artificial
  Chemically synthesized
uuuacaggaaggugacuu

SEQ ID NO: 7355 - RNA, 18 nt, artificial
  Chemically synthesized
ggcggugugcugccuguc

SEQ ID NO: 7356 - RNA, 18 nt, artificial
  Chemically synthesized
accuccagaacgcaggug

SEQ ID NO: 7357 - RNA, 18 nt, artificial
  Chemically synthesized
gcggugugcugccugucg

SEQ ID NO: 7358 - RNA, 18 nt, artificial
  Chemically synthesized
gcacucagcuuagccagg

SEQ ID NO: 7359 - RNA, 18 nt, artificial
  Chemically synthesized
ccggugcgcggcugcuac

SEQ ID NO: 7360 - RNA, 18 nt, artificial
  Chemically synthesized
ggcugcuacgaggcggug

SEQ ID NO: 7361 - RNA, 18 nt, artificial
  Chemically synthesized
gaggcggugugcugccug

SEQ ID NO: 7362 - RNA, 18 nt, artificial
  Chemically synthesized
acagcgcgucaucgacua

SEQ ID NO: 7363 - RNA, 18 nt, artificial
  Chemically synthesized
cgcggcugcuacgaggcg

SEQ ID NO: 7364 - RNA, 18 nt, artificial
  Chemically synthesized
gaaggcgcugagcccggu

SEQ ID NO: 7365 - RNA, 18 nt, artificial
  Chemically synthesized
aggugcuggcgcccguuc

SEQ ID NO: 7366 - RNA, 18 nt, artificial
  Chemically synthesized
gcaggugcuggcgcccgu

SEQ ID NO: 7367 - RNA, 18 nt, artificial
  Chemically synthesized
uuuuuuacaggaagguga

SEQ ID NO: 7368 - RNA, 18 nt, artificial
  Chemically synthesized
uacaggaaggugacuuuc

SEQ ID NO: 7369 - RNA, 18 nt, artificial
  Chemically synthesized
ugaaggcgcugagcccgg

SEQ ID NO: 7370 - RNA, 18 nt, artificial
  Chemically synthesized
uccagaacgcaggugcug

SEQ ID NO: 7371 - RNA, 18 nt, artificial
  Chemically synthesized
acucagcuuagccaggug

SEQ ID NO: 7372 - RNA, 18 nt, artificial
  Chemically synthesized
agaacgcaggugcuggcg

SEQ ID NO: 7373 - RNA, 18 nt, artificial
  Chemically synthesized
agaggcacucagcuuagc

SEQ ID NO: 7374 - RNA, 18 nt, artificial
  Chemically synthesized
gugcugccugucggaacg

SEQ ID NO: 7375 - RNA, 18 nt, artificial
  Chemically synthesized
gcgcggcugcuacgaggc

SEQ ID NO: 7376 - RNA, 18 nt, artificial
  Chemically synthesized
cuacgaggcggugugcug

SEQ ID NO: 7377 - RNA, 18 nt, artificial
  Chemically synthesized
cuuagccagguggaaauc

SEQ ID NO: 7378 - RNA, 18 nt, artificial
  Chemically synthesized
cugcuacgaggcggugug

SEQ ID NO: 7379 - RNA, 18 nt, artificial
  Chemically synthesized
uuagccagguggaaaucc

SEQ ID NO: 7380 - RNA, 18 nt, artificial
  Chemically synthesized
uuacaggaaggugacuuu

SEQ ID NO: 7381 - RNA, 18 nt, artificial
  Chemically synthesized
aggcggugugcugccugu

SEQ ID NO: 7382 - RNA, 18 nt, artificial
  Chemically synthesized
augaaggcgcugagcccg

SEQ ID NO: 7383 - RNA, 18 nt, artificial
  Chemically synthesized
caggugcuggcgcccguu

SEQ ID NO: 7384 - RNA, 18 nt, artificial
  Chemically synthesized
cagaacgcaggugcuggc

SEQ ID NO: 7385 - RNA, 18 nt, artificial
  Chemically synthesized
ugcgcggcugcuacgagg

SEQ ID NO: 7386 - RNA, 18 nt, artificial
  Chemically synthesized
aggcgcugagcccggugc

SEQ ID NO: 7387 - RNA, 18 nt, artificial
  Chemically synthesized
cgaggcggugugcugccu

SEQ ID NO: 7388 - RNA, 18 nt, artificial
  Chemically synthesized
cggcugcuacgaggcggu

SEQ ID NO: 7389 - RNA, 18 nt, artificial
  Chemically synthesized
aaggcgcugagcccggug

SEQ ID NO: 7390 - RNA, 18 nt, artificial
  Chemically synthesized
ugagcccggugcgcggcu

SEQ ID NO: 7391 - RNA, 18 nt, artificial
  Chemically synthesized
ugcuacgaggcggugugc

SEQ ID NO: 7392 - RNA, 18 nt, artificial
  Chemically synthesized
acgcaggugcuggcgccc

SEQ ID NO: 7393 - RNA, 18 nt, artificial
  Chemically synthesized
uuuuacaggaaggugacu

SEQ ID NO: 7394 - RNA, 18 nt, artificial
  Chemically synthesized
uuuuuacaggaaggugac

SEQ ID NO: 7395 - RNA, 18 nt, artificial
  Chemically synthesized
aacgcaggugcuggcgcc

SEQ ID NO: 7396 - RNA, 18 nt, artificial
  Chemically synthesized
uacgaggcggugugcugc

SEQ ID NO: 7397 - RNA, 18 nt, artificial
  Chemically synthesized
acgaggcggugugcugcc

SEQ ID NO: 7398 - RNA, 18 nt, artificial
  Chemically synthesized
agcaccugcguucuggag

SEQ ID NO: 7399 - RNA, 18 nt, artificial
  Chemically synthesized
aagucaccuuccuguaaa

SEQ ID NO: 7400 - RNA, 18 nt, artificial
  Chemically synthesized
gacaggcagcacaccgcc

SEQ ID NO: 7401 - RNA, 18 nt, artificial
  Chemically synthesized
caccugcguucuggaggu

SEQ ID NO: 7402 - RNA, 18 nt, artificial
  Chemically synthesized
cgacaggcagcacaccgc

SEQ ID NO: 7403 - RNA, 18 nt, artificial
  Chemically synthesized
ccuggcuaagcugagugc

SEQ ID NO: 7404 - RNA, 18 nt, artificial
  Chemically synthesized
guagcagccgcgcaccgg

SEQ ID NO: 7405 - RNA, 18 nt, artificial
  Chemically synthesized
caccgccucguagcagcc

SEQ ID NO: 7406 - RNA, 18 nt, artificial
  Chemically synthesized
caggcagcacaccgccuc

SEQ ID NO: 7407 - RNA, 18 nt, artificial
  Chemically synthesized
uagucgaugacgcgcugu

SEQ ID NO: 7408 - RNA, 18 nt, artificial
  Chemically synthesized
cgccucguagcagccgcg

SEQ ID NO: 7409 - RNA, 18 nt, artificial
  Chemically synthesized
accgggcucagcgccuuc

SEQ ID NO: 7410 - RNA, 18 nt, artificial
  Chemically synthesized
gaacgggcgccagcaccu

SEQ ID NO: 7411 - RNA, 18 nt, artificial
  Chemically synthesized
acgggcgccagcaccugc

SEQ ID NO: 7412 - RNA, 18 nt, artificial
  Chemically synthesized
ucaccuuccuguaaaaaa

SEQ ID NO: 7413 - RNA, 18 nt, artificial
  Chemically synthesized
gaaagucaccuuccugua

SEQ ID NO: 7414 - RNA, 18 nt, artificial
  Chemically synthesized
ccgggcucagcgccuuca

SEQ ID NO: 7415 - RNA, 18 nt, artificial
  Chemically synthesized
cagcaccugcguucugga

SEQ ID NO: 7416 - RNA, 18 nt, artificial
  Chemically synthesized
caccuggcuaagcugagu

SEQ ID NO: 7417 - RNA, 18 nt, artificial
  Chemically synthesized
cgccagcaccugcguucu

SEQ ID NO: 7418 - RNA, 18 nt, artificial
  Chemically synthesized
gcuaagcugagugccucu

SEQ ID NO: 7419 - RNA, 18 nt, artificial
  Chemically synthesized
cguuccgacaggcagcac

SEQ ID NO: 7420 - RNA, 18 nt, artificial
  Chemically synthesized
gccucguagcagccgcgc

SEQ ID NO: 7421 - RNA, 18 nt, artificial
  Chemically synthesized
cagcacaccgccucguag

SEQ ID NO: 7422 - RNA, 18 nt, artificial
  Chemically synthesized
gauuuccaccuggcuaag

SEQ ID NO: 7423 - RNA, 18 nt, artificial
  Chemically synthesized
cacaccgccucguagcag

SEQ ID NO: 7424 - RNA, 18 nt, artificial
  Chemically synthesized
ggauuuccaccuggcuaa

SEQ ID NO: 7425 - RNA, 18 nt, artificial
  Chemically synthesized
aaagucaccuuccuguaa

SEQ ID NO: 7426 - RNA, 18 nt, artificial
  Chemically synthesized
acaggcagcacaccgccu

SEQ ID NO: 7427 - RNA, 18 nt, artificial
  Chemically synthesized
cgggcucagcgccuucau

SEQ ID NO: 7428 - RNA, 18 nt, artificial
  Chemically synthesized
aacgggcgccagcaccug

SEQ ID NO: 7429 - RNA, 18 nt, artificial
  Chemically synthesized
gccagcaccugcguucug

SEQ ID NO: 7430 - RNA, 18 nt, artificial
  Chemically synthesized
ccucguagcagccgcgca

SEQ ID NO: 7431 - RNA, 18 nt, artificial
  Chemically synthesized
gcaccgggcucagcgccu

SEQ ID NO: 7432 - RNA, 18 nt, artificial
  Chemically synthesized
aggcagcacaccgccucg

SEQ ID NO: 7433 - RNA, 18 nt, artificial
  Chemically synthesized
accgccucguagcagccg

SEQ ID NO: 7434 - RNA, 18 nt, artificial
  Chemically synthesized
caccgggcucagcgccuu

SEQ ID NO: 7435 - RNA, 18 nt, artificial
  Chemically synthesized
agccgcgcaccgggcuca

SEQ ID NO: 7436 - RNA, 18 nt, artificial
  Chemically synthesized
gcacaccgccucguagca

SEQ ID NO: 7437 - RNA, 18 nt, artificial
  Chemically synthesized
gggcgccagcaccugcgu

SEQ ID NO: 7438 - RNA, 18 nt, artificial
  Chemically synthesized
agucaccuuccuguaaaa

SEQ ID NO: 7439 - RNA, 18 nt, artificial
  Chemically synthesized
gucaccuuccuguaaaaa

SEQ ID NO: 7440 - RNA, 18 nt, artificial
  Chemically synthesized
ggcgccagcaccugcguu

SEQ ID NO: 7441 - RNA, 18 nt, artificial
  Chemically synthesized
gcagcacaccgccucgua

SEQ ID NO: 7442 - RNA, 18 nt, Artificial Sequence
  Chemically synthesized
ggcagcacaccgccucgu

SEQ ID NO: 7443 - RNA, 19 nt, artificial
  Chemically synthesized
agacaauauacaagccaaa

SEQ ID NO: 7444 - RNA, 19 nt, artificial
  Chemically synthesized
cagaagacgucaaacguaa

SEQ ID NO: 7445 - RNA, 19 nt, artificial
  Chemically synthesized
ggagaaagaugucaaacgu

SEQ ID NO: 7446 - RNA, 19 nt, artificial
  Chemically synthesized
cgcauuugguggacccaaa

SEQ ID NO: 7447 - RNA, 19 nt, artificial
  Chemically synthesized
ccgggagaaagaugucaaa

SEQ ID NO: 7448 - RNA, 19 nt, artificial
  Chemically synthesized
ggcuaaagauaauugcuau

SEQ ID NO: 7449 - RNA, 19 nt, artificial
  Chemically synthesized
ggaaggguuugaauuguuu

SEQ ID NO: 7450 - RNA, 19 nt, artificial
  Chemically synthesized
ccuuuuauguagcacauaa

SEQ ID NO: 7451 - RNA, 19 nt, artificial
  Chemically synthesized
caaggaagguucauguaga

SEQ ID NO: 7452 - RNA, 19 nt, artificial
  Chemically synthesized
ggauguagcauuaugcaau

SEQ ID NO: 7453 - RNA, 19 nt, artificial
  Chemically synthesized
ugcuguguuggguagaaua

SEQ ID NO: 7454 - RNA, 19 nt, artificial
  Chemically synthesized
gcauguggcuuuuuuaaaa

SEQ ID NO: 7455 - RNA, 19 nt, artificial
  Chemically synthesized
gauucuucuacucaaaaca

SEQ ID NO: 7456 - RNA, 19 nt, artificial
  Chemically synthesized
gcauacugagccaaguaua

SEQ ID NO: 7457 - RNA, 19 nt, artificial
  Chemically synthesized
ggugcuugggaguuuugaa

SEQ ID NO: 7458 - RNA, 19 nt, artificial
  Chemically synthesized
cgauuuucagaaucacaaa

SEQ ID NO: 7459 - RNA, 19 nt, artificial
  Chemically synthesized
gcauuaugcaauuagguuu

SEQ ID NO: 7460 - RNA, 19 nt, artificial
  Chemically synthesized
ggguuugaauuguuuucuu

SEQ ID NO: 7461 - RNA, 19 nt, artificial
  Chemically synthesized
uagacaauauacaagccaa

SEQ ID NO: 7462 - RNA, 19 nt, artificial
  Chemically synthesized
gcuucauuguacuaccugu

SEQ ID NO: 7463 - RNA, 19 nt, artificial
  Chemically synthesized
cauacugagccaaguauaa

SEQ ID NO: 7464 - RNA, 19 nt, artificial
  Chemically synthesized
gguaugaagagcuugcuuu

SEQ ID NO: 7465 - RNA, 19 nt, artificial
  Chemically synthesized
cuuucagagacagcugaua

SEQ ID NO: 7466 - RNA, 19 nt, artificial
  Chemically synthesized
cccuuucagagacagcuga

SEQ ID NO: 7467 - RNA, 19 nt, artificial
  Chemically synthesized
gguuuuuccuuauuugcuu

SEQ ID NO: 7468 - RNA, 19 nt, artificial
  Chemically synthesized
gauguagcauuaugcaauu

SEQ ID NO: 7469 - RNA, 19 nt, artificial
  Chemically synthesized
gcugcauguggcuuuuuua

SEQ ID NO: 7470 - RNA, 19 nt, artificial
  Chemically synthesized
agagaaaagcacacuugua

SEQ ID NO: 7471 - RNA, 19 nt, artificial
  Chemically synthesized
cuaccuguguauauaguuu

SEQ ID NO: 7472 - RNA, 19 nt, artificial
  Chemically synthesized
gcaaguggaauuucgauuu

SEQ ID NO: 7473 - RNA, 19 nt, artificial
  Chemically synthesized
aacaaaagagccaacagaa

SEQ ID NO: 7474 - RNA, 19 nt, artificial
  Chemically synthesized
ccuuauuugcuucauugua

SEQ ID NO: 7475 - RNA, 19 nt, artificial
  Chemically synthesized
gcaauuagguuuuuccuua

SEQ ID NO: 7476 - RNA, 19 nt, artificial
  Chemically synthesized
gagacagcugauacuucau

SEQ ID NO: 7477 - RNA, 19 nt, artificial
  Chemically synthesized
cgugcagacccgggagaaa

SEQ ID NO: 7478 - RNA, 19 nt, artificial
  Chemically synthesized
gggagaaagaugucaaacg

SEQ ID NO: 7479 - RNA, 19 nt, artificial
  Chemically synthesized
guguaaacacagucaaaau

SEQ ID NO: 7480 - RNA, 19 nt, artificial
  Chemically synthesized
agaagacgucaaacguaaa

SEQ ID NO: 7481 - RNA, 19 nt, artificial
  Chemically synthesized
cuguauaagcacugaaaaa

SEQ ID NO: 7482 - RNA, 19 nt, artificial
  Chemically synthesized
cccgggagaaagaugucaa

SEQ ID NO: 7483 - RNA, 19 nt, artificial
  Chemically synthesized
cuguguaaacacagucaaa

SEQ ID NO: 7484 - RNA, 19 nt, artificial
  Chemically synthesized
cuguguacauaacucugua

SEQ ID NO: 7485 - RNA, 19 nt, artificial
  Chemically synthesized
cgguuuuguuuuuuugaga

SEQ ID NO: 7486 - RNA, 19 nt, artificial
  Chemically synthesized
ccuuucagagacagcugau

SEQ ID NO: 7487 - RNA, 19 nt, artificial
  Chemically synthesized
ccauauugggccacuaaaa

SEQ ID NO: 7488 - RNA, 19 nt, artificial
  Chemically synthesized
cucaaaacaaaagagccaa

SEQ ID NO: 7489 - RNA, 19 nt, artificial
  Chemically synthesized
gaaggguuugaauuguuuu

SEQ ID NO: 7490 - RNA, 19 nt, artificial
  Chemically synthesized
aguguaccuguguacauaa

SEQ ID NO: 7491 - RNA, 19 nt, artificial
  Chemically synthesized
cacuuguaggauaagugaa

SEQ ID NO: 7492 - RNA, 19 nt, artificial
  Chemically synthesized
ccuuguuuaucagauacau

SEQ ID NO: 7493 - RNA, 19 nt, artificial
  Chemically synthesized
cauuguacuaccuguguau

SEQ ID NO: 7494 - RNA, 19 nt, artificial
  Chemically synthesized
ggcuaugcuuaaaagguug

SEQ ID NO: 7495 - RNA, 19 nt, artificial
  Chemically synthesized
gacagcugauacuucauuu

SEQ ID NO: 7496 - RNA, 19 nt, artificial
  Chemically synthesized
gccaauuauuguuacacau

SEQ ID NO: 7497 - RNA, 19 nt, artificial
  Chemically synthesized
cugaaaaacaacaacacaa

SEQ ID NO: 7498 - RNA, 19 nt, artificial
  Chemically synthesized
gcucgaauuaagaauaugu

SEQ ID NO: 7499 - RNA, 19 nt, artificial
  Chemically synthesized
cucucuuaaaguuggaauu

SEQ ID NO: 7500 - RNA, 19 nt, artificial
  Chemically synthesized
aagguucauguagagaaaa

SEQ ID NO: 7501 - RNA, 19 nt, artificial
  Chemically synthesized
agaucuguaaguaacuuca

SEQ ID NO: 7502 - RNA, 19 nt, artificial
  Chemically synthesized
aguuaauuacucagcagaa

SEQ ID NO: 7503 - RNA, 19 nt, artificial
  Chemically synthesized
gugcgagugucuaacggga

SEQ ID NO: 7504 - RNA, 19 nt, artificial
  Chemically synthesized
aguggaauuucgauuuuca

SEQ ID NO: 7505 - RNA, 19 nt, artificial
  Chemically synthesized
cucuguaaaaacacugaaa

SEQ ID NO: 7506 - RNA, 19 nt, artificial
  Chemically synthesized
cauguuuugugcauuugua

SEQ ID NO: 7507 - RNA, 19 nt, artificial
  Chemically synthesized
ccuguauaagcacugaaaa

SEQ ID NO: 7508 - RNA, 19 nt, artificial
  Chemically synthesized
cccgcucgccaguccauuu

SEQ ID NO: 7509 - RNA, 19 nt, artificial
  Chemically synthesized
gggcaaguacgaguggcaa

SEQ ID NO: 7510 - RNA, 19 nt, artificial
  Chemically synthesized
cccgggacuuggagaagca

SEQ ID NO: 7511 - RNA, 19 nt, artificial
  Chemically synthesized
gguggagaagggcagcuug

SEQ ID NO: 7512 - RNA, 19 nt, artificial
  Chemically synthesized
gcccuagccuggagcggau

SEQ ID NO: 7513 - RNA, 19 nt, artificial
  Chemically synthesized
agccagcgcaaguggaauu

SEQ ID NO: 7514 - RNA, 19 nt, artificial
  Chemically synthesized
ccugcaaggugccggcgca

SEQ ID NO: 7515 - RNA, 19 nt, artificial
  Chemically synthesized
uugacuugcaugaagagaa

SEQ ID NO: 7516 - RNA, 19 nt, artificial
  Chemically synthesized
cgguggaccacgaagaguu

SEQ ID NO: 7517 - RNA, 19 nt, artificial
  Chemically synthesized
cuguaaguaacuucacauu

SEQ ID NO: 7518 - RNA, 19 nt, artificial
  Chemically synthesized
gcucgccaguccauuugau

SEQ ID NO: 7519 - RNA, 19 nt, artificial
  Chemically synthesized
ugcagacccgggagaaaga

SEQ ID NO: 7520 - RNA, 19 nt, artificial
  Chemically synthesized
guucauguagagaaaagca

SEQ ID NO: 7521 - RNA, 19 nt, artificial
  Chemically synthesized
ggguaugaagagcuugcuu

SEQ ID NO: 7522 - RNA, 19 nt, artificial
  Chemically synthesized
cccuagagggcaaguacga

SEQ ID NO: 7523 - RNA, 19 nt, artificial
  Chemically synthesized
cuugcaugaagagaagcaa

SEQ ID NO: 7524 - RNA, 19 nt, artificial
  Chemically synthesized
agccaaaguggcauguuuu

SEQ ID NO: 7525 - RNA, 19 nt, artificial
  Chemically synthesized
ggcuguguaaacacaguca

SEQ ID NO: 7526 - RNA, 19 nt, artificial
  Chemically synthesized
agaaaacuuccauagcuau

SEQ ID NO: 7527 - RNA, 19 nt, artificial
  Chemically synthesized
gauccgucggacagccaga

SEQ ID NO: 7528 - RNA, 19 nt, artificial
  Chemically synthesized
gcuuugauuuacagcaagu

SEQ ID NO: 7529 - RNA, 19 nt, artificial
  Chemically synthesized
guguauggaaaaaccauuu

SEQ ID NO: 7530 - RNA, 19 nt, artificial
  Chemically synthesized
cgcucgccaguccauuuga

SEQ ID NO: 7531 - RNA, 19 nt, artificial
  Chemically synthesized
cgccggcaagguuuggaga

SEQ ID NO: 7532 - RNA, 19 nt, artificial
  Chemically synthesized
guauaagcacugaaaaaca

SEQ ID NO: 7533 - RNA, 19 nt, artificial
  Chemically synthesized
gguggacccaaagacugau

SEQ ID NO: 7534 - RNA, 19 nt, artificial
  Chemically synthesized
guuggguagaauagguuuu

SEQ ID NO: 7535 - RNA, 19 nt, artificial
  Chemically synthesized
agcgcaaguggaauuucga

SEQ ID NO: 7536 - RNA, 19 nt, artificial
  Chemically synthesized
ggcgcaggagagccaggau

SEQ ID NO: 7537 - RNA, 19 nt, artificial
  Chemically synthesized
cugcauguggcuuuuuuaa

SEQ ID NO: 7538 - RNA, 19 nt, artificial
  Chemically synthesized
ggagcagacgcccaagaag

SEQ ID NO: 7539 - RNA, 19 nt, artificial
  Chemically synthesized
gggacuuggagaagcacug

SEQ ID NO: 7540 - RNA, 19 nt, artificial
  Chemically synthesized
gaauguuaagaauugacca

SEQ ID NO: 7541 - RNA, 19 nt, artificial
  Chemically synthesized
agauguaaugucccuuuca

SEQ ID NO: 7542 - RNA, 19 nt, artificial
  Chemically synthesized
ggcaaaaauccgaggugcu

SEQ ID NO: 7543 - RNA, 19 nt, artificial
  Chemically synthesized
gcuuuguuuuguucgguuu

SEQ ID NO: 7544 - RNA, 19 nt, artificial
  Chemically synthesized
acgauucuucuacucaaaa

SEQ ID NO: 7545 - RNA, 19 nt, artificial
  Chemically synthesized
aaaugaucugccucuaaaa

SEQ ID NO: 7546 - RNA, 19 nt, artificial
  Chemically synthesized
ugcaugaagagaagcaauu

SEQ ID NO: 7547 - RNA, 19 nt, artificial
  Chemically synthesized
cgauucuucuacucaaaac

SEQ ID NO: 7548 - RNA, 19 nt, artificial
  Chemically synthesized
ugggaguuuugaauguuaa

SEQ ID NO: 7549 - RNA, 19 nt, artificial
  Chemically synthesized
acugcagagacauggaaga

SEQ ID NO: 7550 - RNA, 19 nt, artificial
  Chemically synthesized
acagcugauacuucauuua

SEQ ID NO: 7551 - RNA, 19 nt, artificial
  Chemically synthesized
agcacugcagagacaugga

SEQ ID NO: 7552 - RNA, 19 nt, artificial
  Chemically synthesized
cgaggugcuugggaguuuu

SEQ ID NO: 7553 - RNA, 19 nt, artificial
  Chemically synthesized
gguuuuguuuuuuugagag

SEQ ID NO: 7554 - RNA, 19 nt, artificial
  Chemically synthesized
caguuaauuacucagcaga

SEQ ID NO: 7555 - RNA, 19 nt, artificial
  Chemically synthesized
aguuuauucucauuuggga

SEQ ID NO: 7556 - RNA, 19 nt, artificial
  Chemically synthesized
ccggcuaacucugaggaca

SEQ ID NO: 7557 - RNA, 19 nt, artificial
  Chemically synthesized
gcgcaaguggaauuucgau

SEQ ID NO: 7558 - RNA, 19 nt, artificial
  Chemically synthesized
aggauaagugaaauggaua

SEQ ID NO: 7559 - RNA, 19 nt, artificial
  Chemically synthesized
aguggcaagagguggagaa

SEQ ID NO: 7560 - RNA, 19 nt, artificial
  Chemically synthesized
aagaaaacuuccauagcua

SEQ ID NO: 7561 - RNA, 19 nt, artificial
  Chemically synthesized
uguuggguagaauagguuu

SEQ ID NO: 7562 - RNA, 19 nt, artificial
  Chemically synthesized
aagccaaaguggcauguuu

SEQ ID NO: 7563 - RNA, 19 nt, artificial
  Chemically synthesized
caugaagagaagcaauuuu

SEQ ID NO: 7564 - RNA, 19 nt, artificial
  Chemically synthesized
uacugagccaaguauaauu

SEQ ID NO: 7565 - RNA, 19 nt, artificial
  Chemically synthesized
cgcaaguggaauuucgauu

SEQ ID NO: 7566 - RNA, 19 nt, artificial
  Chemically synthesized
acuuguaggauaagugaaa

SEQ ID NO: 7567 - RNA, 19 nt, artificial
  Chemically synthesized
uguguacauaacucuguaa

SEQ ID NO: 7568 - RNA, 19 nt, artificial
  Chemically synthesized
agguucauguagagaaaag

SEQ ID NO: 7569 - RNA, 19 nt, artificial
  Chemically synthesized
gcuugaugaagcaaggaag

SEQ ID NO: 7570 - RNA, 19 nt, artificial
  Chemically synthesized
ucauguagagaaaagcaca

SEQ ID NO: 7571 - RNA, 19 nt, artificial
  Chemically synthesized
ugaccaucugcuuuuauua

SEQ ID NO: 7572 - RNA, 19 nt, artificial
  Chemically synthesized
ggagaagcacugcagagac

SEQ ID NO: 7573 - RNA, 19 nt, artificial
  Chemically synthesized
cucuguccauuuauccaca

SEQ ID NO: 7574 - RNA, 19 nt, artificial
  Chemically synthesized
cauugccuguguauggaaa

SEQ ID NO: 7575 - RNA, 19 nt, artificial
  Chemically synthesized
cuugaugaagcaaggaaga

SEQ ID NO: 7576 - RNA, 19 nt, artificial
  Chemically synthesized
gcuuacucuguccauuuau

SEQ ID NO: 7577 - RNA, 19 nt, artificial
  Chemically synthesized
gauuuacagcaaguagaua

SEQ ID NO: 7578 - RNA, 19 nt, artificial
  Chemically synthesized
cgccauauugggccacuaa

SEQ ID NO: 7579 - RNA, 19 nt, artificial
  Chemically synthesized
aaauuugaacacuggcuaa

SEQ ID NO: 7580 - RNA, 19 nt, artificial
  Chemically synthesized
guugcauacugagccaagu

SEQ ID NO: 7581 - RNA, 19 nt, artificial
  Chemically synthesized
ucgccaguccauuugauca

SEQ ID NO: 7582 - RNA, 19 nt, artificial
  Chemically synthesized
gugaaaaagaugccaauua

SEQ ID NO: 7583 - RNA, 19 nt, artificial
  Chemically synthesized
uggcuaugcuuaaaagguu

SEQ ID NO: 7584 - RNA, 19 nt, artificial
  Chemically synthesized
gccauauugggccacuaaa

SEQ ID NO: 7585 - RNA, 19 nt, artificial
  Chemically synthesized
cacaaaaauuugaacacug

SEQ ID NO: 7586 - RNA, 19 nt, artificial
  Chemically synthesized
cuguggagcagacgcccaa

SEQ ID NO: 7587 - RNA, 19 nt, artificial
  Chemically synthesized
cucuaaaagcguuggaugu

SEQ ID NO: 7588 - RNA, 19 nt, artificial
  Chemically synthesized
guguuggguagaauagguu

SEQ ID NO: 7589 - RNA, 19 nt, artificial
  Chemically synthesized
uguguuggguagaauaggu

SEQ ID NO: 7590 - RNA, 19 nt, artificial
  Chemically synthesized
guauggaaaaaccauuuga

SEQ ID NO: 7591 - RNA, 19 nt, artificial
  Chemically synthesized
ccgacgauucuucuacuca

SEQ ID NO: 7592 - RNA, 19 nt, artificial
  Chemically synthesized
cuuugauuuacagcaagua

SEQ ID NO: 7593 - RNA, 19 nt, artificial
  Chemically synthesized
cguaaacagcucgaauuaa

SEQ ID NO: 7594 - RNA, 19 nt, artificial
  Chemically synthesized
cuguguauggaaaaaccau

SEQ ID NO: 7595 - RNA, 19 nt, artificial
  Chemically synthesized
agugaaauggauacuacau

SEQ ID NO: 7596 - RNA, 19 nt, artificial
  Chemically synthesized
gaagagcuugcuuugauuu

SEQ ID NO: 7597 - RNA, 19 nt, artificial
  Chemically synthesized
ucagaagacgucaaacgua

SEQ ID NO: 7598 - RNA, 19 nt, artificial
  Chemically synthesized
gagccagcgcaaguggaau

SEQ ID NO: 7599 - RNA, 19 nt, artificial
  Chemically synthesized
caagguuuggagagcggcu

SEQ ID NO: 7600 - RNA, 19 nt, artificial
  Chemically synthesized
aucuguaaguaacuucaca

SEQ ID NO: 7601 - RNA, 19 nt, artificial
  Chemically synthesized
uggacauccuguauaagca

SEQ ID NO: 7602 - RNA, 19 nt, artificial
  Chemically synthesized
gcuguguaaacacagucaa

SEQ ID NO: 7603 - RNA, 19 nt, artificial
  Chemically synthesized
caagcuaucuaaaguuugu

SEQ ID NO: 7604 - RNA, 19 nt, artificial
  Chemically synthesized
ggcaaguacgaguggcaag

SEQ ID NO: 7605 - RNA, 19 nt, artificial
  Chemically synthesized
cccgaguucuacuacagac

SEQ ID NO: 7606 - RNA, 19 nt, artificial
  Chemically synthesized
gagacauggaagaggcgag

SEQ ID NO: 7607 - RNA, 19 nt, artificial
  Chemically synthesized
uggccucagaagacgucaa

SEQ ID NO: 7608 - RNA, 19 nt, artificial
  Chemically synthesized
gcacugaaaaacaacaaca

SEQ ID NO: 7609 - RNA, 19 nt, artificial
  Chemically synthesized
aguccauuugaucagcgga

SEQ ID NO: 7610 - RNA, 19 nt, artificial
  Chemically synthesized
uguguauggaaaaaccauu

SEQ ID NO: 7611 - RNA, 19 nt, artificial
  Chemically synthesized
cagauacaucacugcuuga

SEQ ID NO: 7612 - RNA, 19 nt, artificial
  Chemically synthesized
gggucugugucuuuuggcu

SEQ ID NO: 7613 - RNA, 19 nt, artificial
  Chemically synthesized
gcgacuccgacgccggcaa

SEQ ID NO: 7614 - RNA, 19 nt, artificial
  Chemically synthesized
ggaguuuugaauguuaaga

SEQ ID NO: 7615 - RNA, 19 nt, artificial
  Chemically synthesized
ccuguguauggaaaaacca

SEQ ID NO: 7616 - RNA, 19 nt, artificial
  Chemically synthesized
cuuaaaugaucugccucua

SEQ ID NO: 7617 - RNA, 19 nt, artificial
  Chemically synthesized
uguuuuuuugagagugcga

SEQ ID NO: 7618 - RNA, 19 nt, artificial
  Chemically synthesized
uccauuugaucagcggaga

SEQ ID NO: 7619 - RNA, 19 nt, artificial
  Chemically synthesized
auucuaaaucccucgauau

SEQ ID NO: 7620 - RNA, 19 nt, artificial
  Chemically synthesized
cuuggagaagcacugcaga

SEQ ID NO: 7621 - RNA, 19 nt, artificial
  Chemically synthesized
aagcguuggauguagcauu

SEQ ID NO: 7622 - RNA, 19 nt, artificial
  Chemically synthesized
cucccuuccaccgccauau

SEQ ID NO: 7623 - RNA, 19 nt, artificial
  Chemically synthesized
ugguggacccaaagacuga

SEQ ID NO: 7624 - RNA, 19 nt, artificial
  Chemically synthesized
guuuccuuguuuaucagau

SEQ ID NO: 7625 - RNA, 19 nt, artificial
  Chemically synthesized
gguucauguagagaaaagc

SEQ ID NO: 7626 - RNA, 19 nt, artificial
  Chemically synthesized
cccucgauauuuuuaaaga

SEQ ID NO: 7627 - RNA, 19 nt, artificial
  Chemically synthesized
gcuugggaguuuugaaugu

SEQ ID NO: 7628 - RNA, 19 nt, artificial
  Chemically synthesized
cgcaggagagccaggaugu

SEQ ID NO: 7629 - RNA, 19 nt, artificial
  Chemically synthesized
gcccgaguucuacuacaga

SEQ ID NO: 7630 - RNA, 19 nt, artificial
  Chemically synthesized
cuaaaucccucgauauuuu

SEQ ID NO: 7631 - RNA, 19 nt, artificial
  Chemically synthesized
cuugcuuugauuuacagca

SEQ ID NO: 7632 - RNA, 19 nt, artificial
  Chemically synthesized
ccgccauauugggccacua

SEQ ID NO: 7633 - RNA, 19 nt, artificial
  Chemically synthesized
agacccgggagaaagaugu

SEQ ID NO: 7634 - RNA, 19 nt, artificial
  Chemically synthesized
gugugaaaaagaugccaau

SEQ ID NO: 7635 - RNA, 19 nt, artificial
  Chemically synthesized
agaauugaccaucugcuuu

SEQ ID NO: 7636 - RNA, 19 nt, artificial
  Chemically synthesized
agaagcacugcagagacau

SEQ ID NO: 7637 - RNA, 19 nt, artificial
  Chemically synthesized
gauagcugcauguggcuuu

SEQ ID NO: 7638 - RNA, 19 nt, artificial
  Chemically synthesized
cauuugaucagcggagacu

SEQ ID NO: 7639 - RNA, 19 nt, artificial
  Chemically synthesized
ugauuuacagcaaguagau

SEQ ID NO: 7640 - RNA, 19 nt, artificial
  Chemically synthesized
cuccgacgccggcaagguu

SEQ ID NO: 7641 - RNA, 19 nt, artificial
  Chemically synthesized
agguugcauacugagccaa

SEQ ID NO: 7642 - RNA, 19 nt, artificial
  Chemically synthesized
ucauuguacuaccugugua

SEQ ID NO: 7643 - RNA, 19 nt, artificial
  Chemically synthesized
gguugcauacugagccaag

SEQ ID NO: 7644 - RNA, 19 nt, artificial
  Chemically synthesized
cgggacuuggagaagcacu

SEQ ID NO: 7645 - RNA, 19 nt, artificial
  Chemically synthesized
agaagaaaauguuucagac

SEQ ID NO: 7646 - RNA, 19 nt, artificial
  Chemically synthesized
gcuguguuggguagaauag

SEQ ID NO: 7647 - RNA, 19 nt, artificial
  Chemically synthesized
auacaucacugcuugauga

SEQ ID NO: 7648 - RNA, 19 nt, artificial
  Chemically synthesized
aaugcuguguuggguagaa

SEQ ID NO: 7649 - RNA, 19 nt, artificial
  Chemically synthesized
ccugcaaccgacgauucuu

SEQ ID NO: 7650 - RNA, 19 nt, artificial
  Chemically synthesized
gcaggaauaaggaagcgac

SEQ ID NO: 7651 - RNA, 19 nt, artificial
  Chemically synthesized
gcguuggauguagcauuau

SEQ ID NO: 7652 - RNA, 19 nt, artificial
  Chemically synthesized
ccgaguucuacuacagacc

SEQ ID NO: 7653 - RNA, 19 nt, artificial
  Chemically synthesized
agggcaaguacgaguggca

SEQ ID NO: 7654 - RNA, 19 nt, artificial
  Chemically synthesized
uguguaaacacagucaaaa

SEQ ID NO: 7655 - RNA, 19 nt, artificial
  Chemically synthesized
gaaaacuuccauagcuauu

SEQ ID NO: 7656 - RNA, 19 nt, artificial
  Chemically synthesized
agaugucaaacgugcgagu

SEQ ID NO: 7657 - RNA, 19 nt, artificial
  Chemically synthesized
gucccuuucagagacagcu

SEQ ID NO: 7658 - RNA, 19 nt, artificial
  Chemically synthesized
uggugaucucccaagcuau

SEQ ID NO: 7659 - RNA, 19 nt, artificial
  Chemically synthesized
uggauguagcauuaugcaa

SEQ ID NO: 7660 - RNA, 19 nt, artificial
  Chemically synthesized
guguacauaacucuguaaa

SEQ ID NO: 7661 - RNA, 19 nt, artificial
  Chemically synthesized
caaagacugauccgucgga

SEQ ID NO: 7662 - RNA, 19 nt, artificial
  Chemically synthesized
auguaaugucccuuucaga

SEQ ID NO: 7663 - RNA, 19 nt, artificial
  Chemically synthesized
gugcauuuguaaaugcugu

SEQ ID NO: 7664 - RNA, 19 nt, artificial
  Chemically synthesized
cguuggauguagcauuaug

SEQ ID NO: 7665 - RNA, 19 nt, artificial
  Chemically synthesized
cggagcaaugcgcaggaau

SEQ ID NO: 7666 - RNA, 19 nt, artificial
  Chemically synthesized
agcugcauguggcuuuuuu

SEQ ID NO: 7667 - RNA, 19 nt, artificial
  Chemically synthesized
agguggagaagggcagcuu

SEQ ID NO: 7668 - RNA, 19 nt, artificial
  Chemically synthesized
cuuguaggauaagugaaau

SEQ ID NO: 7669 - RNA, 19 nt, artificial
  Chemically synthesized
cucagaagacgucaaacgu

SEQ ID NO: 7670 - RNA, 19 nt, artificial
  Chemically synthesized
gugcuugggaguuuugaau

SEQ ID NO: 7671 - RNA, 19 nt, artificial
  Chemically synthesized
ccucccuuccaccgccaua

SEQ ID NO: 7672 - RNA, 19 nt, artificial
  Chemically synthesized
cuucuacucaaaacaaaag

SEQ ID NO: 7673 - RNA, 19 nt, artificial
  Chemically synthesized
cagaagaaaauguuucaga

SEQ ID NO: 7674 - RNA, 19 nt, artificial
  Chemically synthesized
aaguguaccuguguacaua

SEQ ID NO: 7675 - RNA, 19 nt, artificial
  Chemically synthesized
gacuuggagaagcacugca

SEQ ID NO: 7676 - RNA, 19 nt, artificial
  Chemically synthesized
ggauaagugaaauggauac

SEQ ID NO: 7677 - RNA, 19 nt, artificial
  Chemically synthesized
aguauuucauugccugugu

SEQ ID NO: 7678 - RNA, 19 nt, artificial
  Chemically synthesized
gacuucauggaauggacau

SEQ ID NO: 7679 - RNA, 19 nt, artificial
  Chemically synthesized
agcauuaugcaauuagguu

SEQ ID NO: 7680 - RNA, 19 nt, artificial
  Chemically synthesized
aaguuggaauuuaccaguu

SEQ ID NO: 7681 - RNA, 19 nt, artificial
  Chemically synthesized
ugcuugaugaagcaaggaa

SEQ ID NO: 7682 - RNA, 19 nt, artificial
  Chemically synthesized
ccauuugaaguguaccugu

SEQ ID NO: 7683 - RNA, 19 nt, artificial
  Chemically synthesized
aaacaaaagagccaacaga

SEQ ID NO: 7684 - RNA, 19 nt, artificial
  Chemically synthesized
ggcuccgagggcagucgcu

SEQ ID NO: 7685 - RNA, 19 nt, artificial
  Chemically synthesized
guaaaugcuguguugggua

SEQ ID NO: 7686 - RNA, 19 nt, artificial
  Chemically synthesized
ugacuugcaugaagagaag

SEQ ID NO: 7687 - RNA, 19 nt, artificial
  Chemically synthesized
caagagguggagaagggca

SEQ ID NO: 7688 - RNA, 19 nt, artificial
  Chemically synthesized
gucaaacgugcgagugucu

SEQ ID NO: 7689 - RNA, 19 nt, artificial
  Chemically synthesized
augcuuaaaagguugcaua

SEQ ID NO: 7690 - RNA, 19 nt, artificial
  Chemically synthesized
cagaacagaagaaaauguu

SEQ ID NO: 7691 - RNA, 19 nt, artificial
  Chemically synthesized
gccuguguauggaaaaacc

SEQ ID NO: 7692 - RNA, 19 nt, artificial
  Chemically synthesized
ggaagcgaccugcaaccga

SEQ ID NO: 7693 - RNA, 19 nt, artificial
  Chemically synthesized
ccauuugaucagcggagac

SEQ ID NO: 7694 - RNA, 19 nt, artificial
  Chemically synthesized
gagaaagaugucaaacgug

SEQ ID NO: 7695 - RNA, 19 nt, artificial
  Chemically synthesized
cagagacagcugauacuuc

SEQ ID NO: 7696 - RNA, 19 nt, artificial
  Chemically synthesized
gcgagccagcgcaagugga

SEQ ID NO: 7697 - RNA, 19 nt, artificial
  Chemically synthesized
guggaccacgaagaguuaa

SEQ ID NO: 7698 - RNA, 19 nt, artificial
  Chemically synthesized
agcucgaauuaagaauaug

SEQ ID NO: 7699 - RNA, 19 nt, artificial
  Chemically synthesized
aucgcugacuucauggaau

SEQ ID NO: 7700 - RNA, 19 nt, artificial
  Chemically synthesized
agacagcugauacuucauu

SEQ ID NO: 7701 - RNA, 19 nt, artificial
  Chemically synthesized
agaaaauguuucagacggu

SEQ ID NO: 7702 - RNA, 19 nt, artificial
  Chemically synthesized
ggcaagagguggagaaggg

SEQ ID NO: 7703 - RNA, 19 nt, artificial
  Chemically synthesized
uccuguauaagcacugaaa

SEQ ID NO: 7704 - RNA, 19 nt, artificial
  Chemically synthesized
gaaguguaccuguguacau

SEQ ID NO: 7705 - RNA, 19 nt, artificial
  Chemically synthesized
gggaguuuugaauguuaag

SEQ ID NO: 7706 - RNA, 19 nt, artificial
  Chemically synthesized
acugagccaaguauaauuu

SEQ ID NO: 7707 - RNA, 19 nt, artificial
  Chemically synthesized
aagguugcauacugagcca

SEQ ID NO: 7708 - RNA, 19 nt, artificial
  Chemically synthesized
uguuaagaauugaccaucu

SEQ ID NO: 7709 - RNA, 19 nt, artificial
  Chemically synthesized
gcuuaaaagguugcauacu

SEQ ID NO: 7710 - RNA, 19 nt, artificial
  Chemically synthesized
gaggcgagccagcgcaagu

SEQ ID NO: 7711 - RNA, 19 nt, artificial
  Chemically synthesized
uggagaagcacugcagaga

SEQ ID NO: 7712 - RNA, 19 nt, artificial
  Chemically synthesized
ucgauuuucagaaucacaa

SEQ ID NO: 7713 - RNA, 19 nt, artificial
  Chemically synthesized
guggcauguuuugugcauu

SEQ ID NO: 7714 - RNA, 19 nt, artificial
  Chemically synthesized
aagugaaauggauacuaca

SEQ ID NO: 7715 - RNA, 19 nt, artificial
  Chemically synthesized
auggaauggacauccugua

SEQ ID NO: 7716 - RNA, 19 nt, artificial
  Chemically synthesized
cuuuguuuuguucgguuuu

SEQ ID NO: 7717 - RNA, 19 nt, artificial
  Chemically synthesized
agagcuugcuuugauuuac

SEQ ID NO: 7718 - RNA, 19 nt, artificial
  Chemically synthesized
cgaccugcaaccgacgauu

SEQ ID NO: 7719 - RNA, 19 nt, artificial
  Chemically synthesized
gcagaauggugaucacucc

SEQ ID NO: 7720 - RNA, 19 nt, artificial
  Chemically synthesized
uccgacgccggcaagguuu

SEQ ID NO: 7721 - RNA, 19 nt, artificial
  Chemically synthesized
acaacaacacaauaacacu

SEQ ID NO: 7722 - RNA, 19 nt, artificial
  Chemically synthesized
aagacugauccgucggaca

SEQ ID NO: 7723 - RNA, 19 nt, artificial
  Chemically synthesized
uggcauguuuugugcauuu

SEQ ID NO: 7724 - RNA, 19 nt, artificial
  Chemically synthesized
ggaauaaggaagcgaccug

SEQ ID NO: 7725 - RNA, 19 nt, artificial
  Chemically synthesized
gccgguucuguggagcaga

SEQ ID NO: 7726 - RNA, 19 nt, artificial
  Chemically synthesized
gaguggcaagagguggaga

SEQ ID NO: 7727 - RNA, 19 nt, artificial
  Chemically synthesized
ucuaaaucccucgauauuu

SEQ ID NO: 7728 - RNA, 19 nt, artificial
  Chemically synthesized
gaagaaaauguuucagacg

SEQ ID NO: 7729 - RNA, 19 nt, artificial
  Chemically synthesized
gcauguuuugugcauuugu

SEQ ID NO: 7730 - RNA, 19 nt, artificial
  Chemically synthesized
uguagagaaaagcacacuu

SEQ ID NO: 7731 - RNA, 19 nt, artificial
  Chemically synthesized
ugcauacugagccaaguau

SEQ ID NO: 7732 - RNA, 19 nt, artificial
  Chemically synthesized
guuuuguucgguuuuguuu

SEQ ID NO: 7733 - RNA, 19 nt, artificial
  Chemically synthesized
aagcuuacucuguccauuu

SEQ ID NO: 7734 - RNA, 19 nt, artificial
  Chemically synthesized
augcuguguuggguagaau

SEQ ID NO: 7735 - RNA, 19 nt, artificial
  Chemically synthesized
gcaaaaauccgaggugcuu

SEQ ID NO: 7736 - RNA, 19 nt, artificial
  Chemically synthesized
gcacccgcccagacucgga

SEQ ID NO: 7737 - RNA, 19 nt, artificial
  Chemically synthesized
cgggcuguguaaacacagu

SEQ ID NO: 7738 - RNA, 19 nt, artificial
  Chemically synthesized
uugcuuugauuuacagcaa

SEQ ID NO: 7739 - RNA, 19 nt, artificial
  Chemically synthesized
caaaacaaaagagccaaca

SEQ ID NO: 7740 - RNA, 19 nt, artificial
  Chemically synthesized
aaugucccuuucagagaca

SEQ ID NO: 7741 - RNA, 19 nt, artificial
  Chemically synthesized
gcagacccgggagaaagau

SEQ ID NO: 7742 - RNA, 19 nt, artificial
  Chemically synthesized
cccagacucggacgggcuu

SEQ ID NO: 7743 - RNA, 19 nt, artificial
  Chemically synthesized
gugcagacccgggagaaag

SEQ ID NO: 7744 - RNA, 19 nt, artificial
  Chemically synthesized
aagagccaacagaacagaa

SEQ ID NO: 7745 - RNA, 19 nt, artificial
  Chemically synthesized
cagaauggugaucacucca

SEQ ID NO: 7746 - RNA, 19 nt, artificial
  Chemically synthesized
ggcaagguuuggagagcgg

SEQ ID NO: 7747 - RNA, 19 nt, artificial
  Chemically synthesized
guaggauaagugaaaugga

SEQ ID NO: 7748 - RNA, 19 nt, artificial
  Chemically synthesized
gcccgguggaccacgaaga

SEQ ID NO: 7749 - RNA, 19 nt, artificial
  Chemically synthesized
cuagagggcaaguacgagu

SEQ ID NO: 7750 - RNA, 19 nt, artificial
  Chemically synthesized
gcagagacauggaagaggc

SEQ ID NO: 7751 - RNA, 19 nt, artificial
  Chemically synthesized
aagagcuugcuuugauuua

SEQ ID NO: 7752 - RNA, 19 nt, artificial
  Chemically synthesized
ccuguguacauaacucugu

SEQ ID NO: 7753 - RNA, 19 nt, artificial
  Chemically synthesized
cuugggaguuuugaauguu

SEQ ID NO: 7754 - RNA, 19 nt, artificial
  Chemically synthesized
gagaucuggugaucuccca

SEQ ID NO: 7755 - RNA, 19 nt, artificial
  Chemically synthesized
gccucagaagacgucaaac

SEQ ID NO: 7756 - RNA, 19 nt, artificial
  Chemically synthesized
aguacgaguggcaagaggu

SEQ ID NO: 7757 - RNA, 19 nt, artificial
  Chemically synthesized
uggcuaaagauaauugcua

SEQ ID NO: 7758 - RNA, 19 nt, artificial
  Chemically synthesized
accuuuuauguagcacaua

SEQ ID NO: 7759 - RNA, 19 nt, artificial
  Chemically synthesized
cugagccaaguauaauuuu

SEQ ID NO: 7760 - RNA, 19 nt, artificial
  Chemically synthesized
guuuaucagauacaucacu

SEQ ID NO: 7761 - RNA, 19 nt, artificial
  Chemically synthesized
ggaaaaaccauuugaagug

SEQ ID NO: 7762 - RNA, 19 nt, artificial
  Chemically synthesized
aaccgacgauucuucuacu

SEQ ID NO: 7763 - RNA, 19 nt, artificial
  Chemically synthesized
gccucuaaaagcguuggau

SEQ ID NO: 7764 - RNA, 19 nt, artificial
  Chemically synthesized
cccaaagacugauccgucg

SEQ ID NO: 7765 - RNA, 19 nt, artificial
  Chemically synthesized
ccagacucggacgggcuuu

SEQ ID NO: 7766 - RNA, 19 nt, artificial
  Chemically synthesized
cccggcggcgccuuuaauu

SEQ ID NO: 7767 - RNA, 19 nt, artificial
  Chemically synthesized
gacccaaagacugauccgu

SEQ ID NO: 7768 - RNA, 19 nt, artificial
  Chemically synthesized
uugcaugaagagaagcaau

SEQ ID NO: 7769 - RNA, 19 nt, artificial
  Chemically synthesized
gaagaggcgagccagcgca

SEQ ID NO: 7770 - RNA, 19 nt, artificial
  Chemically synthesized
cauggaauggacauccugu

SEQ ID NO: 7771 - RNA, 19 nt, artificial
  Chemically synthesized
agcccuagccuggagcgga

SEQ ID NO: 7772 - RNA, 19 nt, artificial
  Chemically synthesized
gccuggccucagaagacgu

SEQ ID NO: 7773 - RNA, 19 nt, artificial
  Chemically synthesized
ugccaauuauuguuacaca

SEQ ID NO: 7774 - RNA, 19 nt, artificial
  Chemically synthesized
cauauugggccacuaaaaa

SEQ ID NO: 7775 - RNA, 19 nt, artificial
  Chemically synthesized
gggcuugcacccgcccaga

SEQ ID NO: 7776 - RNA, 19 nt, artificial
  Chemically synthesized
gagcagacgcccaagaagc

SEQ ID NO: 7777 - RNA, 19 nt, artificial
  Chemically synthesized
ucagagacagcugauacuu

SEQ ID NO: 7778 - RNA, 19 nt, artificial
  Chemically synthesized
guagcauuaugcaauuagg

SEQ ID NO: 7779 - RNA, 19 nt, artificial
  Chemically synthesized
gggcaaaaauccgaggugc

SEQ ID NO: 7780 - RNA, 19 nt, artificial
  Chemically synthesized
cauccuguauaagcacuga

SEQ ID NO: 7781 - RNA, 19 nt, artificial
  Chemically synthesized
aucacugcuugaugaagca

SEQ ID NO: 7782 - RNA, 19 nt, artificial
  Chemically synthesized
guggagcagacgcccaaga

SEQ ID NO: 7783 - RNA, 19 nt, artificial
  Chemically synthesized
caggagagccaggauguca

SEQ ID NO: 7784 - RNA, 19 nt, artificial
  Chemically synthesized
gagggcagucgcugggcuu

SEQ ID NO: 7785 - RNA, 19 nt, artificial
  Chemically synthesized
aacguaaacagcucgaauu

SEQ ID NO: 7786 - RNA, 19 nt, artificial
  Chemically synthesized
uucacuucgggcuguguaa

SEQ ID NO: 7787 - RNA, 19 nt, artificial
  Chemically synthesized
cgcccggcggcgccuuuaa

SEQ ID NO: 7788 - RNA, 19 nt, artificial
  Chemically synthesized
augaagcaaggaagauaua

SEQ ID NO: 7789 - RNA, 19 nt, artificial
  Chemically synthesized
cgccaguccauuugaucag

SEQ ID NO: 7790 - RNA, 19 nt, artificial
  Chemically synthesized
guguuauuuuucaaggaag

SEQ ID NO: 7791 - RNA, 19 nt, artificial
  Chemically synthesized
aaugcgcaggaauaaggaa

SEQ ID NO: 7792 - RNA, 19 nt, artificial
  Chemically synthesized
cuagacaauauacaagcca

SEQ ID NO: 7793 - RNA, 19 nt, artificial
  Chemically synthesized
ccgacgccggcaagguuug

SEQ ID NO: 7794 - RNA, 19 nt, artificial
  Chemically synthesized
cauuugguggacccaaaga

SEQ ID NO: 7795 - RNA, 19 nt, artificial
  Chemically synthesized
acuaccuguguauauaguu

SEQ ID NO: 7796 - RNA, 19 nt, artificial
  Chemically synthesized
ugcauguggcuuuuuuaaa

SEQ ID NO: 7797 - RNA, 19 nt, artificial
  Chemically synthesized
agucgcugggcuuccgaga

SEQ ID NO: 7798 - RNA, 19 nt, artificial
  Chemically synthesized
aacacuggcuaaagauaau

SEQ ID NO: 7799 - RNA, 19 nt, artificial
  Chemically synthesized
auugccuguguauggaaaa

SEQ ID NO: 7800 - RNA, 19 nt, artificial
  Chemically synthesized
aacagcucgaauuaagaau

SEQ ID NO: 7801 - RNA, 19 nt, artificial
  Chemically synthesized
gagaaaagcacacuuguag

SEQ ID NO: 7802 - RNA, 19 nt, artificial
  Chemically synthesized
gaugccaauuauuguuaca

SEQ ID NO: 7803 - RNA, 19 nt, artificial
  Chemically synthesized
cucauuugggagaucuggu

SEQ ID NO: 7804 - RNA, 19 nt, artificial
  Chemically synthesized
acagaaaccuauccucacu

SEQ ID NO: 7805 - RNA, 19 nt, artificial
  Chemically synthesized
accaguuaauuacucagca

SEQ ID NO: 7806 - RNA, 19 nt, artificial
  Chemically synthesized
cucccaagcuaucuaaagu

SEQ ID NO: 7807 - RNA, 19 nt, artificial
  Chemically synthesized
uucuaaaucccucgauauu

SEQ ID NO: 7808 - RNA, 19 nt, artificial
  Chemically synthesized
gccggcaagguuuggagag

SEQ ID NO: 7809 - RNA, 19 nt, artificial
  Chemically synthesized
cacugcagagacauggaag

SEQ ID NO: 7810 - RNA, 19 nt, artificial
  Chemically synthesized
ccucagaagacgucaaacg

SEQ ID NO: 7811 - RNA, 19 nt, artificial
  Chemically synthesized
agagacauggaagaggcga

SEQ ID NO: 7812 - RNA, 19 nt, artificial
  Chemically synthesized
agcggauggacgccaggca

SEQ ID NO: 7813 - RNA, 19 nt, artificial
  Chemically synthesized
uugauuuacagcaaguaga

SEQ ID NO: 7814 - RNA, 19 nt, artificial
  Chemically synthesized
uuuggcuuguauauugucu

SEQ ID NO: 7815 - RNA, 19 nt, artificial
  Chemically synthesized
uuacguuugacgucuucug

SEQ ID NO: 7816 - RNA, 19 nt, artificial
  Chemically synthesized
acguuugacaucuuucucc

SEQ ID NO: 7817 - RNA, 19 nt, artificial
  Chemically synthesized
uuuggguccaccaaaugcg

SEQ ID NO: 7818 - RNA, 19 nt, artificial
  Chemically synthesized
uuugacaucuuucucccgg

SEQ ID NO: 7819 - RNA, 19 nt, artificial
  Chemically synthesized
auagcaauuaucuuuagcc

SEQ ID NO: 7820 - RNA, 19 nt, artificial
  Chemically synthesized
aaacaauucaaacccuucc

SEQ ID NO: 7821 - RNA, 19 nt, artificial
  Chemically synthesized
uuaugugcuacauaaaagg

SEQ ID NO: 7822 - RNA, 19 nt, artificial
  Chemically synthesized
ucuacaugaaccuuccuug

SEQ ID NO: 7823 - RNA, 19 nt, artificial
  Chemically synthesized
auugcauaaugcuacaucc

SEQ ID NO: 7824 - RNA, 19 nt, artificial
  Chemically synthesized
uauucuacccaacacagca

SEQ ID NO: 7825 - RNA, 19 nt, artificial
  Chemically synthesized
uuuuaaaaaagccacaugc

SEQ ID NO: 7826 - RNA, 19 nt, artificial
  Chemically synthesized
uguuuugaguagaagaauc

SEQ ID NO: 7827 - RNA, 19 nt, artificial
  Chemically synthesized
uauacuuggcucaguaugc

SEQ ID NO: 7828 - RNA, 19 nt, artificial
  Chemically synthesized
uucaaaacucccaagcacc

SEQ ID NO: 7829 - RNA, 19 nt, artificial
  Chemically synthesized
uuugugauucugaaaaucg

SEQ ID NO: 7830 - RNA, 19 nt, artificial
  Chemically synthesized
aaaccuaauugcauaaugc

SEQ ID NO: 7831 - RNA, 19 nt, artificial
  Chemically synthesized
aagaaaacaauucaaaccc

SEQ ID NO: 7832 - RNA, 19 nt, artificial
  Chemically synthesized
uuggcuuguauauugucua

SEQ ID NO: 7833 - RNA, 19 nt, artificial
  Chemically synthesized
acagguaguacaaugaagc

SEQ ID NO: 7834 - RNA, 19 nt, artificial
  Chemically synthesized
uuauacuuggcucaguaug

SEQ ID NO: 7835 - RNA, 19 nt, artificial
  Chemically synthesized
aaagcaagcucuucauacc

SEQ ID NO: 7836 - RNA, 19 nt, artificial
  Chemically synthesized
uaucagcugucucugaaag

SEQ ID NO: 7837 - RNA, 19 nt, artificial
  Chemically synthesized
ucagcugucucugaaaggg

SEQ ID NO: 7838 - RNA, 19 nt, artificial
  Chemically synthesized
aagcaaauaaggaaaaacc

SEQ ID NO: 7839 - RNA, 19 nt, artificial
  Chemically synthesized
aauugcauaaugcuacauc

SEQ ID NO: 7840 - RNA, 19 nt, artificial
  Chemically synthesized
uaaaaaagccacaugcagc

SEQ ID NO: 7841 - RNA, 19 nt, artificial
  Chemically synthesized
uacaagugugcuuuucucu

SEQ ID NO: 7842 - RNA, 19 nt, artificial
  Chemically synthesized
aaacuauauacacagguag

SEQ ID NO: 7843 - RNA, 19 nt, artificial
  Chemically synthesized
aaaucgaaauuccacuugc

SEQ ID NO: 7844 - RNA, 19 nt, artificial
  Chemically synthesized
uucuguuggcucuuuuguu

SEQ ID NO: 7845 - RNA, 19 nt, artificial
  Chemically synthesized
uacaaugaagcaaauaagg

SEQ ID NO: 7846 - RNA, 19 nt, artificial
  Chemically synthesized
uaaggaaaaaccuaauugc

SEQ ID NO: 7847 - RNA, 19 nt, artificial
  Chemically synthesized
augaaguaucagcugucuc

SEQ ID NO: 7848 - RNA, 19 nt, artificial
  Chemically synthesized
uuucucccgggucugcacg

SEQ ID NO: 7849 - RNA, 19 nt, artificial
  Chemically synthesized
cguuugacaucuuucuccc

SEQ ID NO: 7850 - RNA, 19 nt, artificial
  Chemically synthesized
auuuugacuguguuuacac

SEQ ID NO: 7851 - RNA, 19 nt, artificial
  Chemically synthesized
uuuacguuugacgucuucu

SEQ ID NO: 7852 - RNA, 19 nt, artificial
  Chemically synthesized
uuuuucagugcuuauacag

SEQ ID NO: 7853 - RNA, 19 nt, artificial
  Chemically synthesized
uugacaucuuucucccggg

SEQ ID NO: 7854 - RNA, 19 nt, artificial
  Chemically synthesized
uuugacuguguuuacacag

SEQ ID NO: 7855 - RNA, 19 nt, artificial
  Chemically synthesized
uacagaguuauguacacag

SEQ ID NO: 7856 - RNA, 19 nt, artificial
  Chemically synthesized
ucucaaaaaaacaaaaccg

SEQ ID NO: 7857 - RNA, 19 nt, artificial
  Chemically synthesized
aucagcugucucugaaagg

SEQ ID NO: 7858 - RNA, 19 nt, artificial
  Chemically synthesized
uuuuaguggcccaauaugg

SEQ ID NO: 7859 - RNA, 19 nt, artificial
  Chemically synthesized
uuggcucuuuuguuuugag

SEQ ID NO: 7860 - RNA, 19 nt, artificial
  Chemically synthesized
aaaacaauucaaacccuuc

SEQ ID NO: 7861 - RNA, 19 nt, artificial
  Chemically synthesized
uuauguacacagguacacu

SEQ ID NO: 7862 - RNA, 19 nt, artificial
  Chemically synthesized
uucacuuauccuacaagug

SEQ ID NO: 7863 - RNA, 19 nt, artificial
  Chemically synthesized
auguaucugauaaacaagg

SEQ ID NO: 7864 - RNA, 19 nt, artificial
  Chemically synthesized
auacacagguaguacaaug

SEQ ID NO: 7865 - RNA, 19 nt, artificial
  Chemically synthesized
caaccuuuuaagcauagcc

SEQ ID NO: 7866 - RNA, 19 nt, artificial
  Chemically synthesized
aaaugaaguaucagcuguc

SEQ ID NO: 7867 - RNA, 19 nt, artificial
  Chemically synthesized
auguguaacaauaauuggc

SEQ ID NO: 7868 - RNA, 19 nt, artificial
  Chemically synthesized
uuguguuguuguuuuucag

SEQ ID NO: 7869 - RNA, 19 nt, artificial
  Chemically synthesized
acauauucuuaauucgagc

SEQ ID NO: 7870 - RNA, 19 nt, artificial
  Chemically synthesized
aauuccaacuuuaagagag

SEQ ID NO: 7871 - RNA, 19 nt, artificial
  Chemically synthesized
uuuucucuacaugaaccuu

SEQ ID NO: 7872 - RNA, 19 nt, artificial
  Chemically synthesized
ugaaguuacuuacagaucu

SEQ ID NO: 7873 - RNA, 19 nt, artificial
  Chemically synthesized
uucugcugaguaauuaacu

SEQ ID NO: 7874 - RNA, 19 nt, artificial
  Chemically synthesized
ucccguuagacacucgcac

SEQ ID NO: 7875 - RNA, 19 nt, artificial
  Chemically synthesized
ugaaaaucgaaauuccacu

SEQ ID NO: 7876 - RNA, 19 nt, artificial
  Chemically synthesized
uuucaguguuuuuacagag

SEQ ID NO: 7877 - RNA, 19 nt, artificial
  Chemically synthesized
uacaaaugcacaaaacaug

SEQ ID NO: 7878 - RNA, 19 nt, artificial
  Chemically synthesized
uuuucagugcuuauacagg

SEQ ID NO: 7879 - RNA, 19 nt, artificial
  Chemically synthesized
aaauggacuggcgagcggg

SEQ ID NO: 7880 - RNA, 19 nt, artificial
  Chemically synthesized
uugccacucguacuugccc

SEQ ID NO: 7881 - RNA, 19 nt, artificial
  Chemically synthesized
ugcuucuccaagucccggg

SEQ ID NO: 7882 - RNA, 19 nt, artificial
  Chemically synthesized
caagcugcccuucuccacc

SEQ ID NO: 7883 - RNA, 19 nt, artificial
  Chemically synthesized
auccgcuccaggcuagggc

SEQ ID NO: 7884 - RNA, 19 nt, artificial
  Chemically synthesized
aauuccacuugcgcuggcu

SEQ ID NO: 7885 - RNA, 19 nt, artificial
  Chemically synthesized
ugcgccggcaccuugcagg

SEQ ID NO: 7886 - RNA, 19 nt, artificial
  Chemically synthesized
uucucuucaugcaagucaa

SEQ ID NO: 7887 - RNA, 19 nt, artificial
  Chemically synthesized
aacucuucgugguccaccg

SEQ ID NO: 7888 - RNA, 19 nt, artificial
  Chemically synthesized
aaugugaaguuacuuacag

SEQ ID NO: 7889 - RNA, 19 nt, artificial
  Chemically synthesized
aucaaauggacuggcgagc

SEQ ID NO: 7890 - RNA, 19 nt, artificial
  Chemically synthesized
ucuuucucccgggucugca

SEQ ID NO: 7891 - RNA, 19 nt, artificial
  Chemically synthesized
ugcuuuucucuacaugaac

SEQ ID NO: 7892 - RNA, 19 nt, artificial
  Chemically synthesized
aagcaagcucuucauaccc

SEQ ID NO: 7893 - RNA, 19 nt, artificial
  Chemically synthesized
ucguacuugcccucuaggg

SEQ ID NO: 7894 - RNA, 19 nt, artificial
  Chemically synthesized
uugcuucucuucaugcaag

SEQ ID NO: 7895 - RNA, 19 nt, artificial
  Chemically synthesized
aaaacaugccacuuuggcu

SEQ ID NO: 7896 - RNA, 19 nt, artificial
  Chemically synthesized
ugacuguguuuacacagcc

SEQ ID NO: 7897 - RNA, 19 nt, artificial
  Chemically synthesized
auagcuauggaaguuuucu

SEQ ID NO: 7898 - RNA, 19 nt, artificial
  Chemically synthesized
ucuggcuguccgacggauc

SEQ ID NO: 7899 - RNA, 19 nt, artificial
  Chemically synthesized
acuugcuguaaaucaaagc

SEQ ID NO: 7900 - RNA, 19 nt, artificial
  Chemically synthesized
aaaugguuuuuccauacac

SEQ ID NO: 7901 - RNA, 19 nt, artificial
  Chemically synthesized
ucaaauggacuggcgagcg

SEQ ID NO: 7902 - RNA, 19 nt, artificial
  Chemically synthesized
ucuccaaaccuugccggcg

SEQ ID NO: 7903 - RNA, 19 nt, artificial
  Chemically synthesized
uguuuuucagugcuuauac

SEQ ID NO: 7904 - RNA, 19 nt, artificial
  Chemically synthesized
aucagucuuuggguccacc

SEQ ID NO: 7905 - RNA, 19 nt, artificial
  Chemically synthesized
aaaaccuauucuacccaac

SEQ ID NO: 7906 - RNA, 19 nt, artificial
  Chemically synthesized
ucgaaauuccacuugcgcu

SEQ ID NO: 7907 - RNA, 19 nt, artificial
  Chemically synthesized
auccuggcucuccugcgcc

SEQ ID NO: 7908 - RNA, 19 nt, artificial
  Chemically synthesized
uuaaaaaagccacaugcag

SEQ ID NO: 7909 - RNA, 19 nt, artificial
  Chemically synthesized
cuucuugggcgucugcucc

SEQ ID NO: 7910 - RNA, 19 nt, artificial
  Chemically synthesized
cagugcuucuccaaguccc

SEQ ID NO: 7911 - RNA, 19 nt, artificial
  Chemically synthesized
uggucaauucuuaacauuc

SEQ ID NO: 7912 - RNA, 19 nt, artificial
  Chemically synthesized
ugaaagggacauuacaucu

SEQ ID NO: 7913 - RNA, 19 nt, artificial
  Chemically synthesized
agcaccucggauuuuugcc

SEQ ID NO: 7914 - RNA, 19 nt, artificial
  Chemically synthesized
aaaccgaacaaaacaaagc

SEQ ID NO: 7915 - RNA, 19 nt, artificial
  Chemically synthesized
uuuugaguagaagaaucgu

SEQ ID NO: 7916 - RNA, 19 nt, artificial
  Chemically synthesized
uuuuagaggcagaucauuu

SEQ ID NO: 7917 - RNA, 19 nt, artificial
  Chemically synthesized
aauugcuucucuucaugca

SEQ ID NO: 7918 - RNA, 19 nt, artificial
  Chemically synthesized
guuuugaguagaagaaucg

SEQ ID NO: 7919 - RNA, 19 nt, artificial
  Chemically synthesized
uuaacauucaaaacuccca

SEQ ID NO: 7920 - RNA, 19 nt, artificial
  Chemically synthesized
ucuuccaugucucugcagu

SEQ ID NO: 7921 - RNA, 19 nt, artificial
  Chemically synthesized
uaaaugaaguaucagcugu

SEQ ID NO: 7922 - RNA, 19 nt, artificial
  Chemically synthesized
uccaugucucugcagugcu

SEQ ID NO: 7923 - RNA, 19 nt, artificial
  Chemically synthesized
aaaacucccaagcaccucg

SEQ ID NO: 7924 - RNA, 19 nt, artificial
  Chemically synthesized
cucucaaaaaaacaaaacc

SEQ ID NO: 7925 - RNA, 19 nt, artificial
  Chemically synthesized
ucugcugaguaauuaacug

SEQ ID NO: 7926 - RNA, 19 nt, artificial
  Chemically synthesized
ucccaaaugagaauaaacu

SEQ ID NO: 7927 - RNA, 19 nt, artificial
  Chemically synthesized
uguccucagaguuagccgg

SEQ ID NO: 7928 - RNA, 19 nt, artificial
  Chemically synthesized
aucgaaauuccacuugcgc

SEQ ID NO: 7929 - RNA, 19 nt, artificial
  Chemically synthesized
uauccauuucacuuauccu

SEQ ID NO: 7930 - RNA, 19 nt, artificial
  Chemically synthesized
uucuccaccucuugccacu

SEQ ID NO: 7931 - RNA, 19 nt, artificial
  Chemically synthesized
uagcuauggaaguuuucuu

SEQ ID NO: 7932 - RNA, 19 nt, artificial
  Chemically synthesized
aaaccuauucuacccaaca

SEQ ID NO: 7933 - RNA, 19 nt, artificial
  Chemically synthesized
aaacaugccacuuuggcuu

SEQ ID NO: 7934 - RNA, 19 nt, artificial
  Chemically synthesized
aaaauugcuucucuucaug

SEQ ID NO: 7935 - RNA, 19 nt, artificial
  Chemically synthesized
aauuauacuuggcucagua

SEQ ID NO: 7936 - RNA, 19 nt, artificial
  Chemically synthesized
aaucgaaauuccacuugcg

SEQ ID NO: 7937 - RNA, 19 nt, artificial
  Chemically synthesized
uuucacuuauccuacaagu

SEQ ID NO: 7938 - RNA, 19 nt, artificial
  Chemically synthesized
uuacagaguuauguacaca

SEQ ID NO: 7939 - RNA, 19 nt, artificial
  Chemically synthesized
cuuuucucuacaugaaccu

SEQ ID NO: 7940 - RNA, 19 nt, artificial
  Chemically synthesized
cuuccuugcuucaucaagc

SEQ ID NO: 7941 - RNA, 19 nt, artificial
  Chemically synthesized
ugugcuuuucucuacauga

SEQ ID NO: 7942 - RNA, 19 nt, artificial
  Chemically synthesized
uaauaaaagcagaugguca

SEQ ID NO: 7943 - RNA, 19 nt, artificial
  Chemically synthesized
gucucugcagugcuucucc

SEQ ID NO: 7944 - RNA, 19 nt, artificial
  Chemically synthesized
uguggauaaauggacagag

SEQ ID NO: 7945 - RNA, 19 nt, artificial
  Chemically synthesized
uuuccauacacaggcaaug

SEQ ID NO: 7946 - RNA, 19 nt, artificial
  Chemically synthesized
ucuuccuugcuucaucaag

SEQ ID NO: 7947 - RNA, 19 nt, artificial
  Chemically synthesized
auaaauggacagaguaagc

SEQ ID NO: 7948 - RNA, 19 nt, artificial
  Chemically synthesized
uaucuacuugcuguaaauc

SEQ ID NO: 7949 - RNA, 19 nt, artificial
  Chemically synthesized
uuaguggcccaauauggcg

SEQ ID NO: 7950 - RNA, 19 nt, artificial
  Chemically synthesized
uuagccaguguucaaauuu

SEQ ID NO: 7951 - RNA, 19 nt, artificial
  Chemically synthesized
acuuggcucaguaugcaac

SEQ ID NO: 7952 - RNA, 19 nt, artificial
  Chemically synthesized
ugaucaaauggacuggcga

SEQ ID NO: 7953 - RNA, 19 nt, artificial
  Chemically synthesized
uaauuggcaucuuuuucac

SEQ ID NO: 7954 - RNA, 19 nt, artificial
  Chemically synthesized
aaccuuuuaagcauagcca

SEQ ID NO: 7955 - RNA, 19 nt, artificial
  Chemically synthesized
uuuaguggcccaauauggc

SEQ ID NO: 7956 - RNA, 19 nt, artificial
  Chemically synthesized
caguguucaaauuuuugug

SEQ ID NO: 7957 - RNA, 19 nt, artificial
  Chemically synthesized
uugggcgucugcuccacag

SEQ ID NO: 7958 - RNA, 19 nt, artificial
  Chemically synthesized
acauccaacgcuuuuagag

SEQ ID NO: 7959 - RNA, 19 nt, artificial
  Chemically synthesized
aaccuauucuacccaacac

SEQ ID NO: 7960 - RNA, 19 nt, artificial
  Chemically synthesized
accuauucuacccaacaca

SEQ ID NO: 7961 - RNA, 19 nt, artificial
  Chemically synthesized
ucaaaugguuuuuccauac

SEQ ID NO: 7962 - RNA, 19 nt, artificial
  Chemically synthesized
ugaguagaagaaucgucgg

SEQ ID NO: 7963 - RNA, 19 nt, artificial
  Chemically synthesized
uacuugcuguaaaucaaag

SEQ ID NO: 7964 - RNA, 19 nt, artificial
  Chemically synthesized
uuaauucgagcuguuuacg

SEQ ID NO: 7965 - RNA, 19 nt, artificial
  Chemically synthesized
augguuuuuccauacacag

SEQ ID NO: 7966 - RNA, 19 nt, artificial
  Chemically synthesized
auguaguauccauuucacu

SEQ ID NO: 7967 - RNA, 19 nt, artificial
  Chemically synthesized
aaaucaaagcaagcucuuc

SEQ ID NO: 7968 - RNA, 19 nt, artificial
  Chemically synthesized
uacguuugacgucuucuga

SEQ ID NO: 7969 - RNA, 19 nt, artificial
  Chemically synthesized
auuccacuugcgcuggcuc

SEQ ID NO: 7970 - RNA, 19 nt, artificial
  Chemically synthesized
agccgcucuccaaaccuug

SEQ ID NO: 7971 - RNA, 19 nt, artificial
  Chemically synthesized
ugugaaguuacuuacagau

SEQ ID NO: 7972 - RNA, 19 nt, artificial
  Chemically synthesized
ugcuuauacaggaugucca

SEQ ID NO: 7973 - RNA, 19 nt, artificial
  Chemically synthesized
uugacuguguuuacacagc

SEQ ID NO: 7974 - RNA, 19 nt, artificial
  Chemically synthesized
acaaacuuuagauagcuug

SEQ ID NO: 7975 - RNA, 19 nt, artificial
  Chemically synthesized
cuugccacucguacuugcc

SEQ ID NO: 7976 - RNA, 19 nt, artificial
  Chemically synthesized
gucuguaguagaacucggg

SEQ ID NO: 7977 - RNA, 19 nt, artificial
  Chemically synthesized
cucgccucuuccaugucuc

SEQ ID NO: 7978 - RNA, 19 nt, artificial
  Chemically synthesized
uugacgucuucugaggcca

SEQ ID NO: 7979 - RNA, 19 nt, artificial
  Chemically synthesized
uguuguuguuuuucagugc

SEQ ID NO: 7980 - RNA, 19 nt, artificial
  Chemically synthesized
uccgcugaucaaauggacu

SEQ ID NO: 7981 - RNA, 19 nt, artificial
  Chemically synthesized
aaugguuuuuccauacaca

SEQ ID NO: 7982 - RNA, 19 nt, artificial
  Chemically synthesized
ucaagcagugauguaucug

SEQ ID NO: 7983 - RNA, 19 nt, artificial
  Chemically synthesized
agccaaaagacacagaccc

SEQ ID NO: 7984 - RNA, 19 nt, artificial
  Chemically synthesized
uugccggcgucggagucgc

SEQ ID NO: 7985 - RNA, 19 nt, artificial
  Chemically synthesized
ucuuaacauucaaaacucc

SEQ ID NO: 7986 - RNA, 19 nt, artificial
  Chemically synthesized
ugguuuuuccauacacagg

SEQ ID NO: 7987 - RNA, 19 nt, artificial
  Chemically synthesized
uagaggcagaucauuuaag

SEQ ID NO: 7988 - RNA, 19 nt, artificial
  Chemically synthesized
ucgcacucucaaaaaaaca

SEQ ID NO: 7989 - RNA, 19 nt, artificial
  Chemically synthesized
ucuccgcugaucaaaugga

SEQ ID NO: 7990 - RNA, 19 nt, artificial
  Chemically synthesized
auaucgagggauuuagaau

SEQ ID NO: 7991 - RNA, 19 nt, artificial
  Chemically synthesized
ucugcagugcuucuccaag

SEQ ID NO: 7992 - RNA, 19 nt, artificial
  Chemically synthesized
aaugcuacauccaacgcuu

SEQ ID NO: 7993 - RNA, 19 nt, artificial
  Chemically synthesized
auauggcgguggaagggag

SEQ ID NO: 7994 - RNA, 19 nt, artificial
  Chemically synthesized
ucagucuuuggguccacca

SEQ ID NO: 7995 - RNA, 19 nt, artificial
  Chemically synthesized
aucugauaaacaaggaaac

SEQ ID NO: 7996 - RNA, 19 nt, artificial
  Chemically synthesized
gcuuuucucuacaugaacc

SEQ ID NO: 7997 - RNA, 19 nt, artificial
  Chemically synthesized
ucuuuaaaaauaucgaggg

SEQ ID NO: 7998 - RNA, 19 nt, artificial
  Chemically synthesized
acauucaaaacucccaagc

SEQ ID NO: 7999 - RNA, 19 nt, artificial
  Chemically synthesized
acauccuggcucuccugcg

SEQ ID NO: 8000 - RNA, 19 nt, artificial
  Chemically synthesized
ucuguaguagaacucgggc

SEQ ID NO: 8001 - RNA, 19 nt, artificial
  Chemically synthesized
aaaauaucgagggauuuag

SEQ ID NO: 8002 - RNA, 19 nt, artificial
  Chemically synthesized
ugcuguaaaucaaagcaag

SEQ ID NO: 8003 - RNA, 19 nt, artificial
  Chemically synthesized
uaguggcccaauauggcgg

SEQ ID NO: 8004 - RNA, 19 nt, artificial
  Chemically synthesized
acaucuuucucccgggucu

SEQ ID NO: 8005 - RNA, 19 nt, artificial
  Chemically synthesized
auuggcaucuuuuucacac

SEQ ID NO: 8006 - RNA, 19 nt, artificial
  Chemically synthesized
aaagcagauggucaauucu

SEQ ID NO: 8007 - RNA, 19 nt, artificial
  Chemically synthesized
augucucugcagugcuucu

SEQ ID NO: 8008 - RNA, 19 nt, artificial
  Chemically synthesized
aaagccacaugcagcuauc

SEQ ID NO: 8009 - RNA, 19 nt, artificial
  Chemically synthesized
agucuccgcugaucaaaug

SEQ ID NO: 8010 - RNA, 19 nt, artificial
  Chemically synthesized
aucuacuugcuguaaauca

SEQ ID NO: 8011 - RNA, 19 nt, artificial
  Chemically synthesized
aaccuugccggcgucggag

SEQ ID NO: 8012 - RNA, 19 nt, artificial
  Chemically synthesized
uuggcucaguaugcaaccu

SEQ ID NO: 8013 - RNA, 19 nt, artificial
  Chemically synthesized
uacacagguaguacaauga

SEQ ID NO: 8014 - RNA, 19 nt, artificial
  Chemically synthesized
cuuggcucaguaugcaacc

SEQ ID NO: 8015 - RNA, 19 nt, artificial
  Chemically synthesized
agugcuucuccaagucccg

SEQ ID NO: 8016 - RNA, 19 nt, artificial
  Chemically synthesized
gucugaaacauuuucuucu

SEQ ID NO: 8017 - RNA, 19 nt, artificial
  Chemically synthesized
cuauucuacccaacacagc

SEQ ID NO: 8018 - RNA, 19 nt, artificial
  Chemically synthesized
ucaucaagcagugauguau

SEQ ID NO: 8019 - RNA, 19 nt, artificial
  Chemically synthesized
uucuacccaacacagcauu

SEQ ID NO: 8020 - RNA, 19 nt, artificial
  Chemically synthesized
aagaaucgucgguugcagg

SEQ ID NO: 8021 - RNA, 19 nt, artificial
  Chemically synthesized
gucgcuuccuuauuccugc

SEQ ID NO: 8022 - RNA, 19 nt, artificial
  Chemically synthesized
auaaugcuacauccaacgc

SEQ ID NO: 8023 - RNA, 19 nt, artificial
  Chemically synthesized
ggucuguaguagaacucgg

SEQ ID NO: 8024 - RNA, 19 nt, artificial
  Chemically synthesized
ugccacucguacuugcccu

SEQ ID NO: 8025 - RNA, 19 nt, artificial
  Chemically synthesized
uuuugacuguguuuacaca

SEQ ID NO: 8026 - RNA, 19 nt, artificial
  Chemically synthesized
aauagcuauggaaguuuuc

SEQ ID NO: 8027 - RNA, 19 nt, artificial
  Chemically synthesized
acucgcacguuugacaucu

SEQ ID NO: 8028 - RNA, 19 nt, artificial
  Chemically synthesized
agcugucucugaaagggac

SEQ ID NO: 8029 - RNA, 19 nt, artificial
  Chemically synthesized
auagcuugggagaucacca

SEQ ID NO: 8030 - RNA, 19 nt, artificial
  Chemically synthesized
uugcauaaugcuacaucca

SEQ ID NO: 8031 - RNA, 19 nt, artificial
  Chemically synthesized
uuuacagaguuauguacac

SEQ ID NO: 8032 - RNA, 19 nt, artificial
  Chemically synthesized
uccgacggaucagucuuug

SEQ ID NO: 8033 - RNA, 19 nt, artificial
  Chemically synthesized
ucugaaagggacauuacau

SEQ ID NO: 8034 - RNA, 19 nt, artificial
  Chemically synthesized
acagcauuuacaaaugcac

SEQ ID NO: 8035 - RNA, 19 nt, artificial
  Chemically synthesized
cauaaugcuacauccaacg

SEQ ID NO: 8036 - RNA, 19 nt, artificial
  Chemically synthesized
auuccugcgcauugcuccg

SEQ ID NO: 8037 - RNA, 19 nt, artificial
  Chemically synthesized
aaaaaagccacaugcagcu

SEQ ID NO: 8038 - RNA, 19 nt, artificial
  Chemically synthesized
aagcugcccuucuccaccu

SEQ ID NO: 8039 - RNA, 19 nt, artificial
  Chemically synthesized
auuucacuuauccuacaag

SEQ ID NO: 8040 - RNA, 19 nt, artificial
  Chemically synthesized
acguuugacgucuucugag

SEQ ID NO: 8041 - RNA, 19 nt, artificial
  Chemically synthesized
auucaaaacucccaagcac

SEQ ID NO: 8042 - RNA, 19 nt, artificial
  Chemically synthesized
uauggcgguggaagggagg

SEQ ID NO: 8043 - RNA, 19 nt, artificial
  Chemically synthesized
cuuuuguuuugaguagaag

SEQ ID NO: 8044 - RNA, 19 nt, artificial
  Chemically synthesized
ucugaaacauuuucuucug

SEQ ID NO: 8045 - RNA, 19 nt, artificial
  Chemically synthesized
uauguacacagguacacuu

SEQ ID NO: 8046 - RNA, 19 nt, artificial
  Chemically synthesized
ugcagugcuucuccaaguc

SEQ ID NO: 8047 - RNA, 19 nt, artificial
  Chemically synthesized
guauccauuucacuuaucc

SEQ ID NO: 8048 - RNA, 19 nt, artificial
  Chemically synthesized
acacaggcaaugaaauacu

SEQ ID NO: 8049 - RNA, 19 nt, artificial
  Chemically synthesized
auguccauuccaugaaguc

SEQ ID NO: 8050 - RNA, 19 nt, artificial
  Chemically synthesized
aaccuaauugcauaaugcu

SEQ ID NO: 8051 - RNA, 19 nt, artificial
  Chemically synthesized
aacugguaaauuccaacuu

SEQ ID NO: 8052 - RNA, 19 nt, artificial
  Chemically synthesized
uuccuugcuucaucaagca

SEQ ID NO: 8053 - RNA, 19 nt, artificial
  Chemically synthesized
acagguacacuucaaaugg

SEQ ID NO: 8054 - RNA, 19 nt, artificial
  Chemically synthesized
ucuguuggcucuuuuguuu

SEQ ID NO: 8055 - RNA, 19 nt, artificial
  Chemically synthesized
agcgacugcccucggagcc

SEQ ID NO: 8056 - RNA, 19 nt, artificial
  Chemically synthesized
uacccaacacagcauuuac

SEQ ID NO: 8057 - RNA, 19 nt, artificial
  Chemically synthesized
cuucucuucaugcaaguca

SEQ ID NO: 8058 - RNA, 19 nt, artificial
  Chemically synthesized
ugcccuucuccaccucuug

SEQ ID NO: 8059 - RNA, 19 nt, artificial
  Chemically synthesized
agacacucgcacguuugac

SEQ ID NO: 8060 - RNA, 19 nt, artificial
  Chemically synthesized
uaugcaaccuuuuaagcau

SEQ ID NO: 8061 - RNA, 19 nt, artificial
  Chemically synthesized
aacauuuucuucuguucug

SEQ ID NO: 8062 - RNA, 19 nt, artificial
  Chemically synthesized
gguuuuuccauacacaggc

SEQ ID NO: 8063 - RNA, 19 nt, artificial
  Chemically synthesized
ucgguugcaggucgcuucc

SEQ ID NO: 8064 - RNA, 19 nt, artificial
  Chemically synthesized
gucuccgcugaucaaaugg

SEQ ID NO: 8065 - RNA, 19 nt, artificial
  Chemically synthesized
cacguuugacaucuuucuc

SEQ ID NO: 8066 - RNA, 19 nt, artificial
  Chemically synthesized
gaaguaucagcugucucug

SEQ ID NO: 8067 - RNA, 19 nt, artificial
  Chemically synthesized
uccacuugcgcuggcucgc

SEQ ID NO: 8068 - RNA, 19 nt, artificial
  Chemically synthesized
uuaacucuucgugguccac

SEQ ID NO: 8069 - RNA, 19 nt, artificial
  Chemically synthesized
cauauucuuaauucgagcu

SEQ ID NO: 8070 - RNA, 19 nt, artificial
  Chemically synthesized
auuccaugaagucagcgau

SEQ ID NO: 8071 - RNA, 19 nt, artificial
  Chemically synthesized
aaugaaguaucagcugucu

SEQ ID NO: 8072 - RNA, 19 nt, artificial
  Chemically synthesized
accgucugaaacauuuucu

SEQ ID NO: 8073 - RNA, 19 nt, artificial
  Chemically synthesized
cccuucuccaccucuugcc

SEQ ID NO: 8074 - RNA, 19 nt, artificial
  Chemically synthesized
uuucagugcuuauacagga

SEQ ID NO: 8075 - RNA, 19 nt, artificial
  Chemically synthesized
auguacacagguacacuuc

SEQ ID NO: 8076 - RNA, 19 nt, artificial
  Chemically synthesized
cuuaacauucaaaacuccc

SEQ ID NO: 8077 - RNA, 19 nt, artificial
  Chemically synthesized
aaauuauacuuggcucagu

SEQ ID NO: 8078 - RNA, 19 nt, artificial
  Chemically synthesized
uggcucaguaugcaaccuu

SEQ ID NO: 8079 - RNA, 19 nt, artificial
  Chemically synthesized
agauggucaauucuuaaca

SEQ ID NO: 8080 - RNA, 19 nt, artificial
  Chemically synthesized
aguaugcaaccuuuuaagc

SEQ ID NO: 8081 - RNA, 19 nt, artificial
  Chemically synthesized
acuugcgcuggcucgccuc

SEQ ID NO: 8082 - RNA, 19 nt, artificial
  Chemically synthesized
ucucugcagugcuucucca

SEQ ID NO: 8083 - RNA, 19 nt, artificial
  Chemically synthesized
uugugauucugaaaaucga

SEQ ID NO: 8084 - RNA, 19 nt, artificial
  Chemically synthesized
aaugcacaaaacaugccac

SEQ ID NO: 8085 - RNA, 19 nt, artificial
  Chemically synthesized
uguaguauccauuucacuu

SEQ ID NO: 8086 - RNA, 19 nt, artificial
  Chemically synthesized
uacaggauguccauuccau

SEQ ID NO: 8087 - RNA, 19 nt, artificial
  Chemically synthesized
aaaaccgaacaaaacaaag

SEQ ID NO: 8088 - RNA, 19 nt, artificial
  Chemically synthesized
guaaaucaaagcaagcucu

SEQ ID NO: 8089 - RNA, 19 nt, artificial
  Chemically synthesized
aaucgucgguugcaggucg

SEQ ID NO: 8090 - RNA, 19 nt, artificial
  Chemically synthesized
ggagugaucaccauucugc

SEQ ID NO: 8091 - RNA, 19 nt, artificial
  Chemically synthesized
aaaccuugccggcgucgga

SEQ ID NO: 8092 - RNA, 19 nt, artificial
  Chemically synthesized
aguguuauuguguuguugu

SEQ ID NO: 8093 - RNA, 19 nt, artificial
  Chemically synthesized
uguccgacggaucagucuu

SEQ ID NO: 8094 - RNA, 19 nt, artificial
  Chemically synthesized
aaaugcacaaaacaugcca

SEQ ID NO: 8095 - RNA, 19 nt, artificial
  Chemically synthesized
caggucgcuuccuuauucc

SEQ ID NO: 8096 - RNA, 19 nt, artificial
  Chemically synthesized
ucugcuccacagaaccggc

SEQ ID NO: 8097 - RNA, 19 nt, artificial
  Chemically synthesized
ucuccaccucuugccacuc

SEQ ID NO: 8098 - RNA, 19 nt, artificial
  Chemically synthesized
aaauaucgagggauuuaga

SEQ ID NO: 8099 - RNA, 19 nt, artificial
  Chemically synthesized
cgucugaaacauuuucuuc

SEQ ID NO: 8100 - RNA, 19 nt, artificial
  Chemically synthesized
acaaaugcacaaaacaugc

SEQ ID NO: 8101 - RNA, 19 nt, artificial
  Chemically synthesized
aagugugcuuuucucuaca

SEQ ID NO: 8102 - RNA, 19 nt, artificial
  Chemically synthesized
auacuuggcucaguaugca

SEQ ID NO: 8103 - RNA, 19 nt, artificial
  Chemically synthesized
aaacaaaaccgaacaaaac

SEQ ID NO: 8104 - RNA, 19 nt, artificial
  Chemically synthesized
aaauggacagaguaagcuu

SEQ ID NO: 8105 - RNA, 19 nt, artificial
  Chemically synthesized
auucuacccaacacagcau

SEQ ID NO: 8106 - RNA, 19 nt, artificial
  Chemically synthesized
aagcaccucggauuuuugc

SEQ ID NO: 8107 - RNA, 19 nt, artificial
  Chemically synthesized
uccgagucugggcgggugc

SEQ ID NO: 8108 - RNA, 19 nt, artificial
  Chemically synthesized
acuguguuuacacagcccg

SEQ ID NO: 8109 - RNA, 19 nt, artificial
  Chemically synthesized
uugcuguaaaucaaagcaa

SEQ ID NO: 8110 - RNA, 19 nt, artificial
  Chemically synthesized
uguuggcucuuuuguuuug

SEQ ID NO: 8111 - RNA, 19 nt, artificial
  Chemically synthesized
ugucucugaaagggacauu

SEQ ID NO: 8112 - RNA, 19 nt, artificial
  Chemically synthesized
aucuuucucccgggucugc

SEQ ID NO: 8113 - RNA, 19 nt, artificial
  Chemically synthesized
aagcccguccgagucuggg

SEQ ID NO: 8114 - RNA, 19 nt, artificial
  Chemically synthesized
cuuucucccgggucugcac

SEQ ID NO: 8115 - RNA, 19 nt, artificial
  Chemically synthesized
uucuguucuguuggcucuu

SEQ ID NO: 8116 - RNA, 19 nt, artificial
  Chemically synthesized
uggagugaucaccauucug

SEQ ID NO: 8117 - RNA, 19 nt, artificial
  Chemically synthesized
ccgcucuccaaaccuugcc

SEQ ID NO: 8118 - RNA, 19 nt, artificial
  Chemically synthesized
uccauuucacuuauccuac

SEQ ID NO: 8119 - RNA, 19 nt, artificial
  Chemically synthesized
ucuucgugguccaccgggc

SEQ ID NO: 8120 - RNA, 19 nt, artificial
  Chemically synthesized
acucguacuugcccucuag

SEQ ID NO: 8121 - RNA, 19 nt, artificial
  Chemically synthesized
gccucuuccaugucucugc

SEQ ID NO: 8122 - RNA, 19 nt, artificial
  Chemically synthesized
uaaaucaaagcaagcucuu

SEQ ID NO: 8123 - RNA, 19 nt, artificial
  Chemically synthesized
acagaguuauguacacagg

SEQ ID NO: 8124 - RNA, 19 nt, artificial
  Chemically synthesized
aacauucaaaacucccaag

SEQ ID NO: 8125 - RNA, 19 nt, artificial
  Chemically synthesized
ugggagaucaccagaucuc

SEQ ID NO: 8126 - RNA, 19 nt, artificial
  Chemically synthesized
guuugacgucuucugaggc

SEQ ID NO: 8127 - RNA, 19 nt, artificial
  Chemically synthesized
accucuugccacucguacu

SEQ ID NO: 8128 - RNA, 19 nt, artificial
  Chemically synthesized
uagcaauuaucuuuagcca

SEQ ID NO: 8129 - RNA, 19 nt, artificial
  Chemically synthesized
uaugugcuacauaaaaggu

SEQ ID NO: 8130 - RNA, 19 nt, artificial
  Chemically synthesized
aaaauuauacuuggcucag

SEQ ID NO: 8131 - RNA, 19 nt, artificial
  Chemically synthesized
agugauguaucugauaaac

SEQ ID NO: 8132 - RNA, 19 nt, artificial
  Chemically synthesized
cacuucaaaugguuuuucc

SEQ ID NO: 8133 - RNA, 19 nt, artificial
  Chemically synthesized
aguagaagaaucgucgguu

SEQ ID NO: 8134 - RNA, 19 nt, artificial
  Chemically synthesized
auccaacgcuuuuagaggc

SEQ ID NO: 8135 - RNA, 19 nt, artificial
  Chemically synthesized
cgacggaucagucuuuggg

SEQ ID NO: 8136 - RNA, 19 nt, artificial
  Chemically synthesized
aaagcccguccgagucugg

SEQ ID NO: 8137 - RNA, 19 nt, artificial
  Chemically synthesized
aauuaaaggcgccgccggg

SEQ ID NO: 8138 - RNA, 19 nt, artificial
  Chemically synthesized
acggaucagucuuuggguc

SEQ ID NO: 8139 - RNA, 19 nt, artificial
  Chemically synthesized
auugcuucucuucaugcaa

SEQ ID NO: 8140 - RNA, 19 nt, artificial
  Chemically synthesized
ugcgcuggcucgccucuuc

SEQ ID NO: 8141 - RNA, 19 nt, artificial
  Chemically synthesized
acaggauguccauuccaug

SEQ ID NO: 8142 - RNA, 19 nt, artificial
  Chemically synthesized
uccgcuccaggcuagggcu

SEQ ID NO: 8143 - RNA, 19 nt, artificial
  Chemically synthesized
acgucuucugaggccaggc

SEQ ID NO: 8144 - RNA, 19 nt, artificial
  Chemically synthesized
uguguaacaauaauuggca

SEQ ID NO: 8145 - RNA, 19 nt, artificial
  Chemically synthesized
uuuuuaguggcccaauaug

SEQ ID NO: 8146 - RNA, 19 nt, artificial
  Chemically synthesized
ucugggcgggugcaagccc

SEQ ID NO: 8147 - RNA, 19 nt, artificial
  Chemically synthesized
gcuucuugggcgucugcuc

SEQ ID NO: 8148 - RNA, 19 nt, artificial
  Chemically synthesized
aaguaucagcugucucuga

SEQ ID NO: 8149 - RNA, 19 nt, artificial
  Chemically synthesized
ccuaauugcauaaugcuac

SEQ ID NO: 8150 - RNA, 19 nt, artificial
  Chemically synthesized
gcaccucggauuuuugccc

SEQ ID NO: 8151 - RNA, 19 nt, artificial
  Chemically synthesized
ucagugcuuauacaggaug

SEQ ID NO: 8152 - RNA, 19 nt, artificial
  Chemically synthesized
ugcuucaucaagcagugau

SEQ ID NO: 8153 - RNA, 19 nt, artificial
  Chemically synthesized
ucuugggcgucugcuccac

SEQ ID NO: 8154 - RNA, 19 nt, artificial
  Chemically synthesized
ugacauccuggcucuccug

SEQ ID NO: 8155 - RNA, 19 nt, artificial
  Chemically synthesized
aagcccagcgacugcccuc

SEQ ID NO: 8156 - RNA, 19 nt, artificial
  Chemically synthesized
aauucgagcuguuuacguu

SEQ ID NO: 8157 - RNA, 19 nt, artificial
  Chemically synthesized
uuacacagcccgaagugaa

SEQ ID NO: 8158 - RNA, 19 nt, artificial
  Chemically synthesized
uuaaaggcgccgccgggcg

SEQ ID NO: 8159 - RNA, 19 nt, artificial
  Chemically synthesized
uauaucuuccuugcuucau

SEQ ID NO: 8160 - RNA, 19 nt, artificial
  Chemically synthesized
cugaucaaauggacuggcg

SEQ ID NO: 8161 - RNA, 19 nt, artificial
  Chemically synthesized
cuuccuugaaaaauaacac

SEQ ID NO: 8162 - RNA, 19 nt, artificial
  Chemically synthesized
uuccuuauuccugcgcauu

SEQ ID NO: 8163 - RNA, 19 nt, artificial
  Chemically synthesized
uggcuuguauauugucuag

SEQ ID NO: 8164 - RNA, 19 nt, artificial
  Chemically synthesized
caaaccuugccggcgucgg

SEQ ID NO: 8165 - RNA, 19 nt, artificial
  Chemically synthesized
ucuuuggguccaccaaaug

SEQ ID NO: 8166 - RNA, 19 nt, artificial
  Chemically synthesized
aacuauauacacagguagu

SEQ ID NO: 8167 - RNA, 19 nt, artificial
  Chemically synthesized
uuuaaaaaagccacaugca

SEQ ID NO: 8168 - RNA, 19 nt, artificial
  Chemically synthesized
ucucggaagcccagcgacu

SEQ ID NO: 8169 - RNA, 19 nt, artificial
  Chemically synthesized
auuaucuuuagccaguguu

SEQ ID NO: 8170 - RNA, 19 nt, artificial
  Chemically synthesized
uuuuccauacacaggcaau

SEQ ID NO: 8171 - RNA, 19 nt, artificial
  Chemically synthesized
auucuuaauucgagcuguu

SEQ ID NO: 8172 - RNA, 19 nt, artificial
  Chemically synthesized
cuacaagugugcuuuucuc

SEQ ID NO: 8173 - RNA, 19 nt, artificial
  Chemically synthesized
uguaacaauaauuggcauc

SEQ ID NO: 8174 - RNA, 19 nt, artificial
  Chemically synthesized
accagaucucccaaaugag

SEQ ID NO: 8175 - RNA, 19 nt, artificial
  Chemically synthesized
agugaggauagguuucugu

SEQ ID NO: 8176 - RNA, 19 nt, artificial
  Chemically synthesized
ugcugaguaauuaacuggu

SEQ ID NO: 8177 - RNA, 19 nt, artificial
  Chemically synthesized
acuuuagauagcuugggag

SEQ ID NO: 8178 - RNA, 19 nt, artificial
  Chemically synthesized
aauaucgagggauuuagaa

SEQ ID NO: 8179 - RNA, 19 nt, artificial
  Chemically synthesized
cucuccaaaccuugccggc

SEQ ID NO: 8180 - RNA, 19 nt, artificial
  Chemically synthesized
cuuccaugucucugcagug

SEQ ID NO: 8181 - RNA, 19 nt, artificial
  Chemically synthesized
cguuugacgucuucugagg

SEQ ID NO: 8182 - RNA, 19 nt, artificial
  Chemically synthesized
ucgccucuuccaugucucu

SEQ ID NO: 8183 - RNA, 19 nt, artificial
  Chemically synthesized
ugccuggcguccauccgcu

SEQ ID NO: 8184 - RNA, 19 nt, Artificial Sequence
  Chemically synthesized
ucuacuugcuguaaaucaa

SEQ ID NO: 8185 - RNA, 19 nt, artificial
  Chemically synthesized
ccucuaaaagcguuggaug

SEQ ID NO: 8186 - RNA, 19 nt, artificial
  Chemically synthesized
auuguacuaccuguguaua

SEQ ID NO: 8187 - RNA, 19 nt, artificial
  Chemically synthesized
cucauuuucuuuucacuuc

SEQ ID NO: 8188 - RNA, 19 nt, artificial
  Chemically synthesized
guagagaaaagcacacuug

SEQ ID NO: 8189 - RNA, 19 nt, artificial
  Chemically synthesized
acaauauacaagccaaagu

SEQ ID NO: 8190 - RNA, 19 nt, artificial
  Chemically synthesized
cgcaggaauaaggaagcga

SEQ ID NO: 8191 - RNA, 19 nt, artificial
  Chemically synthesized
cacuaaaauuuuaggcacu

SEQ ID NO: 8192 - RNA, 19 nt, artificial
  Chemically synthesized
gaagcgaccugcaaccgac

SEQ ID NO: 8193 - RNA, 19 nt, artificial
  Chemically synthesized
uccuuguuuaucagauaca

SEQ ID NO: 8194 - RNA, 19 nt, artificial
  Chemically synthesized
cugacuucauggaauggac

SEQ ID NO: 8195 - RNA, 19 nt, artificial
  Chemically synthesized
ccggcaagguuuggagagc

SEQ ID NO: 8196 - RNA, 19 nt, artificial
  Chemically synthesized
aauugaccaucugcuuuua

SEQ ID NO: 8197 - RNA, 19 nt, artificial
  Chemically synthesized
aggaagguucauguagaga

SEQ ID NO: 8198 - RNA, 19 nt, artificial
  Chemically synthesized
agggcagcuugcccgaguu

SEQ ID NO: 8199 - RNA, 19 nt, artificial
  Chemically synthesized
ucuguaaguaacuucacau

SEQ ID NO: 8200 - RNA, 19 nt, artificial
  Chemically synthesized
gaaaauguuucagacgguu

SEQ ID NO: 8201 - RNA, 19 nt, artificial
  Chemically synthesized
acagaacagaagaaaaugu

SEQ ID NO: 8202 - RNA, 19 nt, artificial
  Chemically synthesized
uccuuauuugcuucauugu

SEQ ID NO: 8203 - RNA, 19 nt, artificial
  Chemically synthesized
aagaauugaccaucugcuu

SEQ ID NO: 8204 - RNA, 19 nt, artificial
  Chemically synthesized
ugacuucauggaauggaca

SEQ ID NO: 8205 - RNA, 19 nt, artificial
  Chemically synthesized
aagcaaggaagauauacau

SEQ ID NO: 8206 - RNA, 19 nt, artificial
  Chemically synthesized
gcacacuuguaggauaagu

SEQ ID NO: 8207 - RNA, 19 nt, artificial
  Chemically synthesized
gcgaccugcaaccgacgau

SEQ ID NO: 8208 - RNA, 19 nt, artificial
  Chemically synthesized
augucaaacgugcgagugu

SEQ ID NO: 8209 - RNA, 19 nt, artificial
  Chemically synthesized
gacaauauacaagccaaag

SEQ ID NO: 8210 - RNA, 19 nt, artificial
  Chemically synthesized
aaaauuugaacacuggcua

SEQ ID NO: 8211 - RNA, 19 nt, artificial
  Chemically synthesized
gguucuguggagcagacgc

SEQ ID NO: 8212 - RNA, 19 nt, artificial
  Chemically synthesized
cgaguucuacuacagaccc

SEQ ID NO: 8213 - RNA, 19 nt, artificial
  Chemically synthesized
cagacgcccaagaagccug

SEQ ID NO: 8214 - RNA, 19 nt, artificial
  Chemically synthesized
agagccaacagaacagaag

SEQ ID NO: 8215 - RNA, 19 nt, artificial
  Chemically synthesized
agaucuggugaucucccaa

SEQ ID NO: 8216 - RNA, 19 nt, artificial
  Chemically synthesized
cauuugggagaucugguga

SEQ ID NO: 8217 - RNA, 19 nt, artificial
  Chemically synthesized
uugccuguguauggaaaaa

SEQ ID NO: 8218 - RNA, 19 nt, artificial
  Chemically synthesized
aaagauguaaugucccuuu

SEQ ID NO: 8219 - RNA, 19 nt, artificial
  Chemically synthesized
gacauccuguauaagcacu

SEQ ID NO: 8220 - RNA, 19 nt, artificial
  Chemically synthesized
gaacagaagaaaauguuuc

SEQ ID NO: 8221 - RNA, 19 nt, artificial
  Chemically synthesized
gucucucuuaaaguuggaa

SEQ ID NO: 8222 - RNA, 19 nt, artificial
  Chemically synthesized
uaccuuuuauguagcacau

SEQ ID NO: 8223 - RNA, 19 nt, artificial
  Chemically synthesized
acaaaagagccaacagaac

SEQ ID NO: 8224 - RNA, 19 nt, artificial
  Chemically synthesized
cuuguuuaucagauacauc

SEQ ID NO: 8225 - RNA, 19 nt, artificial
  Chemically synthesized
ugucaaacgugcgaguguc

SEQ ID NO: 8226 - RNA, 19 nt, artificial
  Chemically synthesized
aggcacucuuaaaugaucu

SEQ ID NO: 8227 - RNA, 19 nt, artificial
  Chemically synthesized
gcagacgcccaagaagccu

SEQ ID NO: 8228 - RNA, 19 nt, artificial
  Chemically synthesized
ggcauguuuugugcauuug

SEQ ID NO: 8229 - RNA, 19 nt, artificial
  Chemically synthesized
acacuuguaggauaaguga

SEQ ID NO: 8230 - RNA, 19 nt, artificial
  Chemically synthesized
acaguauuucauugccugu

SEQ ID NO: 8231 - RNA, 19 nt, artificial
  Chemically synthesized
cccaagaagccuggccuca

SEQ ID NO: 8232 - RNA, 19 nt, artificial
  Chemically synthesized
aaagaaaacuuccauagcu

SEQ ID NO: 8233 - RNA, 19 nt, artificial
  Chemically synthesized
ucuaaaagcguuggaugua

SEQ ID NO: 8234 - RNA, 19 nt, artificial
  Chemically synthesized
uggaauggacauccuguau

SEQ ID NO: 8235 - RNA, 19 nt, artificial
  Chemically synthesized
aaaguuggaauuuaccagu

SEQ ID NO: 8236 - RNA, 19 nt, artificial
  Chemically synthesized
ucccuuccaccgccauauu

SEQ ID NO: 8237 - RNA, 19 nt, artificial
  Chemically synthesized
agccucccuuccaccgcca

SEQ ID NO: 8238 - RNA, 19 nt, artificial
  Chemically synthesized
ucauugccuguguauggaa

SEQ ID NO: 8239 - RNA, 19 nt, artificial
  Chemically synthesized
auauugggccacuaaaaaa

SEQ ID NO: 8240 - RNA, 19 nt, artificial
  Chemically synthesized
gaucacuccagguaguuug

SEQ ID NO: 8241 - RNA, 19 nt, artificial
  Chemically synthesized
guuuuuccuuauuugcuuc

SEQ ID NO: 8242 - RNA, 19 nt, artificial
  Chemically synthesized
guaccuguguacauaacuc

SEQ ID NO: 8243 - RNA, 19 nt, artificial
  Chemically synthesized
ggauacuacaucuuuaaac

SEQ ID NO: 8244 - RNA, 19 nt, artificial
  Chemically synthesized
uugcauacugagccaagua

SEQ ID NO: 8245 - RNA, 19 nt, artificial
  Chemically synthesized
auaaggaagcgaccugcaa

SEQ ID NO: 8246 - RNA, 19 nt, artificial
  Chemically synthesized
cgcccaagaagccuggccu

SEQ ID NO: 8247 - RNA, 19 nt, artificial
  Chemically synthesized
ccgguucuguggagcagac

SEQ ID NO: 8248 - RNA, 19 nt, artificial
  Chemically synthesized
acaaaaauuugaacacugg

SEQ ID NO: 8249 - RNA, 19 nt, artificial
  Chemically synthesized
cuggcuaaagauaauugcu

SEQ ID NO: 8250 - RNA, 19 nt, artificial
  Chemically synthesized
ggaagggagggcagggugg

SEQ ID NO: 8251 - RNA, 19 nt, artificial
  Chemically synthesized
gggaagggagggcagggug

SEQ ID NO: 8252 - RNA, 19 nt, artificial
  Chemically synthesized
uauacaagccaaaguggca

SEQ ID NO: 8253 - RNA, 19 nt, artificial
  Chemically synthesized
uuugaaguguaccugugua

SEQ ID NO: 8254 - RNA, 19 nt, artificial
  Chemically synthesized
uagagaaaagcacacuugu

SEQ ID NO: 8255 - RNA, 19 nt, artificial
  Chemically synthesized
cuuuaaagauguaaugucc

SEQ ID NO: 8256 - RNA, 19 nt, artificial
  Chemically synthesized
cuucauuguacuaccugug

SEQ ID NO: 8257 - RNA, 19 nt, artificial
  Chemically synthesized
ggacauccuguauaagcac

SEQ ID NO: 8258 - RNA, 19 nt, artificial
  Chemically synthesized
ggacccaaagacugauccg

SEQ ID NO: 8259 - RNA, 19 nt, artificial
  Chemically synthesized
guggagaagggcagcuugc

SEQ ID NO: 8260 - RNA, 19 nt, artificial
  Chemically synthesized
auacugagccaaguauaau

SEQ ID NO: 8261 - RNA, 19 nt, artificial
  Chemically synthesized
aggaauaaggaagcgaccu

SEQ ID NO: 8262 - RNA, 19 nt, artificial
  Chemically synthesized
uaacccgggacuuggagaa

SEQ ID NO: 8263 - RNA, 19 nt, artificial
  Chemically synthesized
ucaaacgugcgagugucua

SEQ ID NO: 8264 - RNA, 19 nt, artificial
  Chemically synthesized
cugauccgucggacagcca

SEQ ID NO: 8265 - RNA, 19 nt, artificial
  Chemically synthesized
uuguacuaccuguguauau

SEQ ID NO: 8266 - RNA, 19 nt, artificial
  Chemically synthesized
gcgcaggagagccaggaug

SEQ ID NO: 8267 - RNA, 19 nt, artificial
  Chemically synthesized
gcccggcggcgccuuuaau

SEQ ID NO: 8268 - RNA, 19 nt, artificial
  Chemically synthesized
agguuuuuccuuauuugcu

SEQ ID NO: 8269 - RNA, 19 nt, artificial
  Chemically synthesized
auccuguauaagcacugaa

SEQ ID NO: 8270 - RNA, 19 nt, artificial
  Chemically synthesized
cgucaaacguaaacagcuc

SEQ ID NO: 8271 - RNA, 19 nt, artificial
  Chemically synthesized
gcaaggugccggcgcagga

SEQ ID NO: 8272 - RNA, 19 nt, artificial
  Chemically synthesized
guguaccuguguacauaac

SEQ ID NO: 8273 - RNA, 19 nt, artificial
  Chemically synthesized
acauggaagaggcgagcca

SEQ ID NO: 8274 - RNA, 19 nt, artificial
  Chemically synthesized
agcuugcccgaguucuacu

SEQ ID NO: 8275 - RNA, 19 nt, artificial
  Chemically synthesized
ggcagcuugcccgaguucu

SEQ ID NO: 8276 - RNA, 19 nt, artificial
  Chemically synthesized
uguuuccuuguuuaucaga

SEQ ID NO: 8277 - RNA, 19 nt, artificial
  Chemically synthesized
ugcaauuagguuuuuccuu

SEQ ID NO: 8278 - RNA, 19 nt, artificial
  Chemically synthesized
ugugugaaaaagaugccaa

SEQ ID NO: 8279 - RNA, 19 nt, artificial
  Chemically synthesized
cggcgcaggagagccagga

SEQ ID NO: 8280 - RNA, 19 nt, artificial
  Chemically synthesized
cauguagagaaaagcacac

SEQ ID NO: 8281 - RNA, 19 nt, artificial
  Chemically synthesized
uauugggccacuaaaaaaa

SEQ ID NO: 8282 - RNA, 19 nt, artificial
  Chemically synthesized
gaucuguaaguaacuucac

SEQ ID NO: 8283 - RNA, 19 nt, artificial
  Chemically synthesized
agacgucaaacguaaacag

SEQ ID NO: 8284 - RNA, 19 nt, artificial
  Chemically synthesized
guuuauucucauuugggag

SEQ ID NO: 8285 - RNA, 19 nt, artificial
  Chemically synthesized
aaagagccaacagaacaga

SEQ ID NO: 8286 - RNA, 19 nt, artificial
  Chemically synthesized
ugugaaaaagaugccaauu

SEQ ID NO: 8287 - RNA, 19 nt, artificial
  Chemically synthesized
ggcacucuuaaaugaucug

SEQ ID NO: 8288 - RNA, 19 nt, artificial
  Chemically synthesized
aauuugaacacuggcuaaa

SEQ ID NO: 8289 - RNA, 19 nt, artificial
  Chemically synthesized
caagccaaaguggcauguu

SEQ ID NO: 8290 - RNA, 19 nt, artificial
  Chemically synthesized
aucugccucuaaaagcguu

SEQ ID NO: 8291 - RNA, 19 nt, artificial
  Chemically synthesized
aaaaauuugaacacuggcu

SEQ ID NO: 8292 - RNA, 19 nt, artificial
  Chemically synthesized
cuggccucagaagacguca

SEQ ID NO: 8293 - RNA, 19 nt, artificial
  Chemically synthesized
auuugggagaucuggugau

SEQ ID NO: 8294 - RNA, 19 nt, artificial
  Chemically synthesized
ugaaguguaccuguguaca

SEQ ID NO: 8295 - RNA, 19 nt, artificial
  Chemically synthesized
uuaccuuuuauguagcaca

SEQ ID NO: 8296 - RNA, 19 nt, artificial
  Chemically synthesized
cccuuccaccgccauauug

SEQ ID NO: 8297 - RNA, 19 nt, artificial
  Chemically synthesized
gcgagugucuaacgggagc

SEQ ID NO: 8298 - RNA, 19 nt, artificial
  Chemically synthesized
gccaaaguggcauguuuug

SEQ ID NO: 8299 - RNA, 19 nt, artificial
  Chemically synthesized
agacugauccgucggacag

SEQ ID NO: 8300 - RNA, 19 nt, artificial
  Chemically synthesized
aguggcauguuuugugcau

SEQ ID NO: 8301 - RNA, 19 nt, artificial
  Chemically synthesized
ccggcggcgccuuuaauug

SEQ ID NO: 8302 - RNA, 19 nt, artificial
  Chemically synthesized
gagguggagaagggcagcu

SEQ ID NO: 8303 - RNA, 19 nt, artificial
  Chemically synthesized
uugcccgaguucuacuaca

SEQ ID NO: 8304 - RNA, 19 nt, artificial
  Chemically synthesized
ggacuuggagaagcacugc

SEQ ID NO: 8305 - RNA, 19 nt, artificial
  Chemically synthesized
ggcgagccagcgcaagugg

SEQ ID NO: 8306 - RNA, 19 nt, artificial
  Chemically synthesized
gccucccuuccaccgccau

SEQ ID NO: 8307 - RNA, 19 nt, artificial
  Chemically synthesized
cauggaagaggcgagccag

SEQ ID NO: 8308 - RNA, 19 nt, artificial
  Chemically synthesized
acgucaaacguaaacagcu

SEQ ID NO: 8309 - RNA, 19 nt, artificial
  Chemically synthesized
cgugcgagugucuaacggg

SEQ ID NO: 8310 - RNA, 19 nt, artificial
  Chemically synthesized
ggcggcgccuuuaauuggg

SEQ ID NO: 8311 - RNA, 19 nt, artificial
  Chemically synthesized
agcagacgcccaagaagcc

SEQ ID NO: 8312 - RNA, 19 nt, artificial
  Chemically synthesized
guuggauguagcauuaugc

SEQ ID NO: 8313 - RNA, 19 nt, artificial
  Chemically synthesized
uacuaccuguguauauagu

SEQ ID NO: 8314 - RNA, 19 nt, artificial
  Chemically synthesized
guaaugugugaaaaagaug

SEQ ID NO: 8315 - RNA, 19 nt, artificial
  Chemically synthesized
gccuggagcggauggacgc

SEQ ID NO: 8316 - RNA, 19 nt, artificial
  Chemically synthesized
aggagagccaggaugucag

SEQ ID NO: 8317 - RNA, 19 nt, artificial
  Chemically synthesized
gggagaucuggugaucucc

SEQ ID NO: 8318 - RNA, 19 nt, artificial
  Chemically synthesized
acccaaagacugauccguc

SEQ ID NO: 8319 - RNA, 19 nt, artificial
  Chemically synthesized
aaaagagccaacagaacag

SEQ ID NO: 8320 - RNA, 19 nt, artificial
  Chemically synthesized
uaugaagagcuugcuuuga

SEQ ID NO: 8321 - RNA, 19 nt, artificial
  Chemically synthesized
ucuagacaauauacaagcc

SEQ ID NO: 8322 - RNA, 19 nt, artificial
  Chemically synthesized
aucuagacaauauacaagc

SEQ ID NO: 8323 - RNA, 19 nt, artificial
  Chemically synthesized
gcccaagaagccuggccuc

SEQ ID NO: 8324 - RNA, 19 nt, artificial
  Chemically synthesized
gauaagugaaauggauacu

SEQ ID NO: 8325 - RNA, 19 nt, artificial
  Chemically synthesized
ccgucggacagccagacgg

SEQ ID NO: 8326 - RNA, 19 nt, artificial
  Chemically synthesized
cgucggacagccagacggg

SEQ ID NO: 8327 - RNA, 19 nt, artificial
  Chemically synthesized
agccuggagcggauggacg

SEQ ID NO: 8328 - RNA, 19 nt, artificial
  Chemically synthesized
ccgggacuuggagaagcac

SEQ ID NO: 8329 - RNA, 19 nt, artificial
  Chemically synthesized
auuugaaguguaccugugu

SEQ ID NO: 8330 - RNA, 19 nt, artificial
  Chemically synthesized
cacacuuguaggauaagug

SEQ ID NO: 8331 - RNA, 19 nt, artificial
  Chemically synthesized
augaagagaagcaauuuug

SEQ ID NO: 8332 - RNA, 19 nt, artificial
  Chemically synthesized
caggaauaaggaagcgacc

SEQ ID NO: 8333 - RNA, 19 nt, artificial
  Chemically synthesized
aaggaagguucauguagag

SEQ ID NO: 8334 - RNA, 19 nt, artificial
  Chemically synthesized
auucucauuugggagaucu

SEQ ID NO: 8335 - RNA, 19 nt, artificial
  Chemically synthesized
uuccuuauuugcuucauug

SEQ ID NO: 8336 - RNA, 19 nt, artificial
  Chemically synthesized
gugaaauggauacuacauc

SEQ ID NO: 8337 - RNA, 19 nt, artificial
  Chemically synthesized
aaacaguauuucauugccu

SEQ ID NO: 8338 - RNA, 19 nt, artificial
  Chemically synthesized
aagacgucaaacguaaaca

SEQ ID NO: 8339 - RNA, 19 nt, artificial
  Chemically synthesized
uauuucauugccuguguau

SEQ ID NO: 8340 - RNA, 19 nt, artificial
  Chemically synthesized
ccagcgcaaguggaauuuc

SEQ ID NO: 8341 - RNA, 19 nt, artificial
  Chemically synthesized
agcaaggaagauauacaug

SEQ ID NO: 8342 - RNA, 19 nt, artificial
  Chemically synthesized
ggagagccaggaugucagc

SEQ ID NO: 8343 - RNA, 19 nt, artificial
  Chemically synthesized
ugcccgaguucuacuacag

SEQ ID NO: 8344 - RNA, 19 nt, artificial
  Chemically synthesized
caguauuucauugccugug

SEQ ID NO: 8345 - RNA, 19 nt, artificial
  Chemically synthesized
ccuuccaccgccauauugg

SEQ ID NO: 8346 - RNA, 19 nt, artificial
  Chemically synthesized
uugaccaucugcuuuuauu

SEQ ID NO: 8347 - RNA, 19 nt, artificial
  Chemically synthesized
uugcuucauuguacuaccu

SEQ ID NO: 8348 - RNA, 19 nt, artificial
  Chemically synthesized
guuaagaauugaccaucug

SEQ ID NO: 8349 - RNA, 19 nt, artificial
  Chemically synthesized
aacgugcgagugucuaacg

SEQ ID NO: 8350 - RNA, 19 nt, artificial
  Chemically synthesized
aacaguauuucauugccug

SEQ ID NO: 8351 - RNA, 19 nt, artificial
  Chemically synthesized
acuuggagaagcacugcag

SEQ ID NO: 8352 - RNA, 19 nt, artificial
  Chemically synthesized
cacuggcuaaagauaauug

SEQ ID NO: 8353 - RNA, 19 nt, artificial
  Chemically synthesized
agcgaccugcaaccgacga

SEQ ID NO: 8354 - RNA, 19 nt, artificial
  Chemically synthesized
uuuaggcacucuuaaauga

SEQ ID NO: 8355 - RNA, 19 nt, artificial
  Chemically synthesized
acacuggcuaaagauaauu

SEQ ID NO: 8356 - RNA, 19 nt, artificial
  Chemically synthesized
auguagagaaaagcacacu

SEQ ID NO: 8357 - RNA, 19 nt, artificial
  Chemically synthesized
guggcuuuuuuaaaaaagc

SEQ ID NO: 8358 - RNA, 19 nt, artificial
  Chemically synthesized
gaucugccucuaaaagcgu

SEQ ID NO: 8359 - RNA, 19 nt, artificial
  Chemically synthesized
ugaucugccucuaaaagcg

SEQ ID NO: 8360 - RNA, 19 nt, artificial
  Chemically synthesized
gggcuguguaaacacaguc

SEQ ID NO: 8361 - RNA, 19 nt, artificial
  Chemically synthesized
uaccuguguacauaacucu

SEQ ID NO: 8362 - RNA, 19 nt, artificial
  Chemically synthesized
agccuggccucagaagacg

SEQ ID NO: 8363 - RNA, 19 nt, artificial
  Chemically synthesized
uguaccuguguacauaacu

SEQ ID NO: 8364 - RNA, 19 nt, artificial
  Chemically synthesized
uaagaauugaccaucugcu

SEQ ID NO: 8365 - RNA, 19 nt, artificial
  Chemically synthesized
cuaaaagcguuggauguag

SEQ ID NO: 8366 - RNA, 19 nt, artificial
  Chemically synthesized
agccaggaugucagcggga

SEQ ID NO: 8367 - RNA, 19 nt, artificial
  Chemically synthesized
gacugauccgucggacagc

SEQ ID NO: 8368 - RNA, 19 nt, artificial
  Chemically synthesized
ucuguggagcagacgccca

SEQ ID NO: 8369 - RNA, 19 nt, artificial
  Chemically synthesized
ccaagaagccuggccucag

SEQ ID NO: 8370 - RNA, 19 nt, artificial
  Chemically synthesized
cugcaaccgacgauucuuc

SEQ ID NO: 8371 - RNA, 19 nt, artificial
  Chemically synthesized
uacucaaaacaaaagagcc

SEQ ID NO: 8372 - RNA, 19 nt, artificial
  Chemically synthesized
ugccggcgcaggagagcca

SEQ ID NO: 8373 - RNA, 19 nt, artificial
  Chemically synthesized
aacagaacagaagaaaaug

SEQ ID NO: 8374 - RNA, 19 nt, artificial
  Chemically synthesized
uuuauucucauuugggaga

SEQ ID NO: 8375 - RNA, 19 nt, artificial
  Chemically synthesized
ugggagaucuggugaucuc

SEQ ID NO: 8376 - RNA, 19 nt, artificial
  Chemically synthesized
aagaagccuggccucagaa

SEQ ID NO: 8377 - RNA, 19 nt, artificial
  Chemically synthesized
ucaaaacaaaagagccaac

SEQ ID NO: 8378 - RNA, 19 nt, artificial
  Chemically synthesized
aaggugccggcgcaggaga

SEQ ID NO: 8379 - RNA, 19 nt, artificial
  Chemically synthesized
gcaggagagccaggauguc

SEQ ID NO: 8380 - RNA, 19 nt, artificial
  Chemically synthesized
cuggagcggauggacgcca

SEQ ID NO: 8381 - RNA, 19 nt, artificial
  Chemically synthesized
ccaaaguggcauguuuugu

SEQ ID NO: 8382 - RNA, 19 nt, artificial
  Chemically synthesized
aaaacaaaagagccaacag

SEQ ID NO: 8383 - RNA, 19 nt, artificial
  Chemically synthesized
aauaaggaagcgaccugca

SEQ ID NO: 8384 - RNA, 19 nt, artificial
  Chemically synthesized
auguuuccuuguuuaucag

SEQ ID NO: 8385 - RNA, 19 nt, artificial
  Chemically synthesized
accuguguacauaacucug

SEQ ID NO: 8386 - RNA, 19 nt, artificial
  Chemically synthesized
auacaagccaaaguggcau

SEQ ID NO: 8387 - RNA, 19 nt, artificial
  Chemically synthesized
uagcauuaugcaauuaggu

SEQ ID NO: 8388 - RNA, 19 nt, artificial
  Chemically synthesized
ggagaagggcagcuugccc

SEQ ID NO: 8389 - RNA, 19 nt, artificial
  Chemically synthesized
caaaaauuugaacacuggc

SEQ ID NO: 8390 - RNA, 19 nt, artificial
  Chemically synthesized
accugcaaccgacgauucu

SEQ ID NO: 8391 - RNA, 19 nt, artificial
  Chemically synthesized
agacgcccaagaagccugg

SEQ ID NO: 8392 - RNA, 19 nt, artificial
  Chemically synthesized
cuaaaauuuuaggcacucu

SEQ ID NO: 8393 - RNA, 19 nt, artificial
  Chemically synthesized
aaaagcguuggauguagca

SEQ ID NO: 8394 - RNA, 19 nt, artificial
  Chemically synthesized
gcgcaggaauaaggaagcg

SEQ ID NO: 8395 - RNA, 19 nt, artificial
  Chemically synthesized
aaacgugcgagugucuaac

SEQ ID NO: 8396 - RNA, 19 nt, artificial
  Chemically synthesized
gaugucaaacgugcgagug

SEQ ID NO: 8397 - RNA, 19 nt, artificial
  Chemically synthesized
uggagcggauggacgccag

SEQ ID NO: 8398 - RNA, 19 nt, artificial
  Chemically synthesized
aagauguaaugucccuuuc

SEQ ID NO: 8399 - RNA, 19 nt, artificial
  Chemically synthesized
ugcgagugucuaacgggag

SEQ ID NO: 8400 - RNA, 19 nt, artificial
  Chemically synthesized
guucuguggagcagacgcc

SEQ ID NO: 8401 - RNA, 19 nt, artificial
  Chemically synthesized
gaauaaggaagcgaccugc

SEQ ID NO: 8402 - RNA, 19 nt, artificial
  Chemically synthesized
ucucucuuaaaguuggaau

SEQ ID NO: 8403 - RNA, 19 nt, artificial
  Chemically synthesized
ugcgcaggaauaaggaagc

SEQ ID NO: 8404 - RNA, 19 nt, artificial
  Chemically synthesized
ggagaucuggugaucuccc

SEQ ID NO: 8405 - RNA, 19 nt, artificial
  Chemically synthesized
uuugcuucauuguacuacc

SEQ ID NO: 8406 - RNA, 19 nt, artificial
  Chemically synthesized
ggagcggauggacgccagg

SEQ ID NO: 8407 - RNA, 19 nt, artificial
  Chemically synthesized
augcgcaggaauaaggaag

SEQ ID NO: 8408 - RNA, 19 nt, artificial
  Chemically synthesized
uuauucucauuugggagau

SEQ ID NO: 8409 - RNA, 19 nt, artificial
  Chemically synthesized
gagccaggaugucagcggg

SEQ ID NO: 8410 - RNA, 19 nt, artificial
  Chemically synthesized
uuggauguagcauuaugca

SEQ ID NO: 8411 - RNA, 19 nt, artificial
  Chemically synthesized
acucuuaaaugaucugccu

SEQ ID NO: 8412 - RNA, 19 nt, artificial
  Chemically synthesized
agaaaagcacacuuguagg

SEQ ID NO: 8413 - RNA, 19 nt, artificial
  Chemically synthesized
ugauccgucggacagccag

SEQ ID NO: 8414 - RNA, 19 nt, artificial
  Chemically synthesized
gaagacgucaaacguaaac

SEQ ID NO: 8415 - RNA, 19 nt, artificial
  Chemically synthesized
acuucauggaauggacauc

SEQ ID NO: 8416 - RNA, 19 nt, artificial
  Chemically synthesized
uaaggaagcgaccugcaac

SEQ ID NO: 8417 - RNA, 19 nt, artificial
  Chemically synthesized
uguggagcagacgcccaag

SEQ ID NO: 8418 - RNA, 19 nt, artificial
  Chemically synthesized
agagguggagaagggcagc

SEQ ID NO: 8419 - RNA, 19 nt, artificial
  Chemically synthesized
cggcggcgccuuuaauugg

SEQ ID NO: 8420 - RNA, 19 nt, artificial
  Chemically synthesized
ccaaagacugauccgucgg

SEQ ID NO: 8421 - RNA, 19 nt, artificial
  Chemically synthesized
agaagccuggccucagaag

SEQ ID NO: 8422 - RNA, 19 nt, artificial
  Chemically synthesized
cuuccaccgccauauuggg

SEQ ID NO: 8423 - RNA, 19 nt, artificial
  Chemically synthesized
aagaaaauguuucagacgg

SEQ ID NO: 8424 - RNA, 19 nt, artificial
  Chemically synthesized
auauggcuaugcuuaaaag

SEQ ID NO: 8425 - RNA, 19 nt, artificial
  Chemically synthesized
cagccucccuuccaccgcc

SEQ ID NO: 8426 - RNA, 19 nt, artificial
  Chemically synthesized
ugcaaccgacgauucuucu

SEQ ID NO: 8427 - RNA, 19 nt, artificial
  Chemically synthesized
ggaugucagcgggagccgc

SEQ ID NO: 8428 - RNA, 19 nt, artificial
  Chemically synthesized
uuccuuguuuaucagauac

SEQ ID NO: 8429 - RNA, 19 nt, artificial
  Chemically synthesized
uucucauuugggagaucug

SEQ ID NO: 8430 - RNA, 19 nt, artificial
  Chemically synthesized
agcacacuuguaggauaag

SEQ ID NO: 8431 - RNA, 19 nt, artificial
  Chemically synthesized
uguagcauuaugcaauuag

SEQ ID NO: 8432 - RNA, 19 nt, artificial
  Chemically synthesized
agugucuaacgggagcccu

SEQ ID NO: 8433 - RNA, 19 nt, artificial
  Chemically synthesized
gggcagcuugcccgaguuc

SEQ ID NO: 8434 - RNA, 19 nt, artificial
  Chemically synthesized
ugugcauuuguaaaugcug

SEQ ID NO: 8435 - RNA, 19 nt, artificial
  Chemically synthesized
acgugcgagugucuaacgg

SEQ ID NO: 8436 - RNA, 19 nt, artificial
  Chemically synthesized
ugaagagaagcaauuuugg

SEQ ID NO: 8437 - RNA, 19 nt, artificial
  Chemically synthesized
cagcuugcccgaguucuac

SEQ ID NO: 8438 - RNA, 19 nt, artificial
  Chemically synthesized
auguuaagaauugaccauc

SEQ ID NO: 8439 - RNA, 19 nt, artificial
  Chemically synthesized
agaugccaauuauuguuac

SEQ ID NO: 8440 - RNA, 19 nt, artificial
  Chemically synthesized
auuucauugccuguguaug

SEQ ID NO: 8441 - RNA, 19 nt, artificial
  Chemically synthesized
gccugcaggaaccucuucg

SEQ ID NO: 8442 - RNA, 19 nt, artificial
  Chemically synthesized
ucuuaaaugaucugccucu

SEQ ID NO: 8443 - RNA, 19 nt, artificial
  Chemically synthesized
aagccuggccucagaagac

SEQ ID NO: 8444 - RNA, 19 nt, artificial
  Chemically synthesized
gaucuggugaucucccaag

SEQ ID NO: 8445 - RNA, 19 nt, artificial
  Chemically synthesized
auuugaacacuggcuaaag

SEQ ID NO: 8446 - RNA, 19 nt, artificial
  Chemically synthesized
cccaaaugccgguucugug

SEQ ID NO: 8447 - RNA, 19 nt, artificial
  Chemically synthesized
uucauugccuguguaugga

SEQ ID NO: 8448 - RNA, 19 nt, artificial
  Chemically synthesized
cuuaaaguuggaauuuacc

SEQ ID NO: 8449 - RNA, 19 nt, artificial
  Chemically synthesized
caaaguggcauguuuugug

SEQ ID NO: 8450 - RNA, 19 nt, artificial
  Chemically synthesized
ccugcaggaaccucuucgg

SEQ ID NO: 8451 - RNA, 19 nt, artificial
  Chemically synthesized
gcaggaaccucuucggccc

SEQ ID NO: 8452 - RNA, 19 nt, artificial
  Chemically synthesized
ugcauuuguaaaugcugug

SEQ ID NO: 8453 - RNA, 19 nt, artificial
  Chemically synthesized
augcaauuagguuuuuccu

SEQ ID NO: 8454 - RNA, 19 nt, artificial
  Chemically synthesized
uucauggaauggacauccu

SEQ ID NO: 8455 - RNA, 19 nt, artificial
  Chemically synthesized
ugccucuaaaagcguugga

SEQ ID NO: 8456 - RNA, 19 nt, artificial
  Chemically synthesized
aagaucuguaaguaacuuc

SEQ ID NO: 8457 - RNA, 19 nt, artificial
  Chemically synthesized
auguagcacauaaacuuug

SEQ ID NO: 8458 - RNA, 19 nt, artificial
  Chemically synthesized
ugaagcaaggaagauauac

SEQ ID NO: 8459 - RNA, 19 nt, artificial
  Chemically synthesized
uauucucauuugggagauc

SEQ ID NO: 8460 - RNA, 19 nt, artificial
  Chemically synthesized
ggccugcaggaaccucuuc

SEQ ID NO: 8461 - RNA, 19 nt, artificial
  Chemically synthesized
ucauuugggagaucuggug

SEQ ID NO: 8462 - RNA, 19 nt, artificial
  Chemically synthesized
aaagcguuggauguagcau

SEQ ID NO: 8463 - RNA, 19 nt, artificial
  Chemically synthesized
cgguucuguggagcagacg

SEQ ID NO: 8464 - RNA, 19 nt, artificial
  Chemically synthesized
gccaggaugucagcgggag

SEQ ID NO: 8465 - RNA, 19 nt, artificial
  Chemically synthesized
auccgucggacagccagac

SEQ ID NO: 8466 - RNA, 19 nt, artificial
  Chemically synthesized
cgagugucuaacgggagcc

SEQ ID NO: 8467 - RNA, 19 nt, artificial
  Chemically synthesized
ggaaccucuucggcccggu

SEQ ID NO: 8468 - RNA, 19 nt, artificial
  Chemically synthesized
ccuggccucagaagacguc

SEQ ID NO: 8469 - RNA, 19 nt, artificial
  Chemically synthesized
gaagggagggcaggguggg

SEQ ID NO: 8470 - RNA, 19 nt, artificial
  Chemically synthesized
cgucagccucccuuccacc

SEQ ID NO: 8471 - RNA, 19 nt, artificial
  Chemically synthesized
acacuaaaauuuuaggcac

SEQ ID NO: 8472 - RNA, 19 nt, artificial
  Chemically synthesized
aauauacaagccaaagugg

SEQ ID NO: 8473 - RNA, 19 nt, artificial
  Chemically synthesized
uacaagccaaaguggcaug

SEQ ID NO: 8474 - RNA, 19 nt, artificial
  Chemically synthesized
aaaauguuucagacgguuc

SEQ ID NO: 8475 - RNA, 19 nt, artificial
  Chemically synthesized
uucauuguacuaccugugu

SEQ ID NO: 8476 - RNA, 19 nt, artificial
  Chemically synthesized
uugaacacuggcuaaagau

SEQ ID NO: 8477 - RNA, 19 nt, artificial
  Chemically synthesized
uugaugaagcaaggaagau

SEQ ID NO: 8478 - RNA, 19 nt, artificial
  Chemically synthesized
gaagagaagcaauuuuggg

SEQ ID NO: 8479 - RNA, 19 nt, artificial
  Chemically synthesized
acccgggacuuggagaagc

SEQ ID NO: 8480 - RNA, 19 nt, artificial
  Chemically synthesized
cuucauggaauggacaucc

SEQ ID NO: 8481 - RNA, 19 nt, artificial
  Chemically synthesized
acugauccgucggacagcc

SEQ ID NO: 8482 - RNA, 19 nt, artificial
  Chemically synthesized
uuaggcacucuuaaaugau

SEQ ID NO: 8483 - RNA, 19 nt, artificial
  Chemically synthesized
uguagcacauaaacuuugg

SEQ ID NO: 8484 - RNA, 19 nt, artificial
  Chemically synthesized
uccgucggacagccagacg

SEQ ID NO: 8485 - RNA, 19 nt, artificial
  Chemically synthesized
gacgucaaacguaaacagc

SEQ ID NO: 8486 - RNA, 19 nt, artificial
  Chemically synthesized
aaguggcauguuuugugca

SEQ ID NO: 8487 - RNA, 19 nt, artificial
  Chemically synthesized
uugugcauuuguaaaugcu

SEQ ID NO: 8488 - RNA, 19 nt, artificial
  Chemically synthesized
uaaagauguaaugucccuu

SEQ ID NO: 8489 - RNA, 19 nt, artificial
  Chemically synthesized
agacauggaagaggcgagc

SEQ ID NO: 8490 - RNA, 19 nt, artificial
  Chemically synthesized
aaggaagcgaccugcaacc

SEQ ID NO: 8491 - RNA, 19 nt, artificial
  Chemically synthesized
gagugucuaacgggagccc

SEQ ID NO: 8492 - RNA, 19 nt, artificial
  Chemically synthesized
caaaugccgguucugugga

SEQ ID NO: 8493 - RNA, 19 nt, artificial
  Chemically synthesized
auugaccaucugcuuuuau

SEQ ID NO: 8494 - RNA, 19 nt, artificial
  Chemically synthesized
uggagaagggcagcuugcc

SEQ ID NO: 8495 - RNA, 19 nt, artificial
  Chemically synthesized
aggugccggcgcaggagag

SEQ ID NO: 8496 - RNA, 19 nt, artificial
  Chemically synthesized
uucauguagagaaaagcac

SEQ ID NO: 8497 - RNA, 19 nt, artificial
  Chemically synthesized
aaauguuucagacgguucc

SEQ ID NO: 8498 - RNA, 19 nt, artificial
  Chemically synthesized
ugcuucauuguacuaccug

SEQ ID NO: 8499 - RNA, 19 nt, artificial
  Chemically synthesized
acauccuguauaagcacug

SEQ ID NO: 8500 - RNA, 19 nt, artificial
  Chemically synthesized
aauggacauccuguauaag

SEQ ID NO: 8501 - RNA, 19 nt, artificial
  Chemically synthesized
augugugaaaaagaugcca

SEQ ID NO: 8502 - RNA, 19 nt, artificial
  Chemically synthesized
uuaaagauguaaugucccu

SEQ ID NO: 8503 - RNA, 19 nt, artificial
  Chemically synthesized
uugggagaucuggugaucu

SEQ ID NO: 8504 - RNA, 19 nt, artificial
  Chemically synthesized
cucuuaaaugaucugccuc

SEQ ID NO: 8505 - RNA, 19 nt, artificial
  Chemically synthesized
aaaauacauaucgcugacu

SEQ ID NO: 8506 - RNA, 19 nt, artificial
  Chemically synthesized
augccgguucuguggagca

SEQ ID NO: 8507 - RNA, 19 nt, artificial
  Chemically synthesized
ccuggagcggauggacgcc

SEQ ID NO: 8508 - RNA, 19 nt, artificial
  Chemically synthesized
ccaggaugucagcgggagc

SEQ ID NO: 8509 - RNA, 19 nt, artificial
  Chemically synthesized
cugcaaggugccggcgcag

SEQ ID NO: 8510 - RNA, 19 nt, artificial
  Chemically synthesized
cacucuuaaaugaucugcc

SEQ ID NO: 8511 - RNA, 19 nt, artificial
  Chemically synthesized
ucucauuugggagaucugg

SEQ ID NO: 8512 - RNA, 19 nt, artificial
  Chemically synthesized
acagaagaaaauguuucag

SEQ ID NO: 8513 - RNA, 19 nt, artificial
  Chemically synthesized
aagcgaccugcaaccgacg

SEQ ID NO: 8514 - RNA, 19 nt, artificial
  Chemically synthesized
ucauggaauggacauccug

SEQ ID NO: 8515 - RNA, 19 nt, artificial
  Chemically synthesized
aaugaucugccucuaaaag

SEQ ID NO: 8516 - RNA, 19 nt, artificial
  Chemically synthesized
gucagccucccuuccaccg

SEQ ID NO: 8517 - RNA, 19 nt, artificial
  Chemically synthesized
uaaaguuggaauuuaccag

SEQ ID NO: 8518 - RNA, 19 nt, artificial
  Chemically synthesized
caaggugccggcgcaggag

SEQ ID NO: 8519 - RNA, 19 nt, artificial
  Chemically synthesized
uagccuggagcggauggac

SEQ ID NO: 8520 - RNA, 19 nt, artificial
  Chemically synthesized
aaagacugauccgucggac

SEQ ID NO: 8521 - RNA, 19 nt, artificial
  Chemically synthesized
aucacuccagguaguuugg

SEQ ID NO: 8522 - RNA, 19 nt, artificial
  Chemically synthesized
ccaaaugccgguucugugg

SEQ ID NO: 8523 - RNA, 19 nt, artificial
  Chemically synthesized
uuaacccgggacuuggaga

SEQ ID NO: 8524 - RNA, 19 nt, artificial
  Chemically synthesized
acaagccaaaguggcaugu

SEQ ID NO: 8525 - RNA, 19 nt, artificial
  Chemically synthesized
auggacauccuguauaagc

SEQ ID NO: 8526 - RNA, 19 nt, artificial
  Chemically synthesized
auauacaagccaaaguggc

SEQ ID NO: 8527 - RNA, 19 nt, artificial
  Chemically synthesized
uagguuuuuccuuauuugc

SEQ ID NO: 8528 - RNA, 19 nt, artificial
  Chemically synthesized
cuugcccgaguucuacuac

SEQ ID NO: 8529 - RNA, 19 nt, artificial
  Chemically synthesized
uuucauugccuguguaugg

SEQ ID NO: 8530 - RNA, 19 nt, artificial
  Chemically synthesized
uuggguagaauagguuuuc

SEQ ID NO: 8531 - RNA, 19 nt, artificial
  Chemically synthesized
ugaggacacgcauuuggug

SEQ ID NO: 8532 - RNA, 19 nt, artificial
  Chemically synthesized
uuaagaauugaccaucugc

SEQ ID NO: 8533 - RNA, 19 nt, artificial
  Chemically synthesized
uugaaguguaccuguguac

SEQ ID NO: 8534 - RNA, 19 nt, artificial
  Chemically synthesized
auuugcuucauuguacuac

SEQ ID NO: 8535 - RNA, 19 nt, artificial
  Chemically synthesized
uaaugugugaaaaagaugc

SEQ ID NO: 8536 - RNA, 19 nt, artificial
  Chemically synthesized
gacauggaagaggcgagcc

SEQ ID NO: 8537 - RNA, 19 nt, artificial
  Chemically synthesized
cugccucuaaaagcguugg

SEQ ID NO: 8538 - RNA, 19 nt, artificial
  Chemically synthesized
uuugggagaucuggugauc

SEQ ID NO: 8539 - RNA, 19 nt, artificial
  Chemically synthesized
aucuggugaucucccaagc

SEQ ID NO: 8540 - RNA, 19 nt, artificial
  Chemically synthesized
agagccaggaugucagcgg

SEQ ID NO: 8541 - RNA, 19 nt, artificial
  Chemically synthesized
acuggcuaaagauaauugc

SEQ ID NO: 8542 - RNA, 19 nt, artificial
  Chemically synthesized
uaugcaauuagguuuuucc

SEQ ID NO: 8543 - RNA, 19 nt, artificial
  Chemically synthesized
ucugccucuaaaagcguug

SEQ ID NO: 8544 - RNA, 19 nt, artificial
  Chemically synthesized
gaugucagcgggagccgcc

SEQ ID NO: 8545 - RNA, 19 nt, artificial
  Chemically synthesized
uuguaggauaagugaaaug

SEQ ID NO: 8546 - RNA, 19 nt, artificial
  Chemically synthesized
gacgcccaagaagccuggc

SEQ ID NO: 8547 - RNA, 19 nt, artificial
  Chemically synthesized
ucuucgucagccucccuuc

SEQ ID NO: 8548 - RNA, 19 nt, artificial
  Chemically synthesized
aaaagcacacuuguaggau

SEQ ID NO: 8549 - RNA, 19 nt, artificial
  Chemically synthesized
uauggcuaugcuuaaaagg

SEQ ID NO: 8550 - RNA, 19 nt, artificial
  Chemically synthesized
aacccgggacuuggagaag

SEQ ID NO: 8551 - RNA, 19 nt, artificial
  Chemically synthesized
cuucuucgucagccucccu

SEQ ID NO: 8552 - RNA, 19 nt, artificial
  Chemically synthesized
gcacucuuaaaugaucugc

SEQ ID NO: 8553 - RNA, 19 nt, artificial
  Chemically synthesized
augaucugccucuaaaagc

SEQ ID NO: 8554 - RNA, 19 nt, artificial
  Chemically synthesized
auugggccacuaaaaaaag

SEQ ID NO: 8555 - RNA, 19 nt, artificial
  Chemically synthesized
acuaaaauuuuaggcacuc

SEQ ID NO: 8556 - RNA, 19 nt, artificial
  Chemically synthesized
gagagccaggaugucagcg

SEQ ID NO: 8557 - RNA, 19 nt, artificial
  Chemically synthesized
aggaagcgaccugcaaccg

SEQ ID NO: 8558 - RNA, 19 nt, artificial
  Chemically synthesized
ugccgguucuguggagcag

SEQ ID NO: 8559 - RNA, 19 nt, artificial
  Chemically synthesized
uguaggauaagugaaaugg

SEQ ID NO: 8560 - RNA, 19 nt, artificial
  Chemically synthesized
uaaagaaaacuuccauagc

SEQ ID NO: 8561 - RNA, 19 nt, artificial
  Chemically synthesized
uaaaagcguuggauguagc

SEQ ID NO: 8562 - RNA, 19 nt, artificial
  Chemically synthesized
uaaacaguauuucauugcc

SEQ ID NO: 8563 - RNA, 19 nt, artificial
  Chemically synthesized
caggaugucagcgggagcc

SEQ ID NO: 8564 - RNA, 19 nt, artificial
  Chemically synthesized
aggaugucagcgggagccg

SEQ ID NO: 8565 - RNA, 19 nt, artificial
  Chemically synthesized
ucgucagccucccuuccac

SEQ ID NO: 8566 - RNA, 19 nt, artificial
  Chemically synthesized
guagcacauaaacuuuggg

SEQ ID NO: 8567 - RNA, 19 nt, artificial
  Chemically synthesized
cuucgucagccucccuucc

SEQ ID NO: 8568 - RNA, 19 nt, artificial
  Chemically synthesized
uuugugcauuuguaaaugc

SEQ ID NO: 8569 - RNA, 19 nt, artificial
  Chemically synthesized
aauguuucagacgguuccc

SEQ ID NO: 8570 - RNA, 19 nt, artificial
  Chemically synthesized
uuuuaggcacucuuaaaug

SEQ ID NO: 8571 - RNA, 19 nt, artificial
  Chemically synthesized
aaaguggcauguuuugugc

SEQ ID NO: 8572 - RNA, 19 nt, artificial
  Chemically synthesized
ugcaaggugccggcgcagg

SEQ ID NO: 8573 - RNA, 19 nt, artificial
  Chemically synthesized
ugggccacuaaaaaaaggg

SEQ ID NO: 8574 - RNA, 19 nt, artificial
  Chemically synthesized
uucuucgucagccucccuu

SEQ ID NO: 8575 - RNA, 19 nt, artificial
  Chemically synthesized
gaaccucuucggcccggug

SEQ ID NO: 8576 - RNA, 19 nt, artificial
  Chemically synthesized
cugcaggaaccucuucggc

SEQ ID NO: 8577 - RNA, 19 nt, artificial
  Chemically synthesized
ucugaggacacgcauuugg

SEQ ID NO: 8578 - RNA, 19 nt, artificial
  Chemically synthesized
aaaugccgguucuguggag

SEQ ID NO: 8579 - RNA, 19 nt, artificial
  Chemically synthesized
uucgucagccucccuucca

SEQ ID NO: 8580 - RNA, 19 nt, artificial
  Chemically synthesized
acgcccaagaagccuggcc

SEQ ID NO: 8581 - RNA, 19 nt, artificial
  Chemically synthesized
uucuguggagcagacgccc

SEQ ID NO: 8582 - RNA, 19 nt, artificial
  Chemically synthesized
uugggccacuaaaaaaagg

SEQ ID NO: 8583 - RNA, 19 nt, artificial
  Chemically synthesized
ugccugcaaggugccggcg

SEQ ID NO: 8584 - RNA, 19 nt, artificial
  Chemically synthesized
caggaaccucuucggcccg

SEQ ID NO: 8585 - RNA, 19 nt, artificial
  Chemically synthesized
aaugugugaaaaagaugcc

SEQ ID NO: 8586 - RNA, 19 nt, artificial
  Chemically synthesized
uuuaaagauguaauguccc

SEQ ID NO: 8587 - RNA, 19 nt, artificial
  Chemically synthesized
ucagccucccuuccaccgc

SEQ ID NO: 8588 - RNA, 19 nt, artificial
  Chemically synthesized
augucagcgggagccgccc

SEQ ID NO: 8589 - RNA, 19 nt, artificial
  Chemically synthesized
uuuaccuuuuauguagcac

SEQ ID NO: 8590 - RNA, 19 nt, artificial
  Chemically synthesized
ugcaggaaccucuucggcc

SEQ ID NO: 8591 - RNA, 19 nt, artificial
  Chemically synthesized
uccaccgccauauugggcc

SEQ ID NO: 8592 - RNA, 19 nt, artificial
  Chemically synthesized
aaugccgguucuguggagc

SEQ ID NO: 8593 - RNA, 19 nt, artificial
  Chemically synthesized
uuccaccgccauauugggc

SEQ ID NO: 8594 - RNA, 19 nt, artificial
  Chemically synthesized
aggaaccucuucggcccgg

SEQ ID NO: 8595 - RNA, 19 nt, artificial
  Chemically synthesized
ucacuccagguaguuuggg

SEQ ID NO: 8596 - RNA, 19 nt, artificial
  Chemically synthesized
cauccaacgcuuuuagagg

SEQ ID NO: 8597 - RNA, 19 nt, artificial
  Chemically synthesized
uauacacagguaguacaau

SEQ ID NO: 8598 - RNA, 19 nt, artificial
  Chemically synthesized
gaagugaaaagaaaaugag

SEQ ID NO: 8599 - RNA, 19 nt, artificial
  Chemically synthesized
caagugugcuuuucucuac

SEQ ID NO: 8600 - RNA, 19 nt, artificial
  Chemically synthesized
acuuuggcuuguauauugu

SEQ ID NO: 8601 - RNA, 19 nt, artificial
  Chemically synthesized
ucgcuuccuuauuccugcg

SEQ ID NO: 8602 - RNA, 19 nt, artificial
  Chemically synthesized
agugccuaaaauuuuagug

SEQ ID NO: 8603 - RNA, 19 nt, artificial
  Chemically synthesized
gucgguugcaggucgcuuc

SEQ ID NO: 8604 - RNA, 19 nt, artificial
  Chemically synthesized
uguaucugauaaacaagga

SEQ ID NO: 8605 - RNA, 19 nt, artificial
  Chemically synthesized
guccauuccaugaagucag

SEQ ID NO: 8606 - RNA, 19 nt, artificial
  Chemically synthesized
gcucuccaaaccuugccgg

SEQ ID NO: 8607 - RNA, 19 nt, artificial
  Chemically synthesized
uaaaagcagauggucaauu

SEQ ID NO: 8608 - RNA, 19 nt, artificial
  Chemically synthesized
ucucuacaugaaccuuccu

SEQ ID NO: 8609 - RNA, 19 nt, artificial
  Chemically synthesized
aacucgggcaagcugcccu

SEQ ID NO: 8610 - RNA, 19 nt, artificial
  Chemically synthesized
augugaaguuacuuacaga

SEQ ID NO: 8611 - RNA, 19 nt, artificial
  Chemically synthesized
aaccgucugaaacauuuuc

SEQ ID NO: 8612 - RNA, 19 nt, artificial
  Chemically synthesized
acauuuucuucuguucugu

SEQ ID NO: 8613 - RNA, 19 nt, artificial
  Chemically synthesized
acaaugaagcaaauaagga

SEQ ID NO: 8614 - RNA, 19 nt, artificial
  Chemically synthesized
aagcagauggucaauucuu

SEQ ID NO: 8615 - RNA, 19 nt, artificial
  Chemically synthesized
uguccauuccaugaaguca

SEQ ID NO: 8616 - RNA, 19 nt, artificial
  Chemically synthesized
auguauaucuuccuugcuu

SEQ ID NO: 8617 - RNA, 19 nt, artificial
  Chemically synthesized
acuuauccuacaagugugc

SEQ ID NO: 8618 - RNA, 19 nt, artificial
  Chemically synthesized
aucgucgguugcaggucgc

SEQ ID NO: 8619 - RNA, 19 nt, artificial
  Chemically synthesized
acacucgcacguuugacau

SEQ ID NO: 8620 - RNA, 19 nt, artificial
  Chemically synthesized
cuuuggcuuguauauuguc

SEQ ID NO: 8621 - RNA, 19 nt, artificial
  Chemically synthesized
uagccaguguucaaauuuu

SEQ ID NO: 8622 - RNA, 19 nt, artificial
  Chemically synthesized
gcgucugcuccacagaacc

SEQ ID NO: 8623 - RNA, 19 nt, artificial
  Chemically synthesized
gggucuguaguagaacucg

SEQ ID NO: 8624 - RNA, 19 nt, artificial
  Chemically synthesized
caggcuucuugggcgucug

SEQ ID NO: 8625 - RNA, 19 nt, artificial
  Chemically synthesized
cuucuguucuguuggcucu

SEQ ID NO: 8626 - RNA, 19 nt, artificial
  Chemically synthesized
uugggagaucaccagaucu

SEQ ID NO: 8627 - RNA, 19 nt, artificial
  Chemically synthesized
ucaccagaucucccaaaug

SEQ ID NO: 8628 - RNA, 19 nt, artificial
  Chemically synthesized
uuuuuccauacacaggcaa

SEQ ID NO: 8629 - RNA, 19 nt, artificial
  Chemically synthesized
aaagggacauuacaucuuu

SEQ ID NO: 8630 - RNA, 19 nt, artificial
  Chemically synthesized
agugcuuauacaggauguc

SEQ ID NO: 8631 - RNA, 19 nt, artificial
  Chemically synthesized
gaaacauuuucuucuguuc

SEQ ID NO: 8632 - RNA, 19 nt, artificial
  Chemically synthesized
uuccaacuuuaagagagac

SEQ ID NO: 8633 - RNA, 19 nt, artificial
  Chemically synthesized
augugcuacauaaaaggua

SEQ ID NO: 8634 - RNA, 19 nt, artificial
  Chemically synthesized
guucuguuggcucuuuugu

SEQ ID NO: 8635 - RNA, 19 nt, artificial
  Chemically synthesized
gauguaucugauaaacaag

SEQ ID NO: 8636 - RNA, 19 nt, artificial
  Chemically synthesized
gacacucgcacguuugaca

SEQ ID NO: 8637 - RNA, 19 nt, artificial
  Chemically synthesized
agaucauuuaagagugccu

SEQ ID NO: 8638 - RNA, 19 nt, artificial
  Chemically synthesized
aggcuucuugggcgucugc

SEQ ID NO: 8639 - RNA, 19 nt, artificial
  Chemically synthesized
caaaugcacaaaacaugcc

SEQ ID NO: 8640 - RNA, 19 nt, artificial
  Chemically synthesized
ucacuuauccuacaagugu

SEQ ID NO: 8641 - RNA, 19 nt, artificial
  Chemically synthesized
acaggcaaugaaauacugu

SEQ ID NO: 8642 - RNA, 19 nt, artificial
  Chemically synthesized
ugaggccaggcuucuuggg

SEQ ID NO: 8643 - RNA, 19 nt, artificial
  Chemically synthesized
agcuauggaaguuuucuuu

SEQ ID NO: 8644 - RNA, 19 nt, artificial
  Chemically synthesized
uacauccaacgcuuuuaga

SEQ ID NO: 8645 - RNA, 19 nt, artificial
  Chemically synthesized
auacaggauguccauucca

SEQ ID NO: 8646 - RNA, 19 nt, artificial
  Chemically synthesized
acugguaaauuccaacuuu

SEQ ID NO: 8647 - RNA, 19 nt, artificial
  Chemically synthesized
aauauggcgguggaaggga

SEQ ID NO: 8648 - RNA, 19 nt, artificial
  Chemically synthesized
uggcgguggaagggaggcu

SEQ ID NO: 8649 - RNA, 19 nt, artificial
  Chemically synthesized
uuccauacacaggcaauga

SEQ ID NO: 8650 - RNA, 19 nt, artificial
  Chemically synthesized
uuuuuuaguggcccaauau

SEQ ID NO: 8651 - RNA, 19 nt, artificial
  Chemically synthesized
caaacuaccuggagugauc

SEQ ID NO: 8652 - RNA, 19 nt, artificial
  Chemically synthesized
gaagcaaauaaggaaaaac

SEQ ID NO: 8653 - RNA, 19 nt, artificial
  Chemically synthesized
gaguuauguacacagguac

SEQ ID NO: 8654 - RNA, 19 nt, artificial
  Chemically synthesized
guuuaaagauguaguaucc

SEQ ID NO: 8655 - RNA, 19 nt, artificial
  Chemically synthesized
uacuuggcucaguaugcaa

SEQ ID NO: 8656 - RNA, 19 nt, artificial
  Chemically synthesized
uugcaggucgcuuccuuau

SEQ ID NO: 8657 - RNA, 19 nt, artificial
  Chemically synthesized
aggccaggcuucuugggcg

SEQ ID NO: 8658 - RNA, 19 nt, artificial
  Chemically synthesized
gucugcuccacagaaccgg

SEQ ID NO: 8659 - RNA, 19 nt, artificial
  Chemically synthesized
ccaguguucaaauuuuugu

SEQ ID NO: 8660 - RNA, 19 nt, artificial
  Chemically synthesized
agcaauuaucuuuagccag

SEQ ID NO: 8661 - RNA, 19 nt, artificial
  Chemically synthesized
ccacccugcccucccuucc

SEQ ID NO: 8662 - RNA, 19 nt, artificial
  Chemically synthesized
cacccugcccucccuuccc

SEQ ID NO: 8663 - RNA, 19 nt, artificial
  Chemically synthesized
ugccacuuuggcuuguaua

SEQ ID NO: 8664 - RNA, 19 nt, artificial
  Chemically synthesized
uacacagguacacuucaaa

SEQ ID NO: 8665 - RNA, 19 nt, artificial
  Chemically synthesized
acaagugugcuuuucucua

SEQ ID NO: 8666 - RNA, 19 nt, artificial
  Chemically synthesized
ggacauuacaucuuuaaag

SEQ ID NO: 8667 - RNA, 19 nt, artificial
  Chemically synthesized
cacagguaguacaaugaag

SEQ ID NO: 8668 - RNA, 19 nt, artificial
  Chemically synthesized
gugcuuauacaggaugucc

SEQ ID NO: 8669 - RNA, 19 nt, artificial
  Chemically synthesized
cggaucagucuuugggucc

SEQ ID NO: 8670 - RNA, 19 nt, artificial
  Chemically synthesized
gcaagcugcccuucuccac

SEQ ID NO: 8671 - RNA, 19 nt, artificial
  Chemically synthesized
auuauacuuggcucaguau

SEQ ID NO: 8672 - RNA, 19 nt, artificial
  Chemically synthesized
aggucgcuuccuuauuccu

SEQ ID NO: 8673 - RNA, 19 nt, artificial
  Chemically synthesized
uucuccaagucccggguua

SEQ ID NO: 8674 - RNA, 19 nt, artificial
  Chemically synthesized
uagacacucgcacguuuga

SEQ ID NO: 8675 - RNA, 19 nt, artificial
  Chemically synthesized
uggcuguccgacggaucag

SEQ ID NO: 8676 - RNA, 19 nt, artificial
  Chemically synthesized
auauacacagguaguacaa

SEQ ID NO: 8677 - RNA, 19 nt, artificial
  Chemically synthesized
cauccuggcucuccugcgc

SEQ ID NO: 8678 - RNA, 19 nt, artificial
  Chemically synthesized
auuaaaggcgccgccgggc

SEQ ID NO: 8679 - RNA, 19 nt, artificial
  Chemically synthesized
agcaaauaaggaaaaaccu

SEQ ID NO: 8680 - RNA, 19 nt, artificial
  Chemically synthesized
uucagugcuuauacaggau

SEQ ID NO: 8681 - RNA, 19 nt, artificial
  Chemically synthesized
gagcuguuuacguuugacg

SEQ ID NO: 8682 - RNA, 19 nt, artificial
  Chemically synthesized
uccugcgccggcaccuugc

SEQ ID NO: 8683 - RNA, 19 nt, artificial
  Chemically synthesized
guuauguacacagguacac

SEQ ID NO: 8684 - RNA, 19 nt, artificial
  Chemically synthesized
uggcucgccucuuccaugu

SEQ ID NO: 8685 - RNA, 19 nt, artificial
  Chemically synthesized
aguagaacucgggcaagcu

SEQ ID NO: 8686 - RNA, 19 nt, artificial
  Chemically synthesized
agaacucgggcaagcugcc

SEQ ID NO: 8687 - RNA, 19 nt, artificial
  Chemically synthesized
ucugauaaacaaggaaaca

SEQ ID NO: 8688 - RNA, 19 nt, artificial
  Chemically synthesized
aaggaaaaaccuaauugca

SEQ ID NO: 8689 - RNA, 19 nt, artificial
  Chemically synthesized
uuggcaucuuuuucacaca

SEQ ID NO: 8690 - RNA, 19 nt, artificial
  Chemically synthesized
uccuggcucuccugcgccg

SEQ ID NO: 8691 - RNA, 19 nt, artificial
  Chemically synthesized
gugugcuuuucucuacaug

SEQ ID NO: 8692 - RNA, 19 nt, artificial
  Chemically synthesized
uuuuuuuaguggcccaaua

SEQ ID NO: 8693 - RNA, 19 nt, artificial
  Chemically synthesized
gugaaguuacuuacagauc

SEQ ID NO: 8694 - RNA, 19 nt, artificial
  Chemically synthesized
cuguuuacguuugacgucu

SEQ ID NO: 8695 - RNA, 19 nt, artificial
  Chemically synthesized
cucccaaaugagaauaaac

SEQ ID NO: 8696 - RNA, 19 nt, artificial
  Chemically synthesized
ucuguucuguuggcucuuu

SEQ ID NO: 8697 - RNA, 19 nt, artificial
  Chemically synthesized
aauuggcaucuuuuucaca

SEQ ID NO: 8698 - RNA, 19 nt, artificial
  Chemically synthesized
cagaucauuuaagagugcc

SEQ ID NO: 8699 - RNA, 19 nt, artificial
  Chemically synthesized
uuuagccaguguucaaauu

SEQ ID NO: 8700 - RNA, 19 nt, artificial
  Chemically synthesized
aacaugccacuuuggcuug

SEQ ID NO: 8701 - RNA, 19 nt, artificial
  Chemically synthesized
aacgcuuuuagaggcagau

SEQ ID NO: 8702 - RNA, 19 nt, artificial
  Chemically synthesized
agccaguguucaaauuuuu

SEQ ID NO: 8703 - RNA, 19 nt, artificial
  Chemically synthesized
ugacgucuucugaggccag

SEQ ID NO: 8704 - RNA, 19 nt, artificial
  Chemically synthesized
aucaccagaucucccaaau

SEQ ID NO: 8705 - RNA, 19 nt, artificial
  Chemically synthesized
uguacacagguacacuuca

SEQ ID NO: 8706 - RNA, 19 nt, artificial
  Chemically synthesized
ugugcuacauaaaagguaa

SEQ ID NO: 8707 - RNA, 19 nt, artificial
  Chemically synthesized
caauauggcgguggaaggg

SEQ ID NO: 8708 - RNA, 19 nt, artificial
  Chemically synthesized
gcucccguuagacacucgc

SEQ ID NO: 8709 - RNA, 19 nt, artificial
  Chemically synthesized
caaaacaugccacuuuggc

SEQ ID NO: 8710 - RNA, 19 nt, artificial
  Chemically synthesized
cuguccgacggaucagucu

SEQ ID NO: 8711 - RNA, 19 nt, artificial
  Chemically synthesized
augcacaaaacaugccacu

SEQ ID NO: 8712 - RNA, 19 nt, artificial
  Chemically synthesized
caauuaaaggcgccgccgg

SEQ ID NO: 8713 - RNA, 19 nt, artificial
  Chemically synthesized
agcugcccuucuccaccuc

SEQ ID NO: 8714 - RNA, 19 nt, artificial
  Chemically synthesized
uguaguagaacucgggcaa

SEQ ID NO: 8715 - RNA, 19 nt, artificial
  Chemically synthesized
gcagugcuucuccaagucc

SEQ ID NO: 8716 - RNA, 19 nt, artificial
  Chemically synthesized
ccacuugcgcuggcucgcc

SEQ ID NO: 8717 - RNA, 19 nt, artificial
  Chemically synthesized
auggcgguggaagggaggc

SEQ ID NO: 8718 - RNA, 19 nt, artificial
  Chemically synthesized
cuggcucgccucuuccaug

SEQ ID NO: 8719 - RNA, 19 nt, artificial
  Chemically synthesized
agcuguuuacguuugacgu

SEQ ID NO: 8720 - RNA, 19 nt, artificial
  Chemically synthesized
cccguuagacacucgcacg

SEQ ID NO: 8721 - RNA, 19 nt, artificial
  Chemically synthesized
cccaauuaaaggcgccgcc

SEQ ID NO: 8722 - RNA, 19 nt, artificial
  Chemically synthesized
ggcuucuugggcgucugcu

SEQ ID NO: 8723 - RNA, 19 nt, artificial
  Chemically synthesized
gcauaaugcuacauccaac

SEQ ID NO: 8724 - RNA, 19 nt, artificial
  Chemically synthesized
acuauauacacagguagua

SEQ ID NO: 8725 - RNA, 19 nt, artificial
  Chemically synthesized
caucuuuuucacacauuac

SEQ ID NO: 8726 - RNA, 19 nt, artificial
  Chemically synthesized
gcguccauccgcuccaggc

SEQ ID NO: 8727 - RNA, 19 nt, artificial
  Chemically synthesized
cugacauccuggcucuccu

SEQ ID NO: 8728 - RNA, 19 nt, artificial
  Chemically synthesized
ggagaucaccagaucuccc

SEQ ID NO: 8729 - RNA, 19 nt, artificial
  Chemically synthesized
gacggaucagucuuugggu

SEQ ID NO: 8730 - RNA, 19 nt, artificial
  Chemically synthesized
cuguucuguuggcucuuuu

SEQ ID NO: 8731 - RNA, 19 nt, artificial
  Chemically synthesized
ucaaagcaagcucuucaua

SEQ ID NO: 8732 - RNA, 19 nt, artificial
  Chemically synthesized
ggcuuguauauugucuaga

SEQ ID NO: 8733 - RNA, 19 nt, artificial
  Chemically synthesized
gcuuguauauugucuagau

SEQ ID NO: 8734 - RNA, 19 nt, artificial
  Chemically synthesized
gaggccaggcuucuugggc

SEQ ID NO: 8735 - RNA, 19 nt, artificial
  Chemically synthesized
aguauccauuucacuuauc

SEQ ID NO: 8736 - RNA, 19 nt, artificial
  Chemically synthesized
ccgucuggcuguccgacgg

SEQ ID NO: 8737 - RNA, 19 nt, artificial
  Chemically synthesized
cccgucuggcuguccgacg

SEQ ID NO: 8738 - RNA, 19 nt, artificial
  Chemically synthesized
cguccauccgcuccaggcu

SEQ ID NO: 8739 - RNA, 19 nt, artificial
  Chemically synthesized
gugcuucuccaagucccgg

SEQ ID NO: 8740 - RNA, 19 nt, artificial
  Chemically synthesized
acacagguacacuucaaau

SEQ ID NO: 8741 - RNA, 19 nt, artificial
  Chemically synthesized
cacuuauccuacaagugug

SEQ ID NO: 8742 - RNA, 19 nt, artificial
  Chemically synthesized
caaaauugcuucucuucau

SEQ ID NO: 8743 - RNA, 19 nt, artificial
  Chemically synthesized
ggucgcuuccuuauuccug

SEQ ID NO: 8744 - RNA, 19 nt, artificial
  Chemically synthesized
cucuacaugaaccuuccuu

SEQ ID NO: 8745 - RNA, 19 nt, artificial
  Chemically synthesized
agaucucccaaaugagaau

SEQ ID NO: 8746 - RNA, 19 nt, artificial
  Chemically synthesized
caaugaagcaaauaaggaa

SEQ ID NO: 8747 - RNA, 19 nt, artificial
  Chemically synthesized
gauguaguauccauuucac

SEQ ID NO: 8748 - RNA, 19 nt, artificial
  Chemically synthesized
aggcaaugaaauacuguuu

SEQ ID NO: 8749 - RNA, 19 nt, artificial
  Chemically synthesized
uguuuacguuugacgucuu

SEQ ID NO: 8750 - RNA, 19 nt, artificial
  Chemically synthesized
auacacaggcaaugaaaua

SEQ ID NO: 8751 - RNA, 19 nt, artificial
  Chemically synthesized
gaaauuccacuugcgcugg

SEQ ID NO: 8752 - RNA, 19 nt, artificial
  Chemically synthesized
cauguauaucuuccuugcu

SEQ ID NO: 8753 - RNA, 19 nt, artificial
  Chemically synthesized
gcugacauccuggcucucc

SEQ ID NO: 8754 - RNA, 19 nt, artificial
  Chemically synthesized
cuguaguagaacucgggca

SEQ ID NO: 8755 - RNA, 19 nt, artificial
  Chemically synthesized
cacaggcaaugaaauacug

SEQ ID NO: 8756 - RNA, 19 nt, artificial
  Chemically synthesized
ccaauauggcgguggaagg

SEQ ID NO: 8757 - RNA, 19 nt, artificial
  Chemically synthesized
aauaaaagcagauggucaa

SEQ ID NO: 8758 - RNA, 19 nt, artificial
  Chemically synthesized
agguaguacaaugaagcaa

SEQ ID NO: 8759 - RNA, 19 nt, artificial
  Chemically synthesized
cagauggucaauucuuaac

SEQ ID NO: 8760 - RNA, 19 nt, artificial
  Chemically synthesized
cguuagacacucgcacguu

SEQ ID NO: 8761 - RNA, 19 nt, artificial
  Chemically synthesized
caggcaaugaaauacuguu

SEQ ID NO: 8762 - RNA, 19 nt, artificial
  Chemically synthesized
cugcagugcuucuccaagu

SEQ ID NO: 8763 - RNA, 19 nt, artificial
  Chemically synthesized
caauuaucuuuagccagug

SEQ ID NO: 8764 - RNA, 19 nt, artificial
  Chemically synthesized
ucgucgguugcaggucgcu

SEQ ID NO: 8765 - RNA, 19 nt, artificial
  Chemically synthesized
ucauuuaagagugccuaaa

SEQ ID NO: 8766 - RNA, 19 nt, artificial
  Chemically synthesized
aauuaucuuuagccagugu

SEQ ID NO: 8767 - RNA, 19 nt, artificial
  Chemically synthesized
agugugcuuuucucuacau

SEQ ID NO: 8768 - RNA, 19 nt, artificial
  Chemically synthesized
gcuuuuuuaaaaaagccac

SEQ ID NO: 8769 - RNA, 19 nt, artificial
  Chemically synthesized
acgcuuuuagaggcagauc

SEQ ID NO: 8770 - RNA, 19 nt, artificial
  Chemically synthesized
cgcuuuuagaggcagauca

SEQ ID NO: 8771 - RNA, 19 nt, artificial
  Chemically synthesized
gacuguguuuacacagccc

SEQ ID NO: 8772 - RNA, 19 nt, artificial
  Chemically synthesized
agaguuauguacacaggua

SEQ ID NO: 8773 - RNA, 19 nt, artificial
  Chemically synthesized
cgucuucugaggccaggcu

SEQ ID NO: 8774 - RNA, 19 nt, artificial
  Chemically synthesized
aguuauguacacagguaca

SEQ ID NO: 8775 - RNA, 19 nt, artificial
  Chemically synthesized
agcagauggucaauucuua

SEQ ID NO: 8776 - RNA, 19 nt, artificial
  Chemically synthesized
cuacauccaacgcuuuuag

SEQ ID NO: 8777 - RNA, 19 nt, artificial
  Chemically synthesized
ucccgcugacauccuggcu

SEQ ID NO: 8778 - RNA, 19 nt, artificial
  Chemically synthesized
gcuguccgacggaucaguc

SEQ ID NO: 8779 - RNA, 19 nt, artificial
  Chemically synthesized
ugggcgucugcuccacaga

SEQ ID NO: 8780 - RNA, 19 nt, artificial
  Chemically synthesized
cugaggccaggcuucuugg

SEQ ID NO: 8781 - RNA, 19 nt, artificial
  Chemically synthesized
gaagaaucgucgguugcag

SEQ ID NO: 8782 - RNA, 19 nt, artificial
  Chemically synthesized
ggcucuuuuguuuugagua

SEQ ID NO: 8783 - RNA, 19 nt, artificial
  Chemically synthesized
uggcucuccugcgccggca

SEQ ID NO: 8784 - RNA, 19 nt, artificial
  Chemically synthesized
cauuuucuucuguucuguu

SEQ ID NO: 8785 - RNA, 19 nt, artificial
  Chemically synthesized
ucucccaaaugagaauaaa

SEQ ID NO: 8786 - RNA, 19 nt, artificial
  Chemically synthesized
gagaucaccagaucuccca

SEQ ID NO: 8787 - RNA, 19 nt, artificial
  Chemically synthesized
uucugaggccaggcuucuu

SEQ ID NO: 8788 - RNA, 19 nt, artificial
  Chemically synthesized
guuggcucuuuuguuuuga

SEQ ID NO: 8789 - RNA, 19 nt, artificial
  Chemically synthesized
ucuccugcgccggcaccuu

SEQ ID NO: 8790 - RNA, 19 nt, artificial
  Chemically synthesized
gacauccuggcucuccugc

SEQ ID NO: 8791 - RNA, 19 nt, artificial
  Chemically synthesized
uggcguccauccgcuccag

SEQ ID NO: 8792 - RNA, 19 nt, artificial
  Chemically synthesized
acaaaacaugccacuuugg

SEQ ID NO: 8793 - RNA, 19 nt, artificial
  Chemically synthesized
cuguuggcucuuuuguuuu

SEQ ID NO: 8794 - RNA, 19 nt, artificial
  Chemically synthesized
ugcaggucgcuuccuuauu

SEQ ID NO: 8795 - RNA, 19 nt, artificial
  Chemically synthesized
cugauaaacaaggaaacau

SEQ ID NO: 8796 - RNA, 19 nt, artificial
  Chemically synthesized
cagaguuauguacacaggu

SEQ ID NO: 8797 - RNA, 19 nt, artificial
  Chemically synthesized
augccacuuuggcuuguau

SEQ ID NO: 8798 - RNA, 19 nt, artificial
  Chemically synthesized
accuaauugcauaaugcua

SEQ ID NO: 8799 - RNA, 19 nt, artificial
  Chemically synthesized
gggcaagcugcccuucucc

SEQ ID NO: 8800 - RNA, 19 nt, artificial
  Chemically synthesized
gccaguguucaaauuuuug

SEQ ID NO: 8801 - RNA, 19 nt, artificial
  Chemically synthesized
agaaucgucgguugcaggu

SEQ ID NO: 8802 - RNA, 19 nt, artificial
  Chemically synthesized
ccaggcuucuugggcgucu

SEQ ID NO: 8803 - RNA, 19 nt, artificial
  Chemically synthesized
agagugccuaaaauuuuag

SEQ ID NO: 8804 - RNA, 19 nt, artificial
  Chemically synthesized
ugcuacauccaacgcuuuu

SEQ ID NO: 8805 - RNA, 19 nt, artificial
  Chemically synthesized
cgcuuccuuauuccugcgc

SEQ ID NO: 8806 - RNA, 19 nt, artificial
  Chemically synthesized
guuagacacucgcacguuu

SEQ ID NO: 8807 - RNA, 19 nt, artificial
  Chemically synthesized
cacucgcacguuugacauc

SEQ ID NO: 8808 - RNA, 19 nt, artificial
  Chemically synthesized
cuggcguccauccgcucca

SEQ ID NO: 8809 - RNA, 19 nt, artificial
  Chemically synthesized
gaaagggacauuacaucuu

SEQ ID NO: 8810 - RNA, 19 nt, artificial
  Chemically synthesized
cucccguuagacacucgca

SEQ ID NO: 8811 - RNA, 19 nt, artificial
  Chemically synthesized
ggcgucugcuccacagaac

SEQ ID NO: 8812 - RNA, 19 nt, artificial
  Chemically synthesized
gcaggucgcuuccuuauuc

SEQ ID NO: 8813 - RNA, 19 nt, artificial
  Chemically synthesized
auuccaacuuuaagagaga

SEQ ID NO: 8814 - RNA, 19 nt, artificial
  Chemically synthesized
gcuuccuuauuccugcgca

SEQ ID NO: 8815 - RNA, 19 nt, artificial
  Chemically synthesized
gggagaucaccagaucucc

SEQ ID NO: 8816 - RNA, 19 nt, artificial
  Chemically synthesized
gguaguacaaugaagcaaa

SEQ ID NO: 8817 - RNA, 19 nt, artificial
  Chemically synthesized
ccuggcguccauccgcucc

SEQ ID NO: 8818 - RNA, 19 nt, artificial
  Chemically synthesized
cuuccuuauuccugcgcau

SEQ ID NO: 8819 - RNA, 19 nt, artificial
  Chemically synthesized
aucucccaaaugagaauaa

SEQ ID NO: 8820 - RNA, 19 nt, artificial
  Chemically synthesized
cccgcugacauccuggcuc

SEQ ID NO: 8821 - RNA, 19 nt, artificial
  Chemically synthesized
ugcauaaugcuacauccaa

SEQ ID NO: 8822 - RNA, 19 nt, artificial
  Chemically synthesized
aggcagaucauuuaagagu

SEQ ID NO: 8823 - RNA, 19 nt, artificial
  Chemically synthesized
ccuacaagugugcuuuucu

SEQ ID NO: 8824 - RNA, 19 nt, artificial
  Chemically synthesized
cuggcuguccgacggauca

SEQ ID NO: 8825 - RNA, 19 nt, artificial
  Chemically synthesized
guuuacguuugacgucuuc

SEQ ID NO: 8826 - RNA, 19 nt, artificial
  Chemically synthesized
gauguccauuccaugaagu

SEQ ID NO: 8827 - RNA, 19 nt, artificial
  Chemically synthesized
guugcaggucgcuuccuua

SEQ ID NO: 8828 - RNA, 19 nt, artificial
  Chemically synthesized
cuugggcgucugcuccaca

SEQ ID NO: 8829 - RNA, 19 nt, artificial
  Chemically synthesized
gcugcccuucuccaccucu

SEQ ID NO: 8830 - RNA, 19 nt, artificial
  Chemically synthesized
ccaauuaaaggcgccgccg

SEQ ID NO: 8831 - RNA, 19 nt, artificial
  Chemically synthesized
ccgacggaucagucuuugg

SEQ ID NO: 8832 - RNA, 19 nt, artificial
  Chemically synthesized
cuucugaggccaggcuucu

SEQ ID NO: 8833 - RNA, 19 nt, artificial
  Chemically synthesized
cccaauauggcgguggaag

SEQ ID NO: 8834 - RNA, 19 nt, artificial
  Chemically synthesized
ccgucugaaacauuuucuu

SEQ ID NO: 8835 - RNA, 19 nt, artificial
  Chemically synthesized
cuuuuaagcauagccauau

SEQ ID NO: 8836 - RNA, 19 nt, artificial
  Chemically synthesized
ggcgguggaagggaggcug

SEQ ID NO: 8837 - RNA, 19 nt, artificial
  Chemically synthesized
agaagaaucgucgguugca

SEQ ID NO: 8838 - RNA, 19 nt, artificial
  Chemically synthesized
gcggcucccgcugacaucc

SEQ ID NO: 8839 - RNA, 19 nt, artificial
  Chemically synthesized
guaucugauaaacaaggaa

SEQ ID NO: 8840 - RNA, 19 nt, artificial
  Chemically synthesized
cagaucucccaaaugagaa

SEQ ID NO: 8841 - RNA, 19 nt, artificial
  Chemically synthesized
cuuauccuacaagugugcu

SEQ ID NO: 8842 - RNA, 19 nt, artificial
  Chemically synthesized
cuaauugcauaaugcuaca

SEQ ID NO: 8843 - RNA, 19 nt, artificial
  Chemically synthesized
agggcucccguuagacacu

SEQ ID NO: 8844 - RNA, 19 nt, artificial
  Chemically synthesized
gaacucgggcaagcugccc

SEQ ID NO: 8845 - RNA, 19 nt, artificial
  Chemically synthesized
cagcauuuacaaaugcaca

SEQ ID NO: 8846 - RNA, 19 nt, artificial
  Chemically synthesized
ccguuagacacucgcacgu

SEQ ID NO: 8847 - RNA, 19 nt, artificial
  Chemically synthesized
ccaaaauugcuucucuuca

SEQ ID NO: 8848 - RNA, 19 nt, artificial
  Chemically synthesized
guagaacucgggcaagcug

SEQ ID NO: 8849 - RNA, 19 nt, artificial
  Chemically synthesized
gauggucaauucuuaacau

SEQ ID NO: 8850 - RNA, 19 nt, artificial
  Chemically synthesized
guaacaauaauuggcaucu

SEQ ID NO: 8851 - RNA, 19 nt, artificial
  Chemically synthesized
cauacacaggcaaugaaau

SEQ ID NO: 8852 - RNA, 19 nt, artificial
  Chemically synthesized
cgaagagguuccugcaggc

SEQ ID NO: 8853 - RNA, 19 nt, artificial
  Chemically synthesized
agaggcagaucauuuaaga

SEQ ID NO: 8854 - RNA, 19 nt, artificial
  Chemically synthesized
gucuucugaggccaggcuu

SEQ ID NO: 8855 - RNA, 19 nt, artificial
  Chemically synthesized
cuugggagaucaccagauc

SEQ ID NO: 8856 - RNA, 19 nt, artificial
  Chemically synthesized
cuuuagccaguguucaaau

SEQ ID NO: 8857 - RNA, 19 nt, artificial
  Chemically synthesized
cacagaaccggcauuuggg

SEQ ID NO: 8858 - RNA, 19 nt, artificial
  Chemically synthesized
uccauacacaggcaaugaa

SEQ ID NO: 8859 - RNA, 19 nt, artificial
  Chemically synthesized
gguaaauuccaacuuuaag

SEQ ID NO: 8860 - RNA, 19 nt, artificial
  Chemically synthesized
cacaaaacaugccacuuug

SEQ ID NO: 8861 - RNA, 19 nt, artificial
  Chemically synthesized
ccgaagagguuccugcagg

SEQ ID NO: 8862 - RNA, 19 nt, artificial
  Chemically synthesized
gggccgaagagguuccugc

SEQ ID NO: 8863 - RNA, 19 nt, artificial
  Chemically synthesized
cacagcauuuacaaaugca

SEQ ID NO: 8864 - RNA, 19 nt, artificial
  Chemically synthesized
aggaaaaaccuaauugcau

SEQ ID NO: 8865 - RNA, 19 nt, artificial
  Chemically synthesized
aggauguccauuccaugaa

SEQ ID NO: 8866 - RNA, 19 nt, artificial
  Chemically synthesized
uccaacgcuuuuagaggca

SEQ ID NO: 8867 - RNA, 19 nt, artificial
  Chemically synthesized
gaaguuacuuacagaucuu

SEQ ID NO: 8868 - RNA, 19 nt, artificial
  Chemically synthesized
caaaguuuaugugcuacau

SEQ ID NO: 8869 - RNA, 19 nt, artificial
  Chemically synthesized
guauaucuuccuugcuuca

SEQ ID NO: 8870 - RNA, 19 nt, artificial
  Chemically synthesized
gaucucccaaaugagaaua

SEQ ID NO: 8871 - RNA, 19 nt, artificial
  Chemically synthesized
gaagagguuccugcaggcc

SEQ ID NO: 8872 - RNA, 19 nt, artificial
  Chemically synthesized
caccagaucucccaaauga

SEQ ID NO: 8873 - RNA, 19 nt, artificial
  Chemically synthesized
augcuacauccaacgcuuu

SEQ ID NO: 8874 - RNA, 19 nt, artificial
  Chemically synthesized
cgucugcuccacagaaccg

SEQ ID NO: 8875 - RNA, 19 nt, artificial
  Chemically synthesized
cucccgcugacauccuggc

SEQ ID NO: 8876 - RNA, 19 nt, artificial
  Chemically synthesized
gucuggcuguccgacggau

SEQ ID NO: 8877 - RNA, 19 nt, artificial
  Chemically synthesized
ggcucccguuagacacucg

SEQ ID NO: 8878 - RNA, 19 nt, artificial
  Chemically synthesized
accgggccgaagagguucc

SEQ ID NO: 8879 - RNA, 19 nt, artificial
  Chemically synthesized
gacgucuucugaggccagg

SEQ ID NO: 8880 - RNA, 19 nt, artificial
  Chemically synthesized
cccacccugcccucccuuc

SEQ ID NO: 8881 - RNA, 19 nt, artificial
  Chemically synthesized
gguggaagggaggcugacg

SEQ ID NO: 8882 - RNA, 19 nt, artificial
  Chemically synthesized
gugccuaaaauuuuagugu

SEQ ID NO: 8883 - RNA, 19 nt, artificial
  Chemically synthesized
ccacuuuggcuuguauauu

SEQ ID NO: 8884 - RNA, 19 nt, artificial
  Chemically synthesized
caugccacuuuggcuugua

SEQ ID NO: 8885 - RNA, 19 nt, artificial
  Chemically synthesized
gaaccgucugaaacauuuu

SEQ ID NO: 8886 - RNA, 19 nt, artificial
  Chemically synthesized
acacagguaguacaaugaa

SEQ ID NO: 8887 - RNA, 19 nt, artificial
  Chemically synthesized
aucuuuagccaguguucaa

SEQ ID NO: 8888 - RNA, 19 nt, artificial
  Chemically synthesized
aucuuccuugcuucaucaa

SEQ ID NO: 8889 - RNA, 19 nt, artificial
  Chemically synthesized
cccaaaauugcuucucuuc

SEQ ID NO: 8890 - RNA, 19 nt, artificial
  Chemically synthesized
gcuucuccaagucccgggu

SEQ ID NO: 8891 - RNA, 19 nt, artificial
  Chemically synthesized
ggauguccauuccaugaag

SEQ ID NO: 8892 - RNA, 19 nt, artificial
  Chemically synthesized
ggcuguccgacggaucagu

SEQ ID NO: 8893 - RNA, 19 nt, artificial
  Chemically synthesized
aucauuuaagagugccuaa

SEQ ID NO: 8894 - RNA, 19 nt, artificial
  Chemically synthesized
ccaaaguuuaugugcuaca

SEQ ID NO: 8895 - RNA, 19 nt, artificial
  Chemically synthesized
cgucuggcuguccgacgga

SEQ ID NO: 8896 - RNA, 19 nt, artificial
  Chemically synthesized
gcuguuuacguuugacguc

SEQ ID NO: 8897 - RNA, 19 nt, artificial
  Chemically synthesized
ugcacaaaacaugccacuu

SEQ ID NO: 8898 - RNA, 19 nt, artificial
  Chemically synthesized
agcauuuacaaaugcacaa

SEQ ID NO: 8899 - RNA, 19 nt, artificial
  Chemically synthesized
aagggacauuacaucuuua

SEQ ID NO: 8900 - RNA, 19 nt, artificial
  Chemically synthesized
gcucgccucuuccaugucu

SEQ ID NO: 8901 - RNA, 19 nt, artificial
  Chemically synthesized
gguugcaggucgcuuccuu

SEQ ID NO: 8902 - RNA, 19 nt, artificial
  Chemically synthesized
gggcucccguuagacacuc

SEQ ID NO: 8903 - RNA, 19 nt, artificial
  Chemically synthesized
uccacagaaccggcauuug

SEQ ID NO: 8904 - RNA, 19 nt, artificial
  Chemically synthesized
auaaaagcagauggucaau

SEQ ID NO: 8905 - RNA, 19 nt, artificial
  Chemically synthesized
ggcaagcugcccuucucca

SEQ ID NO: 8906 - RNA, 19 nt, artificial
  Chemically synthesized
cucuccugcgccggcaccu

SEQ ID NO: 8907 - RNA, 19 nt, artificial
  Chemically synthesized
gugcuuuucucuacaugaa

SEQ ID NO: 8908 - RNA, 19 nt, artificial
  Chemically synthesized
ggaaccgucugaaacauuu

SEQ ID NO: 8909 - RNA, 19 nt, artificial
  Chemically synthesized
cagguaguacaaugaagca

SEQ ID NO: 8910 - RNA, 19 nt, artificial
  Chemically synthesized
cagugcuuauacaggaugu

SEQ ID NO: 8911 - RNA, 19 nt, artificial
  Chemically synthesized
cuuauacaggauguccauu

SEQ ID NO: 8912 - RNA, 19 nt, artificial
  Chemically synthesized
uggcaucuuuuucacacau

SEQ ID NO: 8913 - RNA, 19 nt, artificial
  Chemically synthesized
agggacauuacaucuuuaa

SEQ ID NO: 8914 - RNA, 19 nt, artificial
  Chemically synthesized
agaucaccagaucucccaa

SEQ ID NO: 8915 - RNA, 19 nt, artificial
  Chemically synthesized
gaggcagaucauuuaagag

SEQ ID NO: 8916 - RNA, 19 nt, artificial
  Chemically synthesized
agucagcgauauguauuuu

SEQ ID NO: 8917 - RNA, 19 nt, artificial
  Chemically synthesized
ugcuccacagaaccggcau

SEQ ID NO: 8918 - RNA, 19 nt, artificial
  Chemically synthesized
ggcguccauccgcuccagg

SEQ ID NO: 8919 - RNA, 19 nt, artificial
  Chemically synthesized
gcucccgcugacauccugg

SEQ ID NO: 8920 - RNA, 19 nt, artificial
  Chemically synthesized
cugcgccggcaccuugcag

SEQ ID NO: 8921 - RNA, 19 nt, artificial
  Chemically synthesized
ggcagaucauuuaagagug

SEQ ID NO: 8922 - RNA, 19 nt, artificial
  Chemically synthesized
ccagaucucccaaaugaga

SEQ ID NO: 8923 - RNA, 19 nt, artificial
  Chemically synthesized
cugaaacauuuucuucugu

SEQ ID NO: 8924 - RNA, 19 nt, artificial
  Chemically synthesized
cgucgguugcaggucgcuu

SEQ ID NO: 8925 - RNA, 19 nt, artificial
  Chemically synthesized
caggauguccauuccauga

SEQ ID NO: 8926 - RNA, 19 nt, artificial
  Chemically synthesized
cuuuuagaggcagaucauu

SEQ ID NO: 8927 - RNA, 19 nt, artificial
  Chemically synthesized
cgguggaagggaggcugac

SEQ ID NO: 8928 - RNA, 19 nt, artificial
  Chemically synthesized
cugguaaauuccaacuuua

SEQ ID NO: 8929 - RNA, 19 nt, artificial
  Chemically synthesized
cuccugcgccggcaccuug

SEQ ID NO: 8930 - RNA, 19 nt, artificial
  Chemically synthesized
guccauccgcuccaggcua

SEQ ID NO: 8931 - RNA, 19 nt, artificial
  Chemically synthesized
guccgacggaucagucuuu

SEQ ID NO: 8932 - RNA, 19 nt, artificial
  Chemically synthesized
ccaaacuaccuggagugau

SEQ ID NO: 8933 - RNA, 19 nt, artificial
  Chemically synthesized
ccacagaaccggcauuugg

SEQ ID NO: 8934 - RNA, 19 nt, artificial
  Chemically synthesized
ucuccaagucccggguuaa

SEQ ID NO: 8935 - RNA, 19 nt, artificial
  Chemically synthesized
acaugccacuuuggcuugu

SEQ ID NO: 8936 - RNA, 19 nt, artificial
  Chemically synthesized
gcuuauacaggauguccau

SEQ ID NO: 8937 - RNA, 19 nt, artificial
  Chemically synthesized
gccacuuuggcuuguauau

SEQ ID NO: 8938 - RNA, 19 nt, artificial
  Chemically synthesized
gcaaauaaggaaaaaccua

SEQ ID NO: 8939 - RNA, 19 nt, artificial
  Chemically synthesized
guaguagaacucgggcaag

SEQ ID NO: 8940 - RNA, 19 nt, artificial
  Chemically synthesized
ccauacacaggcaaugaaa

SEQ ID NO: 8941 - RNA, 19 nt, artificial
  Chemically synthesized
gaaaaccuauucuacccaa

SEQ ID NO: 8942 - RNA, 19 nt, artificial
  Chemically synthesized
caccaaaugcguguccuca

SEQ ID NO: 8943 - RNA, 19 nt, artificial
  Chemically synthesized
gcagauggucaauucuuaa

SEQ ID NO: 8944 - RNA, 19 nt, artificial
  Chemically synthesized
guacacagguacacuucaa

SEQ ID NO: 8945 - RNA, 19 nt, artificial
  Chemically synthesized
guaguacaaugaagcaaau

SEQ ID NO: 8946 - RNA, 19 nt, artificial
  Chemically synthesized
gcaucuuuuucacacauua

SEQ ID NO: 8947 - RNA, 19 nt, artificial
  Chemically synthesized
ggcucgccucuuccauguc

SEQ ID NO: 8948 - RNA, 19 nt, artificial
  Chemically synthesized
ccaacgcuuuuagaggcag

SEQ ID NO: 8949 - RNA, 19 nt, artificial
  Chemically synthesized
gaucaccagaucucccaaa

SEQ ID NO: 8950 - RNA, 19 nt, artificial
  Chemically synthesized
gcuugggagaucaccagau

SEQ ID NO: 8951 - RNA, 19 nt, artificial
  Chemically synthesized
ccgcugacauccuggcucu

SEQ ID NO: 8952 - RNA, 19 nt, artificial
  Chemically synthesized
gcaauuaucuuuagccagu

SEQ ID NO: 8953 - RNA, 19 nt, artificial
  Chemically synthesized
ggaaaaaccuaauugcaua

SEQ ID NO: 8954 - RNA, 19 nt, artificial
  Chemically synthesized
caacgcuuuuagaggcaga

SEQ ID NO: 8955 - RNA, 19 nt, artificial
  Chemically synthesized
ggcggcucccgcugacauc

SEQ ID NO: 8956 - RNA, 19 nt, artificial
  Chemically synthesized
cauuucacuuauccuacaa

SEQ ID NO: 8957 - RNA, 19 nt, artificial
  Chemically synthesized
gccaggcuucuugggcguc

SEQ ID NO: 8958 - RNA, 19 nt, artificial
  Chemically synthesized
gaagggaggcugacgaaga

SEQ ID NO: 8959 - RNA, 19 nt, artificial
  Chemically synthesized
auccuacaagugugcuuuu

SEQ ID NO: 8960 - RNA, 19 nt, artificial
  Chemically synthesized
ccuuuuaagcauagccaua

SEQ ID NO: 8961 - RNA, 19 nt, artificial
  Chemically synthesized
cuucuccaagucccggguu

SEQ ID NO: 8962 - RNA, 19 nt, artificial
  Chemically synthesized
agggaggcugacgaagaag

SEQ ID NO: 8963 - RNA, 19 nt, artificial
  Chemically synthesized
gcagaucauuuaagagugc

SEQ ID NO: 8964 - RNA, 19 nt, artificial
  Chemically synthesized
gcuuuuagaggcagaucau

SEQ ID NO: 8965 - RNA, 19 nt, artificial
  Chemically synthesized
cuuuuuuuaguggcccaau

SEQ ID NO: 8966 - RNA, 19 nt, artificial
  Chemically synthesized
gagugccuaaaauuuuagu

SEQ ID NO: 8967 - RNA, 19 nt, artificial
  Chemically synthesized
cgcugacauccuggcucuc

SEQ ID NO: 8968 - RNA, 19 nt, artificial
  Chemically synthesized
cgguugcaggucgcuuccu

SEQ ID NO: 8969 - RNA, 19 nt, artificial
  Chemically synthesized
cugcuccacagaaccggca

SEQ ID NO: 8970 - RNA, 19 nt, artificial
  Chemically synthesized
ccauuucacuuauccuaca

SEQ ID NO: 8971 - RNA, 19 nt, artificial
  Chemically synthesized
gcuauggaaguuuucuuua

SEQ ID NO: 8972 - RNA, 19 nt, artificial
  Chemically synthesized
gcuacauccaacgcuuuua

SEQ ID NO: 8973 - RNA, 19 nt, artificial
  Chemically synthesized
ggcaaugaaauacuguuua

SEQ ID NO: 8974 - RNA, 19 nt, artificial
  Chemically synthesized
ggcucccgcugacauccug

SEQ ID NO: 8975 - RNA, 19 nt, artificial
  Chemically synthesized
cggcucccgcugacauccu

SEQ ID NO: 8976 - RNA, 19 nt, artificial
  Chemically synthesized
guggaagggaggcugacga

SEQ ID NO: 8977 - RNA, 19 nt, artificial
  Chemically synthesized
cccaaaguuuaugugcuac

SEQ ID NO: 8978 - RNA, 19 nt, artificial
  Chemically synthesized
ggaagggaggcugacgaag

SEQ ID NO: 8979 - RNA, 19 nt, artificial
  Chemically synthesized
gcauuuacaaaugcacaaa

SEQ ID NO: 8980 - RNA, 19 nt, artificial
  Chemically synthesized
gggaaccgucugaaacauu

SEQ ID NO: 8981 - RNA, 19 nt, artificial
  Chemically synthesized
cauuuaagagugccuaaaa

SEQ ID NO: 8982 - RNA, 19 nt, artificial
  Chemically synthesized
gcacaaaacaugccacuuu

SEQ ID NO: 8983 - RNA, 19 nt, artificial
  Chemically synthesized
ccugcgccggcaccuugca

SEQ ID NO: 8984 - RNA, 19 nt, artificial
  Chemically synthesized
cccuuuuuuuaguggccca

SEQ ID NO: 8985 - RNA, 19 nt, artificial
  Chemically synthesized
aagggaggcugacgaagaa

SEQ ID NO: 8986 - RNA, 19 nt, artificial
  Chemically synthesized
caccgggccgaagagguuc

SEQ ID NO: 8987 - RNA, 19 nt, artificial
  Chemically synthesized
gccgaagagguuccugcag

SEQ ID NO: 8988 - RNA, 19 nt, artificial
  Chemically synthesized
ccaaaugcguguccucaga

SEQ ID NO: 8989 - RNA, 19 nt, artificial
  Chemically synthesized
cuccacagaaccggcauuu

SEQ ID NO: 8990 - RNA, 19 nt, artificial
  Chemically synthesized
uggaagggaggcugacgaa

SEQ ID NO: 8991 - RNA, 19 nt, artificial
  Chemically synthesized
ggccaggcuucuugggcgu

SEQ ID NO: 8992 - RNA, 19 nt, artificial
  Chemically synthesized
gggcgucugcuccacagaa

SEQ ID NO: 8993 - RNA, 19 nt, artificial
  Chemically synthesized
ccuuuuuuuaguggcccaa

SEQ ID NO: 8994 - RNA, 19 nt, artificial
  Chemically synthesized
cgccggcaccuugcaggca

SEQ ID NO: 8995 - RNA, 19 nt, artificial
  Chemically synthesized
cgggccgaagagguuccug

SEQ ID NO: 8996 - RNA, 19 nt, artificial
  Chemically synthesized
ggcaucuuuuucacacauu

SEQ ID NO: 8997 - RNA, 19 nt, artificial
  Chemically synthesized
gggacauuacaucuuuaaa

SEQ ID NO: 8998 - RNA, 19 nt, artificial
  Chemically synthesized
gcgguggaagggaggcuga

SEQ ID NO: 8999 - RNA, 19 nt, artificial
  Chemically synthesized
gggcggcucccgcugacau

SEQ ID NO: 9000 - RNA, 19 nt, artificial
  Chemically synthesized
gugcuacauaaaagguaaa

SEQ ID NO: 9001 - RNA, 19 nt, artificial
  Chemically synthesized
ggccgaagagguuccugca

SEQ ID NO: 9002 - RNA, 19 nt, artificial
  Chemically synthesized
ggcccaauauggcggugga

SEQ ID NO: 9003 - RNA, 19 nt, artificial
  Chemically synthesized
gcuccacagaaccggcauu

SEQ ID NO: 9004 - RNA, 19 nt, artificial
  Chemically synthesized
gcccaauauggcgguggaa

SEQ ID NO: 9005 - RNA, 19 nt, artificial
  Chemically synthesized
ccgggccgaagagguuccu

SEQ ID NO: 9006 - RNA, 19 nt, Artificial Sequence
  Chemically synthesized
cccaaacuaccuggaguga

SEQ ID NO: 9007 - RNA, 18 nt, artificial
  Chemically synthesized
ggcuaaagauaauugcua

SEQ ID NO: 9008 - RNA, 18 nt, artificial
  Chemically synthesized
gggagaaagaugucaaac

SEQ ID NO: 9009 - RNA, 18 nt, artificial
  Chemically synthesized
ggagaaagaugucaaacg

SEQ ID NO: 9010 - RNA, 18 nt, artificial
  Chemically synthesized
cgauucuucuacucaaaa

SEQ ID NO: 9011 - RNA, 18 nt, artificial
  Chemically synthesized
ggguuugaauuguuuucu

SEQ ID NO: 9012 - RNA, 18 nt, artificial
  Chemically synthesized
gguggagaagggcagcuu

SEQ ID NO: 9013 - RNA, 18 nt, artificial
  Chemically synthesized
ggauguagcauuaugcaa

SEQ ID NO: 9014 - RNA, 18 nt, artificial
  Chemically synthesized
agguucauguagagaaaa

SEQ ID NO: 9015 - RNA, 18 nt, artificial
  Chemically synthesized
gggacuuggagaagcacu

SEQ ID NO: 9016 - RNA, 18 nt, artificial
  Chemically synthesized
gggaaggguuugaauugu

SEQ ID NO: 9017 - RNA, 18 nt, artificial
  Chemically synthesized
ggcaaguacgaguggcaa

SEQ ID NO: 9018 - RNA, 18 nt, artificial
  Chemically synthesized
ggagcagacgcccaagaa

SEQ ID NO: 9019 - RNA, 18 nt, artificial
  Chemically synthesized
gagacauggaagaggcga

SEQ ID NO: 9020 - RNA, 18 nt, artificial
  Chemically synthesized
cccgaguucuacuacaga

SEQ ID NO: 9021 - RNA, 18 nt, artificial
  Chemically synthesized
gcaggaauaaggaagcga

SEQ ID NO: 9022 - RNA, 18 nt, artificial
  Chemically synthesized
ggcuaugcuuaaaagguu

SEQ ID NO: 9023 - RNA, 18 nt, artificial
  Chemically synthesized
gaaggguuugaauuguuu

SEQ ID NO: 9024 - RNA, 18 nt, artificial
  Chemically synthesized
gguucauguagagaaaag

SEQ ID NO: 9025 - RNA, 18 nt, artificial
  Chemically synthesized
gcaugaagagaagcaauu

SEQ ID NO: 9026 - RNA, 18 nt, artificial
  Chemically synthesized
gguugcauacugagccaa

SEQ ID NO: 9027 - RNA, 18 nt, artificial
  Chemically synthesized
gcuguguuggguagaaua

SEQ ID NO: 9028 - RNA, 18 nt, artificial
  Chemically synthesized
gcuugaugaagcaaggaa

SEQ ID NO: 9029 - RNA, 18 nt, artificial
  Chemically synthesized
ggauaagugaaauggaua

SEQ ID NO: 9030 - RNA, 18 nt, artificial
  Chemically synthesized
ccgaguucuacuacagac

SEQ ID NO: 9031 - RNA, 18 nt, artificial
  Chemically synthesized
guaugaagagcuugcuuu

SEQ ID NO: 9032 - RNA, 18 nt, artificial
  Chemically synthesized
gcuucauuguacuaccug

SEQ ID NO: 9033 - RNA, 18 nt, artificial
  Chemically synthesized
ggagaagcacugcagaga

SEQ ID NO: 9034 - RNA, 18 nt, artificial
  Chemically synthesized
gccuguguauggaaaaac

SEQ ID NO: 9035 - RNA, 18 nt, artificial
  Chemically synthesized
gagacagcugauacuuca

SEQ ID NO: 9036 - RNA, 18 nt, artificial
  Chemically synthesized
agagcuugcuuugauuua

SEQ ID NO: 9037 - RNA, 18 nt, artificial
  Chemically synthesized
gccggcaagguuuggaga

SEQ ID NO: 9038 - RNA, 18 nt, artificial
  Chemically synthesized
guguaaacacagucaaaa

SEQ ID NO: 9039 - RNA, 18 nt, artificial
  Chemically synthesized
ccauuugaucagcggaga

SEQ ID NO: 9040 - RNA, 18 nt, artificial
  Chemically synthesized
cagagacagcugauacuu

SEQ ID NO: 9041 - RNA, 18 nt, artificial
  Chemically synthesized
guacuaccuguguauaua

SEQ ID NO: 9042 - RNA, 18 nt, artificial
  Chemically synthesized
cguuggauguagcauuau

SEQ ID NO: 9043 - RNA, 18 nt, artificial
  Chemically synthesized
gguaugaagagcuugcuu

SEQ ID NO: 9044 - RNA, 18 nt, artificial
  Chemically synthesized
gaguucuacuacagaccc

SEQ ID NO: 9045 - RNA, 18 nt, artificial
  Chemically synthesized
ggugaucacuccagguag

SEQ ID NO: 9046 - RNA, 18 nt, artificial
  Chemically synthesized
gcagaauggugaucacuc

SEQ ID NO: 9047 - RNA, 18 nt, artificial
  Chemically synthesized
agccaaaguggcauguuu

SEQ ID NO: 9048 - RNA, 18 nt, artificial
  Chemically synthesized
gguuuuuccuuauuugcu

SEQ ID NO: 9049 - RNA, 18 nt, artificial
  Chemically synthesized
gauguagcauuaugcaau

SEQ ID NO: 9050 - RNA, 18 nt, artificial
  Chemically synthesized
gaagcacugcagagacau

SEQ ID NO: 9051 - RNA, 18 nt, artificial
  Chemically synthesized
ggaaggguuugaauuguu

SEQ ID NO: 9052 - RNA, 18 nt, artificial
  Chemically synthesized
gccucagaagacgucaaa

SEQ ID NO: 9053 - RNA, 18 nt, artificial
  Chemically synthesized
ccuuucagagacagcuga

SEQ ID NO: 9054 - RNA, 18 nt, artificial
  Chemically synthesized
guuggguagaauagguuu

SEQ ID NO: 9055 - RNA, 18 nt, artificial
  Chemically synthesized
gagaaagaugucaaacgu

SEQ ID NO: 9056 - RNA, 18 nt, artificial
  Chemically synthesized
cagcucgaauuaagaaua

SEQ ID NO: 9057 - RNA, 18 nt, artificial
  Chemically synthesized
gugcagacccgggagaaa

SEQ ID NO: 9058 - RNA, 18 nt, artificial
  Chemically synthesized
ccuuguuuaucagauaca

SEQ ID NO: 9059 - RNA, 18 nt, artificial
  Chemically synthesized
gaugaagcaaggaagaua

SEQ ID NO: 9060 - RNA, 18 nt, artificial
  Chemically synthesized
cauuguacuaccugugua

SEQ ID NO: 9061 - RNA, 18 nt, artificial
  Chemically synthesized
gcaaguggaauuucgauu

SEQ ID NO: 9062 - RNA, 18 nt, artificial
  Chemically synthesized
gccaauuauuguuacaca

SEQ ID NO: 9063 - RNA, 18 nt, artificial
  Chemically synthesized
cgaggugcuugggaguuu

SEQ ID NO: 9064 - RNA, 18 nt, artificial
  Chemically synthesized
gauguaaugucccuuuca

SEQ ID NO: 9065 - RNA, 18 nt, artificial
  Chemically synthesized
ggcaagguuuggagagcg

SEQ ID NO: 9066 - RNA, 18 nt, artificial
  Chemically synthesized
ggaauaaggaagcgaccu

SEQ ID NO: 9067 - RNA, 18 nt, artificial
  Chemically synthesized
cgccaguccauuugauca

SEQ ID NO: 9068 - RNA, 18 nt, artificial
  Chemically synthesized
caugaagagaagcaauuu

SEQ ID NO: 9069 - RNA, 18 nt, artificial
  Chemically synthesized
gagcagacgcccaagaag

SEQ ID NO: 9070 - RNA, 18 nt, artificial
  Chemically synthesized
gggcaaaaauccgaggug

SEQ ID NO: 9071 - RNA, 18 nt, artificial
  Chemically synthesized
ugacuugcaugaagagaa

SEQ ID NO: 9072 - RNA, 18 nt, artificial
  Chemically synthesized
gagaaaagcacacuugua

SEQ ID NO: 9073 - RNA, 18 nt, artificial
  Chemically synthesized
gaagcgaccugcaaccga

SEQ ID NO: 9074 - RNA, 18 nt, artificial
  Chemically synthesized
cugacuucauggaaugga

SEQ ID NO: 9075 - RNA, 18 nt, artificial
  Chemically synthesized
cccagucucucuuaaagu

SEQ ID NO: 9076 - RNA, 18 nt, artificial
  Chemically synthesized
caacagaacagaagaaaa

SEQ ID NO: 9077 - RNA, 18 nt, artificial
  Chemically synthesized
gcucgaauuaagaauaug

SEQ ID NO: 9078 - RNA, 18 nt, artificial
  Chemically synthesized
guagcauuaugcaauuag

SEQ ID NO: 9079 - RNA, 18 nt, artificial
  Chemically synthesized
ggaaaaaccauuugaagu

SEQ ID NO: 9080 - RNA, 18 nt, artificial
  Chemically synthesized
gcccuagccuggagcgga

SEQ ID NO: 9081 - RNA, 18 nt, artificial
  Chemically synthesized
ggcaagagguggagaagg

SEQ ID NO: 9082 - RNA, 18 nt, artificial
  Chemically synthesized
gcauuaugcaauuagguu

SEQ ID NO: 9083 - RNA, 18 nt, artificial
  Chemically synthesized
ccauuuauccacaggaaa

SEQ ID NO: 9084 - RNA, 18 nt, artificial
  Chemically synthesized
ccaguuaauuacucagca

SEQ ID NO: 9085 - RNA, 18 nt, artificial
  Chemically synthesized
gcucgccaguccauuuga

SEQ ID NO: 9086 - RNA, 18 nt, artificial
  Chemically synthesized
ccggcaagguuuggagag

SEQ ID NO: 9087 - RNA, 18 nt, artificial
  Chemically synthesized
ccgacgccggcaagguuu

SEQ ID NO: 9088 - RNA, 18 nt, artificial
  Chemically synthesized
gacagcugauacuucauu

SEQ ID NO: 9089 - RNA, 18 nt, artificial
  Chemically synthesized
gcagagacauggaagagg

SEQ ID NO: 9090 - RNA, 18 nt, artificial
  Chemically synthesized
agaaaacuuccauagcua

SEQ ID NO: 9091 - RNA, 18 nt, artificial
  Chemically synthesized
gguggacccaaagacuga

SEQ ID NO: 9092 - RNA, 18 nt, artificial
  Chemically synthesized
gacaauauacaagccaaa

SEQ ID NO: 9093 - RNA, 18 nt, artificial
  Chemically synthesized
cgaguucuacuacagacc

SEQ ID NO: 9094 - RNA, 18 nt, artificial
  Chemically synthesized
cucucuuaaaguuggaau

SEQ ID NO: 9095 - RNA, 18 nt, artificial
  Chemically synthesized
ccucuaaaagcguuggau

SEQ ID NO: 9096 - RNA, 18 nt, artificial
  Chemically synthesized
gaagaaaauguuucagac

SEQ ID NO: 9097 - RNA, 18 nt, artificial
  Chemically synthesized
cuuacucuguccauuuau

SEQ ID NO: 9098 - RNA, 18 nt, artificial
  Chemically synthesized
ggcgcaggagagccagga

SEQ ID NO: 9099 - RNA, 18 nt, artificial
  Chemically synthesized
guagagaaaagcacacuu

SEQ ID NO: 9100 - RNA, 18 nt, artificial
  Chemically synthesized
cuuaaaagguugcauacu

SEQ ID NO: 9101 - RNA, 18 nt, artificial
  Chemically synthesized
gguucuguggagcagacg

SEQ ID NO: 9102 - RNA, 18 nt, artificial
  Chemically synthesized
ggcacucuuaaaugaucu

SEQ ID NO: 9103 - RNA, 18 nt, artificial
  Chemically synthesized
agaaaauguuucagacgg

SEQ ID NO: 9104 - RNA, 18 nt, artificial
  Chemically synthesized
caauauacaagccaaagu

SEQ ID NO: 9105 - RNA, 18 nt, artificial
  Chemically synthesized
gcgagugucuaacgggag

SEQ ID NO: 9106 - RNA, 18 nt, artificial
  Chemically synthesized
ggcuccggcuaacucuga

SEQ ID NO: 9107 - RNA, 18 nt, artificial
  Chemically synthesized
cuaaaucccucgauauuu

SEQ ID NO: 9108 - RNA, 18 nt, artificial
  Chemically synthesized
gcuuugauuuacagcaag

SEQ ID NO: 9109 - RNA, 18 nt, artificial
  Chemically synthesized
gaauugaccaucugcuuu

SEQ ID NO: 9110 - RNA, 18 nt, artificial
  Chemically synthesized
cgggagaaagaugucaaa

SEQ ID NO: 9111 - RNA, 18 nt, artificial
  Chemically synthesized
ugucaaacgugcgagugu

SEQ ID NO: 9112 - RNA, 18 nt, artificial
  Chemically synthesized
guccauuugaucagcgga

SEQ ID NO: 9113 - RNA, 18 nt, artificial
  Chemically synthesized
cccaaagacugauccguc

SEQ ID NO: 9114 - RNA, 18 nt, artificial
  Chemically synthesized
cccgcucgccaguccauu

SEQ ID NO: 9115 - RNA, 18 nt, artificial
  Chemically synthesized
guuuccuuguuuaucaga

SEQ ID NO: 9116 - RNA, 18 nt, artificial
  Chemically synthesized
gcgcaaguggaauuucga

SEQ ID NO: 9117 - RNA, 18 nt, artificial
  Chemically synthesized
agccagcgcaaguggaau

SEQ ID NO: 9118 - RNA, 18 nt, artificial
  Chemically synthesized
guaaacagcucgaauuaa

SEQ ID NO: 9119 - RNA, 18 nt, artificial
  Chemically synthesized
ggcaaaaauccgaggugc

SEQ ID NO: 9120 - RNA, 18 nt, artificial
  Chemically synthesized
ggacauccuguauaagca

SEQ ID NO: 9121 - RNA, 18 nt, artificial
  Chemically synthesized
gcauuugguggacccaaa

SEQ ID NO: 9122 - RNA, 18 nt, artificial
  Chemically synthesized
gggaguuuugaauguuaa

SEQ ID NO: 9123 - RNA, 18 nt, artificial
  Chemically synthesized
cgguggaccacgaagagu

SEQ ID NO: 9124 - RNA, 18 nt, artificial
  Chemically synthesized
cacugcagagacauggaa

SEQ ID NO: 9125 - RNA, 18 nt, artificial
  Chemically synthesized
cagacgcccaagaagccu

SEQ ID NO: 9126 - RNA, 18 nt, artificial
  Chemically synthesized
ugauuuacagcaaguaga

SEQ ID NO: 9127 - RNA, 18 nt, artificial
  Chemically synthesized
gccaguccauuugaucag

SEQ ID NO: 9128 - RNA, 18 nt, artificial
  Chemically synthesized
cuguaaguaacuucacau

SEQ ID NO: 9129 - RNA, 18 nt, artificial
  Chemically synthesized
ggguaugaagagcuugcu

SEQ ID NO: 9130 - RNA, 18 nt, artificial
  Chemically synthesized
cggcuaacucugaggaca

SEQ ID NO: 9131 - RNA, 18 nt, artificial
  Chemically synthesized
guaccuguguacauaacu

SEQ ID NO: 9132 - RNA, 18 nt, artificial
  Chemically synthesized
auuugaucagcggagacu

SEQ ID NO: 9133 - RNA, 18 nt, artificial
  Chemically synthesized
cagucucucuuaaaguug

SEQ ID NO: 9134 - RNA, 18 nt, artificial
  Chemically synthesized
cgugcgagugucuaacgg

SEQ ID NO: 9135 - RNA, 18 nt, artificial
  Chemically synthesized
cacugcuugaugaagcaa

SEQ ID NO: 9136 - RNA, 18 nt, artificial
  Chemically synthesized
ccucagaagacgucaaac

SEQ ID NO: 9137 - RNA, 18 nt, artificial
  Chemically synthesized
gcuuacucuguccauuua

SEQ ID NO: 9138 - RNA, 18 nt, artificial
  Chemically synthesized
ccgguucuguggagcaga

SEQ ID NO: 9139 - RNA, 18 nt, artificial
  Chemically synthesized
guguauggaaaaaccauu

SEQ ID NO: 9140 - RNA, 18 nt, artificial
  Chemically synthesized
cuaccuguguauauaguu

SEQ ID NO: 9141 - RNA, 18 nt, artificial
  Chemically synthesized
cagcgcaaguggaauuuc

SEQ ID NO: 9142 - RNA, 18 nt, artificial
  Chemically synthesized
ugcuuaaaagguugcaua

SEQ ID NO: 9143 - RNA, 18 nt, artificial
  Chemically synthesized
uaaugucccuuucagaga

SEQ ID NO: 9144 - RNA, 18 nt, artificial
  Chemically synthesized
ccugcaaccgacgauucu

SEQ ID NO: 9145 - RNA, 18 nt, artificial
  Chemically synthesized
ggcauguuuugugcauuu

SEQ ID NO: 9146 - RNA, 18 nt, artificial
  Chemically synthesized
guggagaagggcagcuug

SEQ ID NO: 9147 - RNA, 18 nt, artificial
  Chemically synthesized
cuguguuggguagaauag

SEQ ID NO: 9148 - RNA, 18 nt, artificial
  Chemically synthesized
cauguagagaaaagcaca

SEQ ID NO: 9149 - RNA, 18 nt, artificial
  Chemically synthesized
agcagaauggugaucacu

SEQ ID NO: 9150 - RNA, 18 nt, artificial
  Chemically synthesized
gaucuguaaguaacuuca

SEQ ID NO: 9151 - RNA, 18 nt, artificial
  Chemically synthesized
ggaagggagggcagggug

SEQ ID NO: 9152 - RNA, 18 nt, artificial
  Chemically synthesized
ccgucggacagccagacg

SEQ ID NO: 9153 - RNA, 18 nt, artificial
  Chemically synthesized
ggcgcuuuguuuuguucg

SEQ ID NO: 9154 - RNA, 18 nt, artificial
  Chemically synthesized
aaggaagguucauguaga

SEQ ID NO: 9155 - RNA, 18 nt, artificial
  Chemically synthesized
cucgccaguccauuugau

SEQ ID NO: 9156 - RNA, 18 nt, artificial
  Chemically synthesized
gaucacuccagguaguuu

SEQ ID NO: 9157 - RNA, 18 nt, artificial
  Chemically synthesized
cuguguauggaaaaacca

SEQ ID NO: 9158 - RNA, 18 nt, artificial
  Chemically synthesized
cagacccgggagaaagau

SEQ ID NO: 9159 - RNA, 18 nt, artificial
  Chemically synthesized
acaaaagagccaacagaa

SEQ ID NO: 9160 - RNA, 18 nt, artificial
  Chemically synthesized
cauuugaaguguaccugu

SEQ ID NO: 9161 - RNA, 18 nt, artificial
  Chemically synthesized
agaaagaugucaaacgug

SEQ ID NO: 9162 - RNA, 18 nt, artificial
  Chemically synthesized
gauacaucacugcuugau

SEQ ID NO: 9163 - RNA, 18 nt, artificial
  Chemically synthesized
caaguggaauuucgauuu

SEQ ID NO: 9164 - RNA, 18 nt, artificial
  Chemically synthesized
cggcaagguuuggagagc

SEQ ID NO: 9165 - RNA, 18 nt, artificial
  Chemically synthesized
ugcuuugauuuacagcaa

SEQ ID NO: 9166 - RNA, 18 nt, artificial
  Chemically synthesized
agugaaauggauacuaca

SEQ ID NO: 9167 - RNA, 18 nt, artificial
  Chemically synthesized
ugcaugaagagaagcaau

SEQ ID NO: 9168 - RNA, 18 nt, artificial
  Chemically synthesized
agagccaacagaacagaa

SEQ ID NO: 9169 - RNA, 18 nt, artificial
  Chemically synthesized
ggugaucucccaagcuau

SEQ ID NO: 9170 - RNA, 18 nt, artificial
  Chemically synthesized
cgucaaacguaaacagcu

SEQ ID NO: 9171 - RNA, 18 nt, artificial
  Chemically synthesized
gggaagggagggcagggu

SEQ ID NO: 9172 - RNA, 18 nt, artificial
  Chemically synthesized
guuaagaauugaccaucu

SEQ ID NO: 9173 - RNA, 18 nt, artificial
  Chemically synthesized
guuuuuuugagagugcga

SEQ ID NO: 9174 - RNA, 18 nt, artificial
  Chemically synthesized
agacgucaaacguaaaca

SEQ ID NO: 9175 - RNA, 18 nt, artificial
  Chemically synthesized
guugcauacugagccaag

SEQ ID NO: 9176 - RNA, 18 nt, artificial
  Chemically synthesized
ugggagaucuggugaucu

SEQ ID NO: 9177 - RNA, 18 nt, artificial
  Chemically synthesized
guuuauucucauuuggga

SEQ ID NO: 9178 - RNA, 18 nt, artificial
  Chemically synthesized
cuucauuguacuaccugu

SEQ ID NO: 9179 - RNA, 18 nt, artificial
  Chemically synthesized
cucuaaaagcguuggaug

SEQ ID NO: 9180 - RNA, 18 nt, artificial
  Chemically synthesized
agcuugcuuugauuuaca

SEQ ID NO: 9181 - RNA, 18 nt, artificial
  Chemically synthesized
gucgcugggcuuccgaga

SEQ ID NO: 9182 - RNA, 18 nt, artificial
  Chemically synthesized
uacugagccaaguauaau

SEQ ID NO: 9183 - RNA, 18 nt, artificial
  Chemically synthesized
uggugaucacuccaggua

SEQ ID NO: 9184 - RNA, 18 nt, artificial
  Chemically synthesized
cgcaaguggaauuucgau

SEQ ID NO: 9185 - RNA, 18 nt, artificial
  Chemically synthesized
ugaagagcuugcuuugau

SEQ ID NO: 9186 - RNA, 18 nt, artificial
  Chemically synthesized
cugcagagacauggaaga

SEQ ID NO: 9187 - RNA, 18 nt, artificial
  Chemically synthesized
caaccgacgauucuucua

SEQ ID NO: 9188 - RNA, 18 nt, artificial
  Chemically synthesized
auucuaaaucccucgaua

SEQ ID NO: 9189 - RNA, 18 nt, artificial
  Chemically synthesized
cucccuuccaccgccaua

SEQ ID NO: 9190 - RNA, 18 nt, artificial
  Chemically synthesized
caagguuuggagagcggc

SEQ ID NO: 9191 - RNA, 18 nt, artificial
  Chemically synthesized
agacugauccgucggaca

SEQ ID NO: 9192 - RNA, 18 nt, artificial
  Chemically synthesized
gcgcaggagagccaggau

SEQ ID NO: 9193 - RNA, 18 nt, artificial
  Chemically synthesized
gugugaaaaagaugccaa

SEQ ID NO: 9194 - RNA, 18 nt, artificial
  Chemically synthesized
ccgcucgccaguccauuu

SEQ ID NO: 9195 - RNA, 18 nt, artificial
  Chemically synthesized
agaagcacugcagagaca

SEQ ID NO: 9196 - RNA, 18 nt, artificial
  Chemically synthesized
gggucugugucuuuuggc

SEQ ID NO: 9197 - RNA, 18 nt, artificial
  Chemically synthesized
cauggaagaggcgagcca

SEQ ID NO: 9198 - RNA, 18 nt, artificial
  Chemically synthesized
gcaagguuuggagagcgg

SEQ ID NO: 9199 - RNA, 18 nt, artificial
  Chemically synthesized
caagcuaucuaaaguuug

SEQ ID NO: 9200 - RNA, 18 nt, artificial
  Chemically synthesized
ggacuuggagaagcacug

SEQ ID NO: 9201 - RNA, 18 nt, artificial
  Chemically synthesized
cugagccaaguauaauuu

SEQ ID NO: 9202 - RNA, 18 nt, artificial
  Chemically synthesized
ggguuagcggagcaaugc

SEQ ID NO: 9203 - RNA, 18 nt, artificial
  Chemically synthesized
uggcuaugcuuaaaaggu

SEQ ID NO: 9204 - RNA, 18 nt, artificial
  Chemically synthesized
gcguuggauguagcauua

SEQ ID NO: 9205 - RNA, 18 nt, artificial
  Chemically synthesized
ggcuaacucugaggacac

SEQ ID NO: 9206 - RNA, 18 nt, artificial
  Chemically synthesized
ccgggacuuggagaagca

SEQ ID NO: 9207 - RNA, 18 nt, artificial
  Chemically synthesized
guguuggguagaauaggu

SEQ ID NO: 9208 - RNA, 18 nt, artificial
  Chemically synthesized
guuaauuacucagcagaa

SEQ ID NO: 9209 - RNA, 18 nt, artificial
  Chemically synthesized
uggugaucucccaagcua

SEQ ID NO: 9210 - RNA, 18 nt, artificial
  Chemically synthesized
aggagagccaggauguca

SEQ ID NO: 9211 - RNA, 18 nt, artificial
  Chemically synthesized
gggagaucuggugaucuc

SEQ ID NO: 9212 - RNA, 18 nt, artificial
  Chemically synthesized
guuggauguagcauuaug

SEQ ID NO: 9213 - RNA, 18 nt, artificial
  Chemically synthesized
accuguguacauaacucu

SEQ ID NO: 9214 - RNA, 18 nt, artificial
  Chemically synthesized
ggcuugcacccgcccaga

SEQ ID NO: 9215 - RNA, 18 nt, artificial
  Chemically synthesized
ggguagaauagguuuucc

SEQ ID NO: 9216 - RNA, 18 nt, artificial
  Chemically synthesized
gccuggagcggauggacg

SEQ ID NO: 9217 - RNA, 18 nt, artificial
  Chemically synthesized
gcuugggaguuuugaaug

SEQ ID NO: 9218 - RNA, 18 nt, artificial
  Chemically synthesized
cgcaggagagccaggaug

SEQ ID NO: 9219 - RNA, 18 nt, artificial
  Chemically synthesized
aaaagagccaacagaaca

SEQ ID NO: 9220 - RNA, 18 nt, artificial
  Chemically synthesized
cauuugaucagcggagac

SEQ ID NO: 9221 - RNA, 18 nt, artificial
  Chemically synthesized
cuuguaggauaagugaaa

SEQ ID NO: 9222 - RNA, 18 nt, artificial
  Chemically synthesized
ucccuuucagagacagcu

SEQ ID NO: 9223 - RNA, 18 nt, artificial
  Chemically synthesized
ucagcagaauggugauca

SEQ ID NO: 9224 - RNA, 18 nt, artificial
  Chemically synthesized
agacccgggagaaagaug

SEQ ID NO: 9225 - RNA, 18 nt, artificial
  Chemically synthesized
cgggacuuggagaagcac

SEQ ID NO: 9226 - RNA, 18 nt, artificial
  Chemically synthesized
ggcgagccagcgcaagug

SEQ ID NO: 9227 - RNA, 18 nt, artificial
  Chemically synthesized
cacugaaaaacaacaaca

SEQ ID NO: 9228 - RNA, 18 nt, artificial
  Chemically synthesized
gcggauggacgccaggca

SEQ ID NO: 9229 - RNA, 18 nt, artificial
  Chemically synthesized
gaccugcaaccgacgauu

SEQ ID NO: 9230 - RNA, 18 nt, artificial
  Chemically synthesized
gaagagcuugcuuugauu

SEQ ID NO: 9231 - RNA, 18 nt, artificial
  Chemically synthesized
gacuucauggaauggaca

SEQ ID NO: 9232 - RNA, 18 nt, artificial
  Chemically synthesized
cccuuccaccgccauauu

SEQ ID NO: 9233 - RNA, 18 nt, artificial
  Chemically synthesized
ggcggcgccuuuaauugg

SEQ ID NO: 9234 - RNA, 18 nt, artificial
  Chemically synthesized
gccaaaguggcauguuuu

SEQ ID NO: 9235 - RNA, 18 nt, artificial
  Chemically synthesized
acccaaagacugauccgu

SEQ ID NO: 9236 - RNA, 18 nt, artificial
  Chemically synthesized
caucacugcuugaugaag

SEQ ID NO: 9237 - RNA, 18 nt, artificial
  Chemically synthesized
caggaauaaggaagcgac

SEQ ID NO: 9238 - RNA, 18 nt, artificial
  Chemically synthesized
ccggcggcgccuuuaauu

SEQ ID NO: 9239 - RNA, 18 nt, artificial
  Chemically synthesized
ggacccaaagacugaucc

SEQ ID NO: 9240 - RNA, 18 nt, artificial
  Chemically synthesized
gucccuuucagagacagc

SEQ ID NO: 9241 - RNA, 18 nt, artificial
  Chemically synthesized
ccaagcuaucuaaaguuu

SEQ ID NO: 9242 - RNA, 18 nt, artificial
  Chemically synthesized
uguguauggaaaaaccau

SEQ ID NO: 9243 - RNA, 18 nt, artificial
  Chemically synthesized
gcccaagaagccuggccu

SEQ ID NO: 9244 - RNA, 18 nt, artificial
  Chemically synthesized
guggcaagagguggagaa

SEQ ID NO: 9245 - RNA, 18 nt, artificial
  Chemically synthesized
ugaucagcggagacucgg

SEQ ID NO: 9246 - RNA, 18 nt, artificial
  Chemically synthesized
gguagaauagguuuuccc

SEQ ID NO: 9247 - RNA, 18 nt, artificial
  Chemically synthesized
ggcagucgcugggcuucc

SEQ ID NO: 9248 - RNA, 18 nt, artificial
  Chemically synthesized
agaugucaaacgugcgag

SEQ ID NO: 9249 - RNA, 18 nt, artificial
  Chemically synthesized
uguguuggguagaauagg

SEQ ID NO: 9250 - RNA, 18 nt, artificial
  Chemically synthesized
guacgaguggcaagaggu

SEQ ID NO: 9251 - RNA, 18 nt, artificial
  Chemically synthesized
gugcauuuguaaaugcug

SEQ ID NO: 9252 - RNA, 18 nt, artificial
  Chemically synthesized
aagcguuggauguagcau

SEQ ID NO: 9253 - RNA, 18 nt, artificial
  Chemically synthesized
gagccagcgcaaguggaa

SEQ ID NO: 9254 - RNA, 18 nt, artificial
  Chemically synthesized
gugaaauggauacuacau

SEQ ID NO: 9255 - RNA, 18 nt, artificial
  Chemically synthesized
ugcccgaguucuacuaca

SEQ ID NO: 9256 - RNA, 18 nt, artificial
  Chemically synthesized
uguaaugucccuuucaga

SEQ ID NO: 9257 - RNA, 18 nt, artificial
  Chemically synthesized
gaaguguaccuguguaca

SEQ ID NO: 9258 - RNA, 18 nt, artificial
  Chemically synthesized
ggagagccaggaugucag

SEQ ID NO: 9259 - RNA, 18 nt, artificial
  Chemically synthesized
gggcagucgcugggcuuc

SEQ ID NO: 9260 - RNA, 18 nt, artificial
  Chemically synthesized
cgucggacagccagacgg

SEQ ID NO: 9261 - RNA, 18 nt, artificial
  Chemically synthesized
ggcucugcgacuccgacg

SEQ ID NO: 9262 - RNA, 18 nt, artificial
  Chemically synthesized
cucagaagacgucaaacg

SEQ ID NO: 9263 - RNA, 18 nt, artificial
  Chemically synthesized
ccagcgcaaguggaauuu

SEQ ID NO: 9264 - RNA, 18 nt, artificial
  Chemically synthesized
ggcuccgagggcagucgc

SEQ ID NO: 9265 - RNA, 18 nt, artificial
  Chemically synthesized
gcaacagaaaccuauccu

SEQ ID NO: 9266 - RNA, 18 nt, artificial
  Chemically synthesized
caaguacgaguggcaaga

SEQ ID NO: 9267 - RNA, 18 nt, artificial
  Chemically synthesized
aguauuucauugccugug

SEQ ID NO: 9268 - RNA, 18 nt, artificial
  Chemically synthesized
agaauugaccaucugcuu

SEQ ID NO: 9269 - RNA, 18 nt, artificial
  Chemically synthesized
gucaaacgugcgaguguc

SEQ ID NO: 9270 - RNA, 18 nt, artificial
  Chemically synthesized
ggaccacgaagaguuaac

SEQ ID NO: 9271 - RNA, 18 nt, artificial
  Chemically synthesized
acugcuugaugaagcaag

SEQ ID NO: 9272 - RNA, 18 nt, artificial
  Chemically synthesized
guggaauuucgauuuuca

SEQ ID NO: 9273 - RNA, 18 nt, artificial
  Chemically synthesized
gauagcugcauguggcuu

SEQ ID NO: 9274 - RNA, 18 nt, artificial
  Chemically synthesized
acuuggagaagcacugca

SEQ ID NO: 9275 - RNA, 18 nt, artificial
  Chemically synthesized
cuccgacgccggcaaggu

SEQ ID NO: 9276 - RNA, 18 nt, artificial
  Chemically synthesized
ccauuugaaguguaccug

SEQ ID NO: 9277 - RNA, 18 nt, artificial
  Chemically synthesized
ggaagaggcgagccagcg

SEQ ID NO: 9278 - RNA, 18 nt, artificial
  Chemically synthesized
accgacgauucuucuacu

SEQ ID NO: 9279 - RNA, 18 nt, artificial
  Chemically synthesized
cuacucaaaacaaaagag

SEQ ID NO: 9280 - RNA, 18 nt, artificial
  Chemically synthesized
ucaaaacaaaagagccaa

SEQ ID NO: 9281 - RNA, 18 nt, artificial
  Chemically synthesized
cacacuuguaggauaagu

SEQ ID NO: 9282 - RNA, 18 nt, artificial
  Chemically synthesized
caguccauuugaucagcg

SEQ ID NO: 9283 - RNA, 18 nt, artificial
  Chemically synthesized
ucgcugacuucauggaau

SEQ ID NO: 9284 - RNA, 18 nt, artificial
  Chemically synthesized
gagccaggaugucagcgg

SEQ ID NO: 9285 - RNA, 18 nt, artificial
  Chemically synthesized
ugcauacugagccaagua

SEQ ID NO: 9286 - RNA, 18 nt, artificial
  Chemically synthesized
cuaaaagcguuggaugua

SEQ ID NO: 9287 - RNA, 18 nt, artificial
  Chemically synthesized
gaaaacuuccauagcuau

SEQ ID NO: 9288 - RNA, 18 nt, artificial
  Chemically synthesized
ucagauacaucacugcuu

SEQ ID NO: 9289 - RNA, 18 nt, artificial
  Chemically synthesized
uguuaagaauugaccauc

SEQ ID NO: 9290 - RNA, 18 nt, artificial
  Chemically synthesized
gcggcuggguucgcggga

SEQ ID NO: 9291 - RNA, 18 nt, artificial
  Chemically synthesized
ccuuccaccgccauauug

SEQ ID NO: 9292 - RNA, 18 nt, artificial
  Chemically synthesized
gcuuaaaagguugcauac

SEQ ID NO: 9293 - RNA, 18 nt, artificial
  Chemically synthesized
ccaagaagccuggccuca

SEQ ID NO: 9294 - RNA, 18 nt, artificial
  Chemically synthesized
gggcugaggaacugacgu

SEQ ID NO: 9295 - RNA, 18 nt, artificial
  Chemically synthesized
gcagacccgggagaaaga

SEQ ID NO: 9296 - RNA, 18 nt, artificial
  Chemically synthesized
ccuagagggcaaguacga

SEQ ID NO: 9297 - RNA, 18 nt, artificial
  Chemically synthesized
agcugcauguggcuuuuu

SEQ ID NO: 9298 - RNA, 18 nt, artificial
  Chemically synthesized
agguggagaagggcagcu

SEQ ID NO: 9299 - RNA, 18 nt, artificial
  Chemically synthesized
agcaaggaagauauacau

SEQ ID NO: 9300 - RNA, 18 nt, artificial
  Chemically synthesized
gggcuguguaaacacagu

SEQ ID NO: 9301 - RNA, 18 nt, artificial
  Chemically synthesized
gacugauccgucggacag

SEQ ID NO: 9302 - RNA, 18 nt, artificial
  Chemically synthesized
gccagcgcaaguggaauu

SEQ ID NO: 9303 - RNA, 18 nt, artificial
  Chemically synthesized
gaggcgagccagcgcaag

SEQ ID NO: 9304 - RNA, 18 nt, artificial
  Chemically synthesized
gaauggugaucacuccag

SEQ ID NO: 9305 - RNA, 18 nt, artificial
  Chemically synthesized
acaacaacacaauaacac

SEQ ID NO: 9306 - RNA, 18 nt, artificial
  Chemically synthesized
gacuugcaugaagagaag

SEQ ID NO: 9307 - RNA, 18 nt, artificial
  Chemically synthesized
gcaaugcgcaggaauaag

SEQ ID NO: 9308 - RNA, 18 nt, artificial
  Chemically synthesized
gaaauggauacuacaucu

SEQ ID NO: 9309 - RNA, 18 nt, artificial
  Chemically synthesized
aaaacaaaagagccaaca

SEQ ID NO: 9310 - RNA, 18 nt, artificial
  Chemically synthesized
caguauuucauugccugu

SEQ ID NO: 9311 - RNA, 18 nt, artificial
  Chemically synthesized
ggacacgcauuuggugga

SEQ ID NO: 9312 - RNA, 18 nt, artificial
  Chemically synthesized
guguaccuguguacauaa

SEQ ID NO: 9313 - RNA, 18 nt, artificial
  Chemically synthesized
agcauuaugcaauuaggu

SEQ ID NO: 9314 - RNA, 18 nt, artificial
  Chemically synthesized
agcagacgcccaagaagc

SEQ ID NO: 9315 - RNA, 18 nt, artificial
  Chemically synthesized
cugcaaccgacgauucuu

SEQ ID NO: 9316 - RNA, 18 nt, artificial
  Chemically synthesized
aaguuggaauuuaccagu

SEQ ID NO: 9317 - RNA, 18 nt, artificial
  Chemically synthesized
uucucauuugggagaucu

SEQ ID NO: 9318 - RNA, 18 nt, artificial
  Chemically synthesized
aagaaaauguuucagacg

SEQ ID NO: 9319 - RNA, 18 nt, artificial
  Chemically synthesized
gccucuaaaagcguugga

SEQ ID NO: 9320 - RNA, 18 nt, artificial
  Chemically synthesized
uugcaugaagagaagcaa

SEQ ID NO: 9321 - RNA, 18 nt, artificial
  Chemically synthesized
aacaguauuucauugccu

SEQ ID NO: 9322 - RNA, 18 nt, artificial
  Chemically synthesized
cagaacagaagaaaaugu

SEQ ID NO: 9323 - RNA, 18 nt, artificial
  Chemically synthesized
gacccgggagaaagaugu

SEQ ID NO: 9324 - RNA, 18 nt, artificial
  Chemically synthesized
cagucgcugggcuuccga

SEQ ID NO: 9325 - RNA, 18 nt, artificial
  Chemically synthesized
cggagcaaugcgcaggaa

SEQ ID NO: 9326 - RNA, 18 nt, artificial
  Chemically synthesized
cccaaaggugccugcaag

SEQ ID NO: 9327 - RNA, 18 nt, artificial
  Chemically synthesized
ugaaauggauacuacauc

SEQ ID NO: 9328 - RNA, 18 nt, artificial
  Chemically synthesized
gcaggagagccaggaugu

SEQ ID NO: 9329 - RNA, 18 nt, artificial
  Chemically synthesized
gaggugcuugggaguuuu

SEQ ID NO: 9330 - RNA, 18 nt, artificial
  Chemically synthesized
auuugacuugcaugaaga

SEQ ID NO: 9331 - RNA, 18 nt, artificial
  Chemically synthesized
gcauguuuugugcauuug

SEQ ID NO: 9332 - RNA, 18 nt, artificial
  Chemically synthesized
cacuggcuaaagauaauu

SEQ ID NO: 9333 - RNA, 18 nt, artificial
  Chemically synthesized
gcuccggcuaacucugag

SEQ ID NO: 9334 - RNA, 18 nt, artificial
  Chemically synthesized
gaaagaugucaaacgugc

SEQ ID NO: 9335 - RNA, 18 nt, artificial
  Chemically synthesized
aaagcaacagaaaccuau

SEQ ID NO: 9336 - RNA, 18 nt, artificial
  Chemically synthesized
caaaaauccgaggugcuu

SEQ ID NO: 9337 - RNA, 18 nt, artificial
  Chemically synthesized
gcuuuguuuuguucgguu

SEQ ID NO: 9338 - RNA, 18 nt, artificial
  Chemically synthesized
ggagaagggcagcuugcc

SEQ ID NO: 9339 - RNA, 18 nt, artificial
  Chemically synthesized
gugcuugggaguuuugaa

SEQ ID NO: 9340 - RNA, 18 nt, artificial
  Chemically synthesized
guggacccaaagacugau

SEQ ID NO: 9341 - RNA, 18 nt, artificial
  Chemically synthesized
ucuagacaauauacaagc

SEQ ID NO: 9342 - RNA, 18 nt, artificial
  Chemically synthesized
ggucugugucuuuuggcu

SEQ ID NO: 9343 - RNA, 18 nt, artificial
  Chemically synthesized
cccuagccuggagcggau

SEQ ID NO: 9344 - RNA, 18 nt, artificial
  Chemically synthesized
ggaacugacguggagcgg

SEQ ID NO: 9345 - RNA, 18 nt, artificial
  Chemically synthesized
cagacucggacgggcuuu

SEQ ID NO: 9346 - RNA, 18 nt, artificial
  Chemically synthesized
agacagcugauacuucau

SEQ ID NO: 9347 - RNA, 18 nt, artificial
  Chemically synthesized
cuagagggcaaguacgag

SEQ ID NO: 9348 - RNA, 18 nt, artificial
  Chemically synthesized
aggcgagccagcgcaagu

SEQ ID NO: 9349 - RNA, 18 nt, artificial
  Chemically synthesized
cgggcuuugccacccucu

SEQ ID NO: 9350 - RNA, 18 nt, artificial
  Chemically synthesized
acugagccaaguauaauu

SEQ ID NO: 9351 - RNA, 18 nt, artificial
  Chemically synthesized
guuuaucagauacaucac

SEQ ID NO: 9352 - RNA, 18 nt, artificial
  Chemically synthesized
caaaaauuugaacacugg

SEQ ID NO: 9353 - RNA, 18 nt, artificial
  Chemically synthesized
aacacuggcuaaagauaa

SEQ ID NO: 9354 - RNA, 18 nt, artificial
  Chemically synthesized
uggagcggauggacgcca

SEQ ID NO: 9355 - RNA, 18 nt, artificial
  Chemically synthesized
aaccgacgauucuucuac

SEQ ID NO: 9356 - RNA, 18 nt, artificial
  Chemically synthesized
acgugcgagugucuaacg

SEQ ID NO: 9357 - RNA, 18 nt, artificial
  Chemically synthesized
agcacugaaaaacaacaa

SEQ ID NO: 9358 - RNA, 18 nt, artificial
  Chemically synthesized
gucugugucuuuuggcuc

SEQ ID NO: 9359 - RNA, 18 nt, artificial
  Chemically synthesized
ccuguguacauaacucug

SEQ ID NO: 9360 - RNA, 18 nt, artificial
  Chemically synthesized
agguuuggagagcggcug

SEQ ID NO: 9361 - RNA, 18 nt, artificial
  Chemically synthesized
uuucagagacagcugaua

SEQ ID NO: 9362 - RNA, 18 nt, artificial
  Chemically synthesized
guggcauguuuugugcau

SEQ ID NO: 9363 - RNA, 18 nt, artificial
  Chemically synthesized
gugucuuuuggcuccgag

SEQ ID NO: 9364 - RNA, 18 nt, artificial
  Chemically synthesized
ccgaggugcuugggaguu

SEQ ID NO: 9365 - RNA, 18 nt, artificial
  Chemically synthesized
ugcgagugucuaacggga

SEQ ID NO: 9366 - RNA, 18 nt, artificial
  Chemically synthesized
cuuuguuuuguucgguuu

SEQ ID NO: 9367 - RNA, 18 nt, artificial
  Chemically synthesized
uguuggguagaauagguu

SEQ ID NO: 9368 - RNA, 18 nt, artificial
  Chemically synthesized
aagccaaaguggcauguu

SEQ ID NO: 9369 - RNA, 18 nt, artificial
  Chemically synthesized
guucuguggagcagacgc

SEQ ID NO: 9370 - RNA, 18 nt, artificial
  Chemically synthesized
acauaucgcugacuucau

SEQ ID NO: 9371 - RNA, 18 nt, artificial
  Chemically synthesized
agaauggugaucacucca

SEQ ID NO: 9372 - RNA, 18 nt, artificial
  Chemically synthesized
agccuggagcggauggac

SEQ ID NO: 9373 - RNA, 18 nt, artificial
  Chemically synthesized
cgaccugcaaccgacgau

SEQ ID NO: 9374 - RNA, 18 nt, artificial
  Chemically synthesized
gacccaaagacugauccg

SEQ ID NO: 9375 - RNA, 18 nt, artificial
  Chemically synthesized
cggccugcaggaaccucu

SEQ ID NO: 9376 - RNA, 18 nt, artificial
  Chemically synthesized
ugucuaacgggagcccua

SEQ ID NO: 9377 - RNA, 18 nt, artificial
  Chemically synthesized
aucgcugacuucauggaa

SEQ ID NO: 9378 - RNA, 18 nt, artificial
  Chemically synthesized
uggcauguuuugugcauu

SEQ ID NO: 9379 - RNA, 18 nt, artificial
  Chemically synthesized
ggagaucuggugaucucc

SEQ ID NO: 9380 - RNA, 18 nt, artificial
  Chemically synthesized
cauggaauggacauccug

SEQ ID NO: 9381 - RNA, 18 nt, artificial
  Chemically synthesized
gccuggccucagaagacg

SEQ ID NO: 9382 - RNA, 18 nt, artificial
  Chemically synthesized
gaagacgucaaacguaaa

SEQ ID NO: 9383 - RNA, 18 nt, artificial
  Chemically synthesized
ucuaaaucccucgauauu

SEQ ID NO: 9384 - RNA, 18 nt, artificial
  Chemically synthesized
uuugcuucauuguacuac

SEQ ID NO: 9385 - RNA, 18 nt, artificial
  Chemically synthesized
gaauaaggaagcgaccug

SEQ ID NO: 9386 - RNA, 18 nt, artificial
  Chemically synthesized
cuugcacccgcccagacu

SEQ ID NO: 9387 - RNA, 18 nt, artificial
  Chemically synthesized
uaaggaagcgaccugcaa

SEQ ID NO: 9388 - RNA, 18 nt, artificial
  Chemically synthesized
agaggcgagccagcgcaa

SEQ ID NO: 9389 - RNA, 18 nt, artificial
  Chemically synthesized
aagauguaaugucccuuu

SEQ ID NO: 9390 - RNA, 18 nt, artificial
  Chemically synthesized
uguagagaaaagcacacu

SEQ ID NO: 9391 - RNA, 18 nt, artificial
  Chemically synthesized
gggcuuugccacccucuc

SEQ ID NO: 9392 - RNA, 18 nt, artificial
  Chemically synthesized
ugcgcaggaauaaggaag

SEQ ID NO: 9393 - RNA, 18 nt, artificial
  Chemically synthesized
agacgcccaagaagccug

SEQ ID NO: 9394 - RNA, 18 nt, artificial
  Chemically synthesized
aagcuuacucuguccauu

SEQ ID NO: 9395 - RNA, 18 nt, artificial
  Chemically synthesized
agagugcgagagaggcgg

SEQ ID NO: 9396 - RNA, 18 nt, artificial
  Chemically synthesized
gcaaaaauccgaggugcu

SEQ ID NO: 9397 - RNA, 18 nt, artificial
  Chemically synthesized
cccucggccugcaggaac

SEQ ID NO: 9398 - RNA, 18 nt, artificial
  Chemically synthesized
gccggcgcaggagagcca

SEQ ID NO: 9399 - RNA, 18 nt, artificial
  Chemically synthesized
agggcagucgcugggcuu

SEQ ID NO: 9400 - RNA, 18 nt, artificial
  Chemically synthesized
acagaaaccuauccucac

SEQ ID NO: 9401 - RNA, 18 nt, artificial
  Chemically synthesized
cccagacucggacgggcu

SEQ ID NO: 9402 - RNA, 18 nt, artificial
  Chemically synthesized
cacuucgggcuguguaaa

SEQ ID NO: 9403 - RNA, 18 nt, artificial
  Chemically synthesized
uacucagcagaaugguga

SEQ ID NO: 9404 - RNA, 18 nt, artificial
  Chemically synthesized
augucccuuucagagaca

SEQ ID NO: 9405 - RNA, 18 nt, artificial
  Chemically synthesized
ugauccgucggacagcca

SEQ ID NO: 9406 - RNA, 18 nt, artificial
  Chemically synthesized
gguuagcggagcaaugcg

SEQ ID NO: 9407 - RNA, 18 nt, artificial
  Chemically synthesized
ucuguaaguaacuucaca

SEQ ID NO: 9408 - RNA, 18 nt, artificial
  Chemically synthesized
cuccgagggcagucgcug

SEQ ID NO: 9409 - RNA, 18 nt, artificial
  Chemically synthesized
ccaguccauuugaucagc

SEQ ID NO: 9410 - RNA, 18 nt, artificial
  Chemically synthesized
uuuugagagugcgagaga

SEQ ID NO: 9411 - RNA, 18 nt, artificial
  Chemically synthesized
cucauuugggagaucugg

SEQ ID NO: 9412 - RNA, 18 nt, artificial
  Chemically synthesized
cuugggaguuuugaaugu

SEQ ID NO: 9413 - RNA, 18 nt, artificial
  Chemically synthesized
uguggagcagacgcccaa

SEQ ID NO: 9414 - RNA, 18 nt, artificial
  Chemically synthesized
cucccaagcuaucuaaag

SEQ ID NO: 9415 - RNA, 18 nt, artificial
  Chemically synthesized
aacgugcgagugucuaac

SEQ ID NO: 9416 - RNA, 18 nt, artificial
  Chemically synthesized
cccaagcuaucuaaaguu

SEQ ID NO: 9417 - RNA, 18 nt, artificial
  Chemically synthesized
gaugucaaacgugcgagu

SEQ ID NO: 9418 - RNA, 18 nt, artificial
  Chemically synthesized
augaagagcuugcuuuga

SEQ ID NO: 9419 - RNA, 18 nt, artificial
  Chemically synthesized
ucaaggaagguucaugua

SEQ ID NO: 9420 - RNA, 18 nt, artificial
  Chemically synthesized
augcuguguuggguagaa

SEQ ID NO: 9421 - RNA, 18 nt, artificial
  Chemically synthesized
aagcaaggaagauauaca

SEQ ID NO: 9422 - RNA, 18 nt, artificial
  Chemically synthesized
cagagacauggaagaggc

SEQ ID NO: 9423 - RNA, 18 nt, artificial
  Chemically synthesized
gcccagacucggacgggc

SEQ ID NO: 9424 - RNA, 18 nt, artificial
  Chemically synthesized
ccagacucggacgggcuu

SEQ ID NO: 9425 - RNA, 18 nt, artificial
  Chemically synthesized
cccggcggcgccuuuaau

SEQ ID NO: 9426 - RNA, 18 nt, artificial
  Chemically synthesized
ggagcggauggacgccag

SEQ ID NO: 9427 - RNA, 18 nt, artificial
  Chemically synthesized
agagguggagaagggcag

SEQ ID NO: 9428 - RNA, 18 nt, artificial
  Chemically synthesized
gcgaccugcaaccgacga

SEQ ID NO: 9429 - RNA, 18 nt, artificial
  Chemically synthesized
ugcuugggaguuuugaau

SEQ ID NO: 9430 - RNA, 18 nt, artificial
  Chemically synthesized
cacuaaaauuuuaggcac

SEQ ID NO: 9431 - RNA, 18 nt, artificial
  Chemically synthesized
aagagguggagaagggca

SEQ ID NO: 9432 - RNA, 18 nt, artificial
  Chemically synthesized
auuugguggacccaaaga

SEQ ID NO: 9433 - RNA, 18 nt, artificial
  Chemically synthesized
acuucauggaauggacau

SEQ ID NO: 9434 - RNA, 18 nt, artificial
  Chemically synthesized
uacucaaaacaaaagagc

SEQ ID NO: 9435 - RNA, 18 nt, artificial
  Chemically synthesized
acaauauacaagccaaag

SEQ ID NO: 9436 - RNA, 18 nt, artificial
  Chemically synthesized
ucagagacagcugauacu

SEQ ID NO: 9437 - RNA, 18 nt, artificial
  Chemically synthesized
gagagugcgagagaggcg

SEQ ID NO: 9438 - RNA, 18 nt, artificial
  Chemically synthesized
ugaucugccucuaaaagc

SEQ ID NO: 9439 - RNA, 18 nt, artificial
  Chemically synthesized
ccggcgcaggagagccag

SEQ ID NO: 9440 - RNA, 18 nt, artificial
  Chemically synthesized
cagccucccuuccaccgc

SEQ ID NO: 9441 - RNA, 18 nt, artificial
  Chemically synthesized
gagggcagucgcugggcu

SEQ ID NO: 9442 - RNA, 18 nt, artificial
  Chemically synthesized
agccuggccucagaagac

SEQ ID NO: 9443 - RNA, 18 nt, artificial
  Chemically synthesized
gcgcgcuccuagagcucg

SEQ ID NO: 9444 - RNA, 18 nt, artificial
  Chemically synthesized
aacguaaacagcucgaau

SEQ ID NO: 9445 - RNA, 18 nt, artificial
  Chemically synthesized
gcuugcuuugauuuacag

SEQ ID NO: 9446 - RNA, 18 nt, artificial
  Chemically synthesized
agaaaagcacacuuguag

SEQ ID NO: 9447 - RNA, 18 nt, artificial
  Chemically synthesized
cagcuugcccgaguucua

SEQ ID NO: 9448 - RNA, 18 nt, artificial
  Chemically synthesized
uaccuuuuauguagcaca

SEQ ID NO: 9449 - RNA, 18 nt, artificial
  Chemically synthesized
ccagucucucuuaaaguu

SEQ ID NO: 9450 - RNA, 18 nt, artificial
  Chemically synthesized
gagggcaaguacgagugg

SEQ ID NO: 9451 - RNA, 18 nt, artificial
  Chemically synthesized
auuacucagcagaauggu

SEQ ID NO: 9452 - RNA, 18 nt, artificial
  Chemically synthesized
acuaccuguguauauagu

SEQ ID NO: 9453 - RNA, 18 nt, artificial
  Chemically synthesized
gcuugcacccgcccagac

SEQ ID NO: 9454 - RNA, 18 nt, artificial
  Chemically synthesized
ugucccuuucagagacag

SEQ ID NO: 9455 - RNA, 18 nt, artificial
  Chemically synthesized
cggcggcgccuuuaauug

SEQ ID NO: 9456 - RNA, 18 nt, artificial
  Chemically synthesized
aauacauaucgcugacuu

SEQ ID NO: 9457 - RNA, 18 nt, artificial
  Chemically synthesized
cgggagcccuagccugga

SEQ ID NO: 9458 - RNA, 18 nt, artificial
  Chemically synthesized
acagaacagaagaaaaug

SEQ ID NO: 9459 - RNA, 18 nt, artificial
  Chemically synthesized
aguacgaguggcaagagg

SEQ ID NO: 9460 - RNA, 18 nt, artificial
  Chemically synthesized
uccuuauuugcuucauug

SEQ ID NO: 9461 - RNA, 18 nt, artificial
  Chemically synthesized
cgacuccgacgccggcaa

SEQ ID NO: 9462 - RNA, 18 nt, artificial
  Chemically synthesized
ggagagcggcuggguucg

SEQ ID NO: 9463 - RNA, 18 nt, artificial
  Chemically synthesized
ccaaagacugauccgucg

SEQ ID NO: 9464 - RNA, 18 nt, artificial
  Chemically synthesized
ggaugucagcgggagccg

SEQ ID NO: 9465 - RNA, 18 nt, artificial
  Chemically synthesized
uucuaaaucccucgauau

SEQ ID NO: 9466 - RNA, 18 nt, artificial
  Chemically synthesized
ccugcgcgcuccuagagc

SEQ ID NO: 9467 - RNA, 18 nt, artificial
  Chemically synthesized
ugccuguguauggaaaaa

SEQ ID NO: 9468 - RNA, 18 nt, artificial
  Chemically synthesized
uucagagacagcugauac

SEQ ID NO: 9469 - RNA, 18 nt, artificial
  Chemically synthesized
gugccugcaaggugccgg

SEQ ID NO: 9470 - RNA, 18 nt, artificial
  Chemically synthesized
auagcugcauguggcuuu

SEQ ID NO: 9471 - RNA, 18 nt, artificial
  Chemically synthesized
cuuccaccgccauauugg

SEQ ID NO: 9472 - RNA, 18 nt, artificial
  Chemically synthesized
aaguacgaguggcaagag

SEQ ID NO: 9473 - RNA, 18 nt, artificial
  Chemically synthesized
gcacacuuguaggauaag

SEQ ID NO: 9474 - RNA, 18 nt, artificial
  Chemically synthesized
gguuuggagagcggcugg

SEQ ID NO: 9475 - RNA, 18 nt, artificial
  Chemically synthesized
gcuaugcuuaaaagguug

SEQ ID NO: 9476 - RNA, 18 nt, artificial
  Chemically synthesized
aaagcuuacucuguccau

SEQ ID NO: 9477 - RNA, 18 nt, artificial
  Chemically synthesized
gacauccuguauaagcac

SEQ ID NO: 9478 - RNA, 18 nt, artificial
  Chemically synthesized
augucaaacgugcgagug

SEQ ID NO: 9479 - RNA, 18 nt, artificial
  Chemically synthesized
agcaaugcgcaggaauaa

SEQ ID NO: 9480 - RNA, 18 nt, artificial
  Chemically synthesized
agacauggaagaggcgag

SEQ ID NO: 9481 - RNA, 18 nt, artificial
  Chemically synthesized
uggaauggacauccugua

SEQ ID NO: 9482 - RNA, 18 nt, artificial
  Chemically synthesized
aaaggugccugcaaggug

SEQ ID NO: 9483 - RNA, 18 nt, artificial
  Chemically synthesized
cauuuucuuuucacuucg

SEQ ID NO: 9484 - RNA, 18 nt, artificial
  Chemically synthesized
cgggcuugcacccgccca

SEQ ID NO: 9485 - RNA, 18 nt, artificial
  Chemically synthesized
gucuaacgggagcccuag

SEQ ID NO: 9486 - RNA, 18 nt, artificial
  Chemically synthesized
uuugaucagcggagacuc

SEQ ID NO: 9487 - RNA, 18 nt, artificial
  Chemically synthesized
uggaaaaaccauuugaag

SEQ ID NO: 9488 - RNA, 18 nt, artificial
  Chemically synthesized
guuuguuagauagcugca

SEQ ID NO: 9489 - RNA, 18 nt, artificial
  Chemically synthesized
cgcuuuguuuuguucggu

SEQ ID NO: 9490 - RNA, 18 nt, artificial
  Chemically synthesized
gaucuggugaucucccaa

SEQ ID NO: 9491 - RNA, 18 nt, artificial
  Chemically synthesized
aacagcucgaauuaagaa

SEQ ID NO: 9492 - RNA, 18 nt, artificial
  Chemically synthesized
gcgcuuuguuuuguucgg

SEQ ID NO: 9493 - RNA, 18 nt, artificial
  Chemically synthesized
cccucuccucuccgcccu

SEQ ID NO: 9494 - RNA, 18 nt, artificial
  Chemically synthesized
acaucacugcuugaugaa

SEQ ID NO: 9495 - RNA, 18 nt, artificial
  Chemically synthesized
gagaggcggucgugcaga

SEQ ID NO: 9496 - RNA, 18 nt, artificial
  Chemically synthesized
aggcacucuuaaaugauc

SEQ ID NO: 9497 - RNA, 18 nt, artificial
  Chemically synthesized
auuugaacacuggcuaaa

SEQ ID NO: 9498 - RNA, 18 nt, artificial
  Chemically synthesized
cucugaggacacgcauuu

SEQ ID NO: 9499 - RNA, 18 nt, artificial
  Chemically synthesized
aaaagguugcauacugag

SEQ ID NO: 9500 - RNA, 18 nt, artificial
  Chemically synthesized
acgccggcaagguuugga

SEQ ID NO: 9501 - RNA, 18 nt, artificial
  Chemically synthesized
ugaagcaaggaagauaua

SEQ ID NO: 9502 - RNA, 18 nt, artificial
  Chemically synthesized
aagguuuggagagcggcu

SEQ ID NO: 9503 - RNA, 18 nt, artificial
  Chemically synthesized
cgcccagacucggacggg

SEQ ID NO: 9504 - RNA, 18 nt, artificial
  Chemically synthesized
agggcagcuugcccgagu

SEQ ID NO: 9505 - RNA, 18 nt, artificial
  Chemically synthesized
uggagaagggcagcuugc

SEQ ID NO: 9506 - RNA, 18 nt, artificial
  Chemically synthesized
gaaaaaccauuugaagug

SEQ ID NO: 9507 - RNA, 18 nt, artificial
  Chemically synthesized
uaggcacucuuaaaugau

SEQ ID NO: 9508 - RNA, 18 nt, artificial
  Chemically synthesized
gcagacgcccaagaagcc

SEQ ID NO: 9509 - RNA, 18 nt, artificial
  Chemically synthesized
cagcagaauggugaucac

SEQ ID NO: 9510 - RNA, 18 nt, artificial
  Chemically synthesized
gcaagagguggagaaggg

SEQ ID NO: 9511 - RNA, 18 nt, artificial
  Chemically synthesized
cucccgcucgccagucca

SEQ ID NO: 9512 - RNA, 18 nt, artificial
  Chemically synthesized
gcgcaggaauaaggaagc

SEQ ID NO: 9513 - RNA, 18 nt, artificial
  Chemically synthesized
gaaaauguuucagacggu

SEQ ID NO: 9514 - RNA, 18 nt, artificial
  Chemically synthesized
aaagaaaacuuccauagc

SEQ ID NO: 9515 - RNA, 18 nt, artificial
  Chemically synthesized
cggauggacgccaggcag

SEQ ID NO: 9516 - RNA, 18 nt, artificial
  Chemically synthesized
aagaauugaccaucugcu

SEQ ID NO: 9517 - RNA, 18 nt, artificial
  Chemically synthesized
ugaagagaagcaauuuug

SEQ ID NO: 9518 - RNA, 18 nt, artificial
  Chemically synthesized
caaaggugccugcaaggu

SEQ ID NO: 9519 - RNA, 18 nt, artificial
  Chemically synthesized
gaguuaacccgggacuug

SEQ ID NO: 9520 - RNA, 18 nt, artificial
  Chemically synthesized
aucagauacaucacugcu

SEQ ID NO: 9521 - RNA, 18 nt, artificial
  Chemically synthesized
gcaggaaccucuucggcc

SEQ ID NO: 9522 - RNA, 18 nt, artificial
  Chemically synthesized
augcgcaggaauaaggaa

SEQ ID NO: 9523 - RNA, 18 nt, artificial
  Chemically synthesized
aggugccggcgcaggaga

SEQ ID NO: 9524 - RNA, 18 nt, artificial
  Chemically synthesized
ggucgugcagacccggga

SEQ ID NO: 9525 - RNA, 18 nt, artificial
  Chemically synthesized
gggcgcuuuguuuuguuc

SEQ ID NO: 9526 - RNA, 18 nt, artificial
  Chemically synthesized
cugaggaacugacgugga

SEQ ID NO: 9527 - RNA, 18 nt, artificial
  Chemically synthesized
acaguauuucauugccug

SEQ ID NO: 9528 - RNA, 18 nt, artificial
  Chemically synthesized
cagaaaccuauccucacu

SEQ ID NO: 9529 - RNA, 18 nt, artificial
  Chemically synthesized
ggcugaggaacugacgug

SEQ ID NO: 9530 - RNA, 18 nt, artificial
  Chemically synthesized
ccacgaagaguuaacccg

SEQ ID NO: 9531 - RNA, 18 nt, artificial
  Chemically synthesized
cccucccgcucgccaguc

SEQ ID NO: 9532 - RNA, 18 nt, artificial
  Chemically synthesized
cacaggaaaguguuauuu

SEQ ID NO: 9533 - RNA, 18 nt, artificial
  Chemically synthesized
cgggcuguguaaacacag

SEQ ID NO: 9534 - RNA, 18 nt, artificial
  Chemically synthesized
ugugcauuuguaaaugcu

SEQ ID NO: 9535 - RNA, 18 nt, artificial
  Chemically synthesized
cccgguggaccacgaaga

SEQ ID NO: 9536 - RNA, 18 nt, artificial
  Chemically synthesized
gggagcccuagccuggag

SEQ ID NO: 9537 - RNA, 18 nt, artificial
  Chemically synthesized
cgcccaagaagccuggcc

SEQ ID NO: 9538 - RNA, 18 nt, artificial
  Chemically synthesized
aaagauguaaugucccuu

SEQ ID NO: 9539 - RNA, 18 nt, artificial
  Chemically synthesized
ugcagagacauggaagag

SEQ ID NO: 9540 - RNA, 18 nt, artificial
  Chemically synthesized
cuggcuaaagauaauugc

SEQ ID NO: 9541 - RNA, 18 nt, artificial
  Chemically synthesized
gccaggaugucagcggga

SEQ ID NO: 9542 - RNA, 18 nt, artificial
  Chemically synthesized
agauacaucacugcuuga

SEQ ID NO: 9543 - RNA, 18 nt, artificial
  Chemically synthesized
aggguuugaauuguuuuc

SEQ ID NO: 9544 - RNA, 18 nt, artificial
  Chemically synthesized
uuguacuaccuguguaua

SEQ ID NO: 9545 - RNA, 18 nt, artificial
  Chemically synthesized
cuguccauuuauccacag

SEQ ID NO: 9546 - RNA, 18 nt, artificial
  Chemically synthesized
auuucauugccuguguau

SEQ ID NO: 9547 - RNA, 18 nt, artificial
  Chemically synthesized
cggcuggguucgcgggac

SEQ ID NO: 9548 - RNA, 18 nt, artificial
  Chemically synthesized
cgcugggcuuccgagagg

SEQ ID NO: 9549 - RNA, 18 nt, artificial
  Chemically synthesized
ccaggaugucagcgggag

SEQ ID NO: 9550 - RNA, 18 nt, artificial
  Chemically synthesized
cacgaagaguuaacccgg

SEQ ID NO: 9551 - RNA, 18 nt, artificial
  Chemically synthesized
uauucucauuugggagau

SEQ ID NO: 9552 - RNA, 18 nt, artificial
  Chemically synthesized
ggccugcaggaaccucuu

SEQ ID NO: 9553 - RNA, 18 nt, artificial
  Chemically synthesized
ccugcaggaaccucuucg

SEQ ID NO: 9554 - RNA, 18 nt, artificial
  Chemically synthesized
uaggauaagugaaaugga

SEQ ID NO: 9555 - RNA, 18 nt, artificial
  Chemically synthesized
cacucuuaaaugaucugc

SEQ ID NO: 9556 - RNA, 18 nt, artificial
  Chemically synthesized
cccaaaugccgguucugu

SEQ ID NO: 9557 - RNA, 18 nt, artificial
  Chemically synthesized
uagagaaaagcacacuug

SEQ ID NO: 9558 - RNA, 18 nt, artificial
  Chemically synthesized
gguucgggcugcguaggg

SEQ ID NO: 9559 - RNA, 18 nt, artificial
  Chemically synthesized
uggagagcggcuggguuc

SEQ ID NO: 9560 - RNA, 18 nt, artificial
  Chemically synthesized
agaagccuggccucagaa

SEQ ID NO: 9561 - RNA, 18 nt, artificial
  Chemically synthesized
ugagagugcgagagaggc

SEQ ID NO: 9562 - RNA, 18 nt, artificial
  Chemically synthesized
cgucagccucccuuccac

SEQ ID NO: 9563 - RNA, 18 nt, artificial
  Chemically synthesized
aggaauaaggaagcgacc

SEQ ID NO: 9564 - RNA, 18 nt, artificial
  Chemically synthesized
uacauaucgcugacuuca

SEQ ID NO: 9565 - RNA, 18 nt, artificial
  Chemically synthesized
aaacgugcgagugucuaa

SEQ ID NO: 9566 - RNA, 18 nt, artificial
  Chemically synthesized
auccgucggacagccaga

SEQ ID NO: 9567 - RNA, 18 nt, artificial
  Chemically synthesized
acucuguccauuuaucca

SEQ ID NO: 9568 - RNA, 18 nt, artificial
  Chemically synthesized
aaaagcaacagaaaccua

SEQ ID NO: 9569 - RNA, 18 nt, artificial
  Chemically synthesized
gggccacuaaaaaaaggg

SEQ ID NO: 9570 - RNA, 18 nt, artificial
  Chemically synthesized
caaaguggcauguuuugu

SEQ ID NO: 9571 - RNA, 18 nt, artificial
  Chemically synthesized
agaaaccuauccucacug

SEQ ID NO: 9572 - RNA, 18 nt, artificial
  Chemically synthesized
gagaagggcagcuugccc

SEQ ID NO: 9573 - RNA, 18 nt, artificial
  Chemically synthesized
gaacugacguggagcggg

SEQ ID NO: 9574 - RNA, 18 nt, artificial
  Chemically synthesized
ggagcccuagccuggagc

SEQ ID NO: 9575 - RNA, 18 nt, artificial
  Chemically synthesized
ccuggccucagaagacgu

SEQ ID NO: 9576 - RNA, 18 nt, artificial
  Chemically synthesized
agguuuuuccuuauuugc

SEQ ID NO: 9577 - RNA, 18 nt, artificial
  Chemically synthesized
uaauuacucagcagaaug

SEQ ID NO: 9578 - RNA, 18 nt, artificial
  Chemically synthesized
ugcauuuguaaaugcugu

SEQ ID NO: 9579 - RNA, 18 nt, artificial
  Chemically synthesized
gcuccgagggcagucgcu

SEQ ID NO: 9580 - RNA, 18 nt, artificial
  Chemically synthesized
ggcuggguucgcgggacc

SEQ ID NO: 9581 - RNA, 18 nt, artificial
  Chemically synthesized
ucccuuccaccgccauau

SEQ ID NO: 9582 - RNA, 18 nt, artificial
  Chemically synthesized
ggacccgcgggcuugcac

SEQ ID NO: 9583 - RNA, 18 nt, artificial
  Chemically synthesized
uggguagaauagguuuuc

SEQ ID NO: 9584 - RNA, 18 nt, artificial
  Chemically synthesized
agaguuaacccgggacuu

SEQ ID NO: 9585 - RNA, 18 nt, artificial
  Chemically synthesized
agcuugcccgaguucuac

SEQ ID NO: 9586 - RNA, 18 nt, artificial
  Chemically synthesized
aacagaaaccuauccuca

SEQ ID NO: 9587 - RNA, 18 nt, artificial
  Chemically synthesized
cuucauggaauggacauc

SEQ ID NO: 9588 - RNA, 18 nt, artificial
  Chemically synthesized
ggcagcuugcccgaguuc

SEQ ID NO: 9589 - RNA, 18 nt, artificial
  Chemically synthesized
gagagcggcuggguucgc

SEQ ID NO: 9590 - RNA, 18 nt, artificial
  Chemically synthesized
ucauuugggagaucuggu

SEQ ID NO: 9591 - RNA, 18 nt, artificial
  Chemically synthesized
agcggagacucggcggcc

SEQ ID NO: 9592 - RNA, 18 nt, artificial
  Chemically synthesized
cgcugacuucauggaaug

SEQ ID NO: 9593 - RNA, 18 nt, artificial
  Chemically synthesized
auuugggagaucugguga

SEQ ID NO: 9594 - RNA, 18 nt, artificial
  Chemically synthesized
acccgggacuuggagaag

SEQ ID NO: 9595 - RNA, 18 nt, artificial
  Chemically synthesized
cccgcuugcucacggcuc

SEQ ID NO: 9596 - RNA, 18 nt, artificial
  Chemically synthesized
gaagggagggcagggugg

SEQ ID NO: 9597 - RNA, 18 nt, artificial
  Chemically synthesized
uccgacgccggcaagguu

SEQ ID NO: 9598 - RNA, 18 nt, artificial
  Chemically synthesized
gaucagcggagacucggc

SEQ ID NO: 9599 - RNA, 18 nt, artificial
  Chemically synthesized
aguggcauguuuugugca

SEQ ID NO: 9600 - RNA, 18 nt, artificial
  Chemically synthesized
cuucgggcuguguaaaca

SEQ ID NO: 9601 - RNA, 18 nt, artificial
  Chemically synthesized
guuagauagcugcaugug

SEQ ID NO: 9602 - RNA, 18 nt, artificial
  Chemically synthesized
uagagggcaaguacgagu

SEQ ID NO: 9603 - RNA, 18 nt, artificial
  Chemically synthesized
cacuccagguaguuuggg

SEQ ID NO: 9604 - RNA, 18 nt, artificial
  Chemically synthesized
gcucacggcucugcgacu

SEQ ID NO: 9605 - RNA, 18 nt, artificial
  Chemically synthesized
ggugccugcaaggugccg

SEQ ID NO: 9606 - RNA, 18 nt, artificial
  Chemically synthesized
uggaccacgaagaguuaa

SEQ ID NO: 9607 - RNA, 18 nt, artificial
  Chemically synthesized
aauauacaagccaaagug

SEQ ID NO: 9608 - RNA, 18 nt, artificial
  Chemically synthesized
cauuuguaaaugcugugu

SEQ ID NO: 9609 - RNA, 18 nt, artificial
  Chemically synthesized
aauccgaggugcuuggga

SEQ ID NO: 9610 - RNA, 18 nt, artificial
  Chemically synthesized
uucauguagagaaaagca

SEQ ID NO: 9611 - RNA, 18 nt, artificial
  Chemically synthesized
cggcucugcgacuccgac

SEQ ID NO: 9612 - RNA, 18 nt, artificial
  Chemically synthesized
gccucccuuccaccgcca

SEQ ID NO: 9613 - RNA, 18 nt, artificial
  Chemically synthesized
guuuuguucgguuuuguu

SEQ ID NO: 9614 - RNA, 18 nt, artificial
  Chemically synthesized
uuguuuuuuugagagugc

SEQ ID NO: 9615 - RNA, 18 nt, artificial
  Chemically synthesized
ggguucgggcugcguagg

SEQ ID NO: 9616 - RNA, 18 nt, artificial
  Chemically synthesized
ccuagccuggagcggaug

SEQ ID NO: 9617 - RNA, 18 nt, artificial
  Chemically synthesized
gacgucaaacguaaacag

SEQ ID NO: 9618 - RNA, 18 nt, artificial
  Chemically synthesized
cgaguggcaagaggugga

SEQ ID NO: 9619 - RNA, 18 nt, artificial
  Chemically synthesized
aaggaagcgaccugcaac

SEQ ID NO: 9620 - RNA, 18 nt, artificial
  Chemically synthesized
uagcaauuaucuuuagcc

SEQ ID NO: 9621 - RNA, 18 nt, artificial
  Chemically synthesized
guuugacaucuuucuccc

SEQ ID NO: 9622 - RNA, 18 nt, artificial
  Chemically synthesized
cguuugacaucuuucucc

SEQ ID NO: 9623 - RNA, 18 nt, artificial
  Chemically synthesized
uuuugaguagaagaaucg

SEQ ID NO: 9624 - RNA, 18 nt, artificial
  Chemically synthesized
agaaaacaauucaaaccc

SEQ ID NO: 9625 - RNA, 18 nt, artificial
  Chemically synthesized
aagcugcccuucuccacc

SEQ ID NO: 9626 - RNA, 18 nt, artificial
  Chemically synthesized
uugcauaaugcuacaucc

SEQ ID NO: 9627 - RNA, 18 nt, artificial
  Chemically synthesized
uuuucucuacaugaaccu

SEQ ID NO: 9628 - RNA, 18 nt, artificial
  Chemically synthesized
agugcuucuccaaguccc

SEQ ID NO: 9629 - RNA, 18 nt, artificial
  Chemically synthesized
acaauucaaacccuuccc

SEQ ID NO: 9630 - RNA, 18 nt, artificial
  Chemically synthesized
uugccacucguacuugcc

SEQ ID NO: 9631 - RNA, 18 nt, artificial
  Chemically synthesized
uucuugggcgucugcucc

SEQ ID NO: 9632 - RNA, 18 nt, artificial
  Chemically synthesized
ucgccucuuccaugucuc

SEQ ID NO: 9633 - RNA, 18 nt, artificial
  Chemically synthesized
ucuguaguagaacucggg

SEQ ID NO: 9634 - RNA, 18 nt, artificial
  Chemically synthesized
ucgcuuccuuauuccugc

SEQ ID NO: 9635 - RNA, 18 nt, artificial
  Chemically synthesized
aaccuuuuaagcauagcc

SEQ ID NO: 9636 - RNA, 18 nt, artificial
  Chemically synthesized
aaacaauucaaacccuuc

SEQ ID NO: 9637 - RNA, 18 nt, artificial
  Chemically synthesized
cuuuucucuacaugaacc

SEQ ID NO: 9638 - RNA, 18 nt, artificial
  Chemically synthesized
aauugcuucucuucaugc

SEQ ID NO: 9639 - RNA, 18 nt, artificial
  Chemically synthesized
uuggcucaguaugcaacc

SEQ ID NO: 9640 - RNA, 18 nt, artificial
  Chemically synthesized
uauucuacccaacacagc

SEQ ID NO: 9641 - RNA, 18 nt, artificial
  Chemically synthesized
uuccuugcuucaucaagc

SEQ ID NO: 9642 - RNA, 18 nt, artificial
  Chemically synthesized
uauccauuucacuuaucc

SEQ ID NO: 9643 - RNA, 18 nt, artificial
  Chemically synthesized
gucuguaguagaacucgg

SEQ ID NO: 9644 - RNA, 18 nt, artificial
  Chemically synthesized
aaagcaagcucuucauac

SEQ ID NO: 9645 - RNA, 18 nt, artificial
  Chemically synthesized
cagguaguacaaugaagc

SEQ ID NO: 9646 - RNA, 18 nt, artificial
  Chemically synthesized
ucucugcagugcuucucc

SEQ ID NO: 9647 - RNA, 18 nt, artificial
  Chemically synthesized
guuuuuccauacacaggc

SEQ ID NO: 9648 - RNA, 18 nt, artificial
  Chemically synthesized
ugaaguaucagcugucuc

SEQ ID NO: 9649 - RNA, 18 nt, artificial
  Chemically synthesized
uaaaucaaagcaagcucu

SEQ ID NO: 9650 - RNA, 18 nt, artificial
  Chemically synthesized
ucuccaaaccuugccggc

SEQ ID NO: 9651 - RNA, 18 nt, artificial
  Chemically synthesized
uuuugacuguguuuacac

SEQ ID NO: 9652 - RNA, 18 nt, artificial
  Chemically synthesized
ucuccgcugaucaaaugg

SEQ ID NO: 9653 - RNA, 18 nt, artificial
  Chemically synthesized
aaguaucagcugucucug

SEQ ID NO: 9654 - RNA, 18 nt, artificial
  Chemically synthesized
uauauacacagguaguac

SEQ ID NO: 9655 - RNA, 18 nt, artificial
  Chemically synthesized
auaaugcuacauccaacg

SEQ ID NO: 9656 - RNA, 18 nt, artificial
  Chemically synthesized
aagcaagcucuucauacc

SEQ ID NO: 9657 - RNA, 18 nt, artificial
  Chemically synthesized
gggucuguaguagaacuc

SEQ ID NO: 9658 - RNA, 18 nt, artificial
  Chemically synthesized
cuaccuggagugaucacc

SEQ ID NO: 9659 - RNA, 18 nt, artificial
  Chemically synthesized
gagugaucaccauucugc

SEQ ID NO: 9660 - RNA, 18 nt, artificial
  Chemically synthesized
aaacaugccacuuuggcu

SEQ ID NO: 9661 - RNA, 18 nt, artificial
  Chemically synthesized
agcaaauaaggaaaaacc

SEQ ID NO: 9662 - RNA, 18 nt, artificial
  Chemically synthesized
auugcauaaugcuacauc

SEQ ID NO: 9663 - RNA, 18 nt, artificial
  Chemically synthesized
augucucugcagugcuuc

SEQ ID NO: 9664 - RNA, 18 nt, artificial
  Chemically synthesized
aacaauucaaacccuucc

SEQ ID NO: 9665 - RNA, 18 nt, artificial
  Chemically synthesized
uuugacgucuucugaggc

SEQ ID NO: 9666 - RNA, 18 nt, artificial
  Chemically synthesized
ucagcugucucugaaagg

SEQ ID NO: 9667 - RNA, 18 nt, artificial
  Chemically synthesized
aaaccuauucuacccaac

SEQ ID NO: 9668 - RNA, 18 nt, artificial
  Chemically synthesized
acguuugacaucuuucuc

SEQ ID NO: 9669 - RNA, 18 nt, artificial
  Chemically synthesized
uauucuuaauucgagcug

SEQ ID NO: 9670 - RNA, 18 nt, artificial
  Chemically synthesized
uuucucccgggucugcac

SEQ ID NO: 9671 - RNA, 18 nt, artificial
  Chemically synthesized
uguaucugauaaacaagg

SEQ ID NO: 9672 - RNA, 18 nt, artificial
  Chemically synthesized
uaucuuccuugcuucauc

SEQ ID NO: 9673 - RNA, 18 nt, artificial
  Chemically synthesized
uacacagguaguacaaug

SEQ ID NO: 9674 - RNA, 18 nt, artificial
  Chemically synthesized
aaucgaaauuccacuugc

SEQ ID NO: 9675 - RNA, 18 nt, artificial
  Chemically synthesized
uguguaacaauaauuggc

SEQ ID NO: 9676 - RNA, 18 nt, artificial
  Chemically synthesized
aaacucccaagcaccucg

SEQ ID NO: 9677 - RNA, 18 nt, artificial
  Chemically synthesized
ugaaagggacauuacauc

SEQ ID NO: 9678 - RNA, 18 nt, artificial
  Chemically synthesized
cgcucuccaaaccuugcc

SEQ ID NO: 9679 - RNA, 18 nt, artificial
  Chemically synthesized
aggucgcuuccuuauucc

SEQ ID NO: 9680 - RNA, 18 nt, artificial
  Chemically synthesized
ugaucaaauggacuggcg

SEQ ID NO: 9681 - RNA, 18 nt, artificial
  Chemically synthesized
aaauugcuucucuucaug

SEQ ID NO: 9682 - RNA, 18 nt, artificial
  Chemically synthesized
cuucuugggcgucugcuc

SEQ ID NO: 9683 - RNA, 18 nt, artificial
  Chemically synthesized
caccucggauuuuugccc

SEQ ID NO: 9684 - RNA, 18 nt, artificial
  Chemically synthesized
uucucuucaugcaaguca

SEQ ID NO: 9685 - RNA, 18 nt, artificial
  Chemically synthesized
uacaagugugcuuuucuc

SEQ ID NO: 9686 - RNA, 18 nt, artificial
  Chemically synthesized
ucgguugcaggucgcuuc

SEQ ID NO: 9687 - RNA, 18 nt, artificial
  Chemically synthesized
uccauuccaugaagucag

SEQ ID NO: 9688 - RNA, 18 nt, artificial
  Chemically synthesized
acuuuaagagagacuggg

SEQ ID NO: 9689 - RNA, 18 nt, artificial
  Chemically synthesized
uuuucuucuguucuguug

SEQ ID NO: 9690 - RNA, 18 nt, artificial
  Chemically synthesized
cauauucuuaauucgagc

SEQ ID NO: 9691 - RNA, 18 nt, artificial
  Chemically synthesized
cuaauugcauaaugcuac

SEQ ID NO: 9692 - RNA, 18 nt, artificial
  Chemically synthesized
acuucaaaugguuuuucc

SEQ ID NO: 9693 - RNA, 18 nt, artificial
  Chemically synthesized
uccgcuccaggcuagggc

SEQ ID NO: 9694 - RNA, 18 nt, artificial
  Chemically synthesized
ccuucuccaccucuugcc

SEQ ID NO: 9695 - RNA, 18 nt, artificial
  Chemically synthesized
aaccuaauugcauaaugc

SEQ ID NO: 9696 - RNA, 18 nt, artificial
  Chemically synthesized
uuuccuguggauaaaugg

SEQ ID NO: 9697 - RNA, 18 nt, artificial
  Chemically synthesized
ugcugaguaauuaacugg

SEQ ID NO: 9698 - RNA, 18 nt, artificial
  Chemically synthesized
ucaaauggacuggcgagc

SEQ ID NO: 9699 - RNA, 18 nt, artificial
  Chemically synthesized
cucuccaaaccuugccgg

SEQ ID NO: 9700 - RNA, 18 nt, artificial
  Chemically synthesized
aaaccuugccggcgucgg

SEQ ID NO: 9701 - RNA, 18 nt, artificial
  Chemically synthesized
aaugaaguaucagcuguc

SEQ ID NO: 9702 - RNA, 18 nt, artificial
  Chemically synthesized
ccucuuccaugucucugc

SEQ ID NO: 9703 - RNA, 18 nt, artificial
  Chemically synthesized
uagcuauggaaguuuucu

SEQ ID NO: 9704 - RNA, 18 nt, artificial
  Chemically synthesized
ucagucuuuggguccacc

SEQ ID NO: 9705 - RNA, 18 nt, artificial
  Chemically synthesized
uuuggcuuguauauuguc

SEQ ID NO: 9706 - RNA, 18 nt, artificial
  Chemically synthesized
ggucuguaguagaacucg

SEQ ID NO: 9707 - RNA, 18 nt, artificial
  Chemically synthesized
auuccaacuuuaagagag

SEQ ID NO: 9708 - RNA, 18 nt, artificial
  Chemically synthesized
auccaacgcuuuuagagg

SEQ ID NO: 9709 - RNA, 18 nt, artificial
  Chemically synthesized
gucugaaacauuuucuuc

SEQ ID NO: 9710 - RNA, 18 nt, artificial
  Chemically synthesized
auaaauggacagaguaag

SEQ ID NO: 9711 - RNA, 18 nt, artificial
  Chemically synthesized
uccuggcucuccugcgcc

SEQ ID NO: 9712 - RNA, 18 nt, artificial
  Chemically synthesized
aagugugcuuuucucuac

SEQ ID NO: 9713 - RNA, 18 nt, artificial
  Chemically synthesized
aguaugcaaccuuuuaag

SEQ ID NO: 9714 - RNA, 18 nt, artificial
  Chemically synthesized
cgucugcuccacagaacc

SEQ ID NO: 9715 - RNA, 18 nt, artificial
  Chemically synthesized
agaucauuuaagagugcc

SEQ ID NO: 9716 - RNA, 18 nt, artificial
  Chemically synthesized
ccgucugaaacauuuucu

SEQ ID NO: 9717 - RNA, 18 nt, artificial
  Chemically synthesized
acuuuggcuuguauauug

SEQ ID NO: 9718 - RNA, 18 nt, artificial
  Chemically synthesized
cucccguuagacacucgc

SEQ ID NO: 9719 - RNA, 18 nt, artificial
  Chemically synthesized
ucagaguuagccggagcc

SEQ ID NO: 9720 - RNA, 18 nt, artificial
  Chemically synthesized
aaauaucgagggauuuag

SEQ ID NO: 9721 - RNA, 18 nt, artificial
  Chemically synthesized
cuugcuguaaaucaaagc

SEQ ID NO: 9722 - RNA, 18 nt, artificial
  Chemically synthesized
aaagcagauggucaauuc

SEQ ID NO: 9723 - RNA, 18 nt, artificial
  Chemically synthesized
uuugacaucuuucucccg

SEQ ID NO: 9724 - RNA, 18 nt, artificial
  Chemically synthesized
acacucgcacguuugaca

SEQ ID NO: 9725 - RNA, 18 nt, artificial
  Chemically synthesized
uccgcugaucaaauggac

SEQ ID NO: 9726 - RNA, 18 nt, artificial
  Chemically synthesized
gacggaucagucuuuggg

SEQ ID NO: 9727 - RNA, 18 nt, artificial
  Chemically synthesized
aauggacuggcgagcggg

SEQ ID NO: 9728 - RNA, 18 nt, artificial
  Chemically synthesized
ucugauaaacaaggaaac

SEQ ID NO: 9729 - RNA, 18 nt, artificial
  Chemically synthesized
ucgaaauuccacuugcgc

SEQ ID NO: 9730 - RNA, 18 nt, artificial
  Chemically synthesized
auuccacuugcgcuggcu

SEQ ID NO: 9731 - RNA, 18 nt, artificial
  Chemically synthesized
uuaauucgagcuguuuac

SEQ ID NO: 9732 - RNA, 18 nt, artificial
  Chemically synthesized
gcaccucggauuuuugcc

SEQ ID NO: 9733 - RNA, 18 nt, artificial
  Chemically synthesized
ugcuuauacaggaugucc

SEQ ID NO: 9734 - RNA, 18 nt, artificial
  Chemically synthesized
uuuggguccaccaaaugc

SEQ ID NO: 9735 - RNA, 18 nt, artificial
  Chemically synthesized
uuaacauucaaaacuccc

SEQ ID NO: 9736 - RNA, 18 nt, artificial
  Chemically synthesized
acucuucgugguccaccg

SEQ ID NO: 9737 - RNA, 18 nt, artificial
  Chemically synthesized
uuccaugucucugcagug

SEQ ID NO: 9738 - RNA, 18 nt, artificial
  Chemically synthesized
aggcuucuugggcgucug

SEQ ID NO: 9739 - RNA, 18 nt, artificial
  Chemically synthesized
ucuacuugcuguaaauca

SEQ ID NO: 9740 - RNA, 18 nt, artificial
  Chemically synthesized
cugaucaaauggacuggc

SEQ ID NO: 9741 - RNA, 18 nt, artificial
  Chemically synthesized
augugaaguuacuuacag

SEQ ID NO: 9742 - RNA, 18 nt, artificial
  Chemically synthesized
agcaagcucuucauaccc

SEQ ID NO: 9743 - RNA, 18 nt, artificial
  Chemically synthesized
uguccucagaguuagccg

SEQ ID NO: 9744 - RNA, 18 nt, artificial
  Chemically synthesized
aguuauguacacagguac

SEQ ID NO: 9745 - RNA, 18 nt, artificial
  Chemically synthesized
agucuccgcugaucaaau

SEQ ID NO: 9746 - RNA, 18 nt, artificial
  Chemically synthesized
caacuuuaagagagacug

SEQ ID NO: 9747 - RNA, 18 nt, artificial
  Chemically synthesized
ccguuagacacucgcacg

SEQ ID NO: 9748 - RNA, 18 nt, artificial
  Chemically synthesized
uugcuucaucaagcagug

SEQ ID NO: 9749 - RNA, 18 nt, artificial
  Chemically synthesized
guuugacgucuucugagg

SEQ ID NO: 9750 - RNA, 18 nt, artificial
  Chemically synthesized
uaaauggacagaguaagc

SEQ ID NO: 9751 - RNA, 18 nt, artificial
  Chemically synthesized
ucugcuccacagaaccgg

SEQ ID NO: 9752 - RNA, 18 nt, artificial
  Chemically synthesized
aaugguuuuuccauacac

SEQ ID NO: 9753 - RNA, 18 nt, artificial
  Chemically synthesized
aacuauauacacagguag

SEQ ID NO: 9754 - RNA, 18 nt, artificial
  Chemically synthesized
gaaauuccacuugcgcug

SEQ ID NO: 9755 - RNA, 18 nt, artificial
  Chemically synthesized
uaugcaaccuuuuaagca

SEQ ID NO: 9756 - RNA, 18 nt, artificial
  Chemically synthesized
ucucugaaagggacauua

SEQ ID NO: 9757 - RNA, 18 nt, artificial
  Chemically synthesized
agaaucgucgguugcagg

SEQ ID NO: 9758 - RNA, 18 nt, artificial
  Chemically synthesized
aaaugcacaaaacaugcc

SEQ ID NO: 9759 - RNA, 18 nt, artificial
  Chemically synthesized
caagcugcccuucuccac

SEQ ID NO: 9760 - RNA, 18 nt, artificial
  Chemically synthesized
cuauucuacccaacacag

SEQ ID NO: 9761 - RNA, 18 nt, artificial
  Chemically synthesized
ugugcuuuucucuacaug

SEQ ID NO: 9762 - RNA, 18 nt, artificial
  Chemically synthesized
agugaucaccauucugcu

SEQ ID NO: 9763 - RNA, 18 nt, artificial
  Chemically synthesized
ugaaguuacuuacagauc

SEQ ID NO: 9764 - RNA, 18 nt, artificial
  Chemically synthesized
cacccugcccucccuucc

SEQ ID NO: 9765 - RNA, 18 nt, artificial
  Chemically synthesized
cgucuggcuguccgacgg

SEQ ID NO: 9766 - RNA, 18 nt, artificial
  Chemically synthesized
cgaacaaaacaaagcgcc

SEQ ID NO: 9767 - RNA, 18 nt, artificial
  Chemically synthesized
ucuacaugaaccuuccuu

SEQ ID NO: 9768 - RNA, 18 nt, artificial
  Chemically synthesized
aucaaauggacuggcgag

SEQ ID NO: 9769 - RNA, 18 nt, artificial
  Chemically synthesized
aaacuaccuggagugauc

SEQ ID NO: 9770 - RNA, 18 nt, artificial
  Chemically synthesized
ugguuuuuccauacacag

SEQ ID NO: 9771 - RNA, 18 nt, artificial
  Chemically synthesized
aucuuucucccgggucug

SEQ ID NO: 9772 - RNA, 18 nt, artificial
  Chemically synthesized
uucuguuggcucuuuugu

SEQ ID NO: 9773 - RNA, 18 nt, artificial
  Chemically synthesized
acagguacacuucaaaug

SEQ ID NO: 9774 - RNA, 18 nt, artificial
  Chemically synthesized
cacguuugacaucuuucu

SEQ ID NO: 9775 - RNA, 18 nt, artificial
  Chemically synthesized
aucaagcagugauguauc

SEQ ID NO: 9776 - RNA, 18 nt, artificial
  Chemically synthesized
aaaucgaaauuccacuug

SEQ ID NO: 9777 - RNA, 18 nt, artificial
  Chemically synthesized
gcucuccaaaccuugccg

SEQ ID NO: 9778 - RNA, 18 nt, artificial
  Chemically synthesized
uugcuguaaaucaaagca

SEQ ID NO: 9779 - RNA, 18 nt, artificial
  Chemically synthesized
uguaguauccauuucacu

SEQ ID NO: 9780 - RNA, 18 nt, artificial
  Chemically synthesized
auugcuucucuucaugca

SEQ ID NO: 9781 - RNA, 18 nt, artificial
  Chemically synthesized
uucuguucuguuggcucu

SEQ ID NO: 9782 - RNA, 18 nt, artificial
  Chemically synthesized
auagcuugggagaucacc

SEQ ID NO: 9783 - RNA, 18 nt, artificial
  Chemically synthesized
agcuguuuacguuugacg

SEQ ID NO: 9784 - RNA, 18 nt, artificial
  Chemically synthesized
acccugcccucccuuccc

SEQ ID NO: 9785 - RNA, 18 nt, artificial
  Chemically synthesized
agauggucaauucuuaac

SEQ ID NO: 9786 - RNA, 18 nt, artificial
  Chemically synthesized
ucgcacucucaaaaaaac

SEQ ID NO: 9787 - RNA, 18 nt, artificial
  Chemically synthesized
uguuuacguuugacgucu

SEQ ID NO: 9788 - RNA, 18 nt, artificial
  Chemically synthesized
cuuggcucaguaugcaac

SEQ ID NO: 9789 - RNA, 18 nt, artificial
  Chemically synthesized
agaucaccagaucuccca

SEQ ID NO: 9790 - RNA, 18 nt, artificial
  Chemically synthesized
ucccaaaugagaauaaac

SEQ ID NO: 9791 - RNA, 18 nt, artificial
  Chemically synthesized
acagguaguacaaugaag

SEQ ID NO: 9792 - RNA, 18 nt, artificial
  Chemically synthesized
cauccaacgcuuuuagag

SEQ ID NO: 9793 - RNA, 18 nt, artificial
  Chemically synthesized
uguaaaucaaagcaagcu

SEQ ID NO: 9794 - RNA, 18 nt, artificial
  Chemically synthesized
ucucggaagcccagcgac

SEQ ID NO: 9795 - RNA, 18 nt, artificial
  Chemically synthesized
auuauacuuggcucagua

SEQ ID NO: 9796 - RNA, 18 nt, artificial
  Chemically synthesized
uaccuggagugaucacca

SEQ ID NO: 9797 - RNA, 18 nt, artificial
  Chemically synthesized
aucgaaauuccacuugcg

SEQ ID NO: 9798 - RNA, 18 nt, artificial
  Chemically synthesized
aucaaagcaagcucuuca

SEQ ID NO: 9799 - RNA, 18 nt, artificial
  Chemically synthesized
ucuuccaugucucugcag

SEQ ID NO: 9800 - RNA, 18 nt, artificial
  Chemically synthesized
uagaagaaucgucgguug

SEQ ID NO: 9801 - RNA, 18 nt, artificial
  Chemically synthesized
uaucgagggauuuagaau

SEQ ID NO: 9802 - RNA, 18 nt, artificial
  Chemically synthesized
uauggcgguggaagggag

SEQ ID NO: 9803 - RNA, 18 nt, artificial
  Chemically synthesized
gccgcucuccaaaccuug

SEQ ID NO: 9804 - RNA, 18 nt, artificial
  Chemically synthesized
uguccgacggaucagucu

SEQ ID NO: 9805 - RNA, 18 nt, artificial
  Chemically synthesized
auccuggcucuccugcgc

SEQ ID NO: 9806 - RNA, 18 nt, artificial
  Chemically synthesized
uuggcaucuuuuucacac

SEQ ID NO: 9807 - RNA, 18 nt, artificial
  Chemically synthesized
aaauggacuggcgagcgg

SEQ ID NO: 9808 - RNA, 18 nt, artificial
  Chemically synthesized
ugucucugcagugcuucu

SEQ ID NO: 9809 - RNA, 18 nt, artificial
  Chemically synthesized
gccaaaagacacagaccc

SEQ ID NO: 9810 - RNA, 18 nt, artificial
  Chemically synthesized
uggcucgccucuuccaug

SEQ ID NO: 9811 - RNA, 18 nt, artificial
  Chemically synthesized
ccgcucuccaaaccuugc

SEQ ID NO: 9812 - RNA, 18 nt, artificial
  Chemically synthesized
caaacuuuagauagcuug

SEQ ID NO: 9813 - RNA, 18 nt, artificial
  Chemically synthesized
cagugcuucuccaagucc

SEQ ID NO: 9814 - RNA, 18 nt, artificial
  Chemically synthesized
aaauuauacuuggcucag

SEQ ID NO: 9815 - RNA, 18 nt, artificial
  Chemically synthesized
gcauugcuccgcuaaccc

SEQ ID NO: 9816 - RNA, 18 nt, artificial
  Chemically synthesized
accuuuuaagcauagcca

SEQ ID NO: 9817 - RNA, 18 nt, artificial
  Chemically synthesized
uaaugcuacauccaacgc

SEQ ID NO: 9818 - RNA, 18 nt, artificial
  Chemically synthesized
guguccucagaguuagcc

SEQ ID NO: 9819 - RNA, 18 nt, artificial
  Chemically synthesized
ugcuucuccaagucccgg

SEQ ID NO: 9820 - RNA, 18 nt, artificial
  Chemically synthesized
accuauucuacccaacac

SEQ ID NO: 9821 - RNA, 18 nt, artificial
  Chemically synthesized
uucugcugaguaauuaac

SEQ ID NO: 9822 - RNA, 18 nt, artificial
  Chemically synthesized
uagcuugggagaucacca

SEQ ID NO: 9823 - RNA, 18 nt, artificial
  Chemically synthesized
ugacauccuggcucuccu

SEQ ID NO: 9824 - RNA, 18 nt, artificial
  Chemically synthesized
gagaucaccagaucuccc

SEQ ID NO: 9825 - RNA, 18 nt, artificial
  Chemically synthesized
cauaaugcuacauccaac

SEQ ID NO: 9826 - RNA, 18 nt, artificial
  Chemically synthesized
agaguuauguacacaggu

SEQ ID NO: 9827 - RNA, 18 nt, artificial
  Chemically synthesized
ucugggcgggugcaagcc

SEQ ID NO: 9828 - RNA, 18 nt, artificial
  Chemically synthesized
ggaaaaccuauucuaccc

SEQ ID NO: 9829 - RNA, 18 nt, artificial
  Chemically synthesized
cguccauccgcuccaggc

SEQ ID NO: 9830 - RNA, 18 nt, artificial
  Chemically synthesized
cauucaaaacucccaagc

SEQ ID NO: 9831 - RNA, 18 nt, artificial
  Chemically synthesized
cauccuggcucuccugcg

SEQ ID NO: 9832 - RNA, 18 nt, artificial
  Chemically synthesized
uguucuguuggcucuuuu

SEQ ID NO: 9833 - RNA, 18 nt, artificial
  Chemically synthesized
gucuccgcugaucaaaug

SEQ ID NO: 9834 - RNA, 18 nt, artificial
  Chemically synthesized
uuucacuuauccuacaag

SEQ ID NO: 9835 - RNA, 18 nt, artificial
  Chemically synthesized
agcugucucugaaaggga

SEQ ID NO: 9836 - RNA, 18 nt, artificial
  Chemically synthesized
ugaucaccauucugcuga

SEQ ID NO: 9837 - RNA, 18 nt, artificial
  Chemically synthesized
caucuuucucccgggucu

SEQ ID NO: 9838 - RNA, 18 nt, artificial
  Chemically synthesized
gugcuucuccaagucccg

SEQ ID NO: 9839 - RNA, 18 nt, artificial
  Chemically synthesized
cacuugcgcuggcucgcc

SEQ ID NO: 9840 - RNA, 18 nt, artificial
  Chemically synthesized
uguuguuguuuuucagug

SEQ ID NO: 9841 - RNA, 18 nt, artificial
  Chemically synthesized
ugccuggcguccauccgc

SEQ ID NO: 9842 - RNA, 18 nt, artificial
  Chemically synthesized
aaucgucgguugcagguc

SEQ ID NO: 9843 - RNA, 18 nt, artificial
  Chemically synthesized
aaucaaagcaagcucuuc

SEQ ID NO: 9844 - RNA, 18 nt, artificial
  Chemically synthesized
uguccauuccaugaaguc

SEQ ID NO: 9845 - RNA, 18 nt, artificial
  Chemically synthesized
aauauggcgguggaaggg

SEQ ID NO: 9846 - RNA, 18 nt, artificial
  Chemically synthesized
ccaauuaaaggcgccgcc

SEQ ID NO: 9847 - RNA, 18 nt, artificial
  Chemically synthesized
aaaacaugccacuuuggc

SEQ ID NO: 9848 - RNA, 18 nt, artificial
  Chemically synthesized
acggaucagucuuugggu

SEQ ID NO: 9849 - RNA, 18 nt, artificial
  Chemically synthesized
cuucaucaagcagugaug

SEQ ID NO: 9850 - RNA, 18 nt, artificial
  Chemically synthesized
gucgcuuccuuauuccug

SEQ ID NO: 9851 - RNA, 18 nt, artificial
  Chemically synthesized
aauuaaaggcgccgccgg

SEQ ID NO: 9852 - RNA, 18 nt, artificial
  Chemically synthesized
ggaucagucuuugggucc

SEQ ID NO: 9853 - RNA, 18 nt, artificial
  Chemically synthesized
gcugucucugaaagggac

SEQ ID NO: 9854 - RNA, 18 nt, artificial
  Chemically synthesized
aaacuuuagauagcuugg

SEQ ID NO: 9855 - RNA, 18 nt, artificial
  Chemically synthesized
augguuuuuccauacaca

SEQ ID NO: 9856 - RNA, 18 nt, artificial
  Chemically synthesized
aggccaggcuucuugggc

SEQ ID NO: 9857 - RNA, 18 nt, artificial
  Chemically synthesized
uucuccaccucuugccac

SEQ ID NO: 9858 - RNA, 18 nt, artificial
  Chemically synthesized
ccgagucuccgcugauca

SEQ ID NO: 9859 - RNA, 18 nt, artificial
  Chemically synthesized
gggaaaaccuauucuacc

SEQ ID NO: 9860 - RNA, 18 nt, artificial
  Chemically synthesized
ggaagcccagcgacugcc

SEQ ID NO: 9861 - RNA, 18 nt, artificial
  Chemically synthesized
cucgcacguuugacaucu

SEQ ID NO: 9862 - RNA, 18 nt, artificial
  Chemically synthesized
ccuauucuacccaacaca

SEQ ID NO: 9863 - RNA, 18 nt, artificial
  Chemically synthesized
accucuugccacucguac

SEQ ID NO: 9864 - RNA, 18 nt, artificial
  Chemically synthesized
cagcauuuacaaaugcac

SEQ ID NO: 9865 - RNA, 18 nt, artificial
  Chemically synthesized
augcuacauccaacgcuu

SEQ ID NO: 9866 - RNA, 18 nt, artificial
  Chemically synthesized
uuccacuugcgcuggcuc

SEQ ID NO: 9867 - RNA, 18 nt, artificial
  Chemically synthesized
auguaguauccauuucac

SEQ ID NO: 9868 - RNA, 18 nt, artificial
  Chemically synthesized
uguaguagaacucgggca

SEQ ID NO: 9869 - RNA, 18 nt, artificial
  Chemically synthesized
ucugaaagggacauuaca

SEQ ID NO: 9870 - RNA, 18 nt, artificial
  Chemically synthesized
uguacacagguacacuuc

SEQ ID NO: 9871 - RNA, 18 nt, artificial
  Chemically synthesized
cugacauccuggcucucc

SEQ ID NO: 9872 - RNA, 18 nt, artificial
  Chemically synthesized
gaagcccagcgacugccc

SEQ ID NO: 9873 - RNA, 18 nt, artificial
  Chemically synthesized
ccgucuggcuguccgacg

SEQ ID NO: 9874 - RNA, 18 nt, artificial
  Chemically synthesized
cgucggagucgcagagcc

SEQ ID NO: 9875 - RNA, 18 nt, artificial
  Chemically synthesized
cguuugacgucuucugag

SEQ ID NO: 9876 - RNA, 18 nt, artificial
  Chemically synthesized
aaauuccacuugcgcugg

SEQ ID NO: 9877 - RNA, 18 nt, artificial
  Chemically synthesized
gcgacugcccucggagcc

SEQ ID NO: 9878 - RNA, 18 nt, artificial
  Chemically synthesized
aggauagguuucuguugc

SEQ ID NO: 9879 - RNA, 18 nt, artificial
  Chemically synthesized
ucuugccacucguacuug

SEQ ID NO: 9880 - RNA, 18 nt, artificial
  Chemically synthesized
cacaggcaaugaaauacu

SEQ ID NO: 9881 - RNA, 18 nt, artificial
  Chemically synthesized
aagcagauggucaauucu

SEQ ID NO: 9882 - RNA, 18 nt, artificial
  Chemically synthesized
gacacucgcacguuugac

SEQ ID NO: 9883 - RNA, 18 nt, artificial
  Chemically synthesized
guuaacucuucguggucc

SEQ ID NO: 9884 - RNA, 18 nt, artificial
  Chemically synthesized
cuugcuucaucaagcagu

SEQ ID NO: 9885 - RNA, 18 nt, artificial
  Chemically synthesized
ugaaaaucgaaauuccac

SEQ ID NO: 9886 - RNA, 18 nt, artificial
  Chemically synthesized
aagccacaugcagcuauc

SEQ ID NO: 9887 - RNA, 18 nt, artificial
  Chemically synthesized
ugcagugcuucuccaagu

SEQ ID NO: 9888 - RNA, 18 nt, artificial
  Chemically synthesized
accuugccggcgucggag

SEQ ID NO: 9889 - RNA, 18 nt, artificial
  Chemically synthesized
cagguacacuucaaaugg

SEQ ID NO: 9890 - RNA, 18 nt, artificial
  Chemically synthesized
cgcuggcucgccucuucc

SEQ ID NO: 9891 - RNA, 18 nt, artificial
  Chemically synthesized
aguagaagaaucgucggu

SEQ ID NO: 9892 - RNA, 18 nt, artificial
  Chemically synthesized
cucuuuuguuuugaguag

SEQ ID NO: 9893 - RNA, 18 nt, artificial
  Chemically synthesized
uuggcucuuuuguuuuga

SEQ ID NO: 9894 - RNA, 18 nt, artificial
  Chemically synthesized
acuuauccuacaagugug

SEQ ID NO: 9895 - RNA, 18 nt, artificial
  Chemically synthesized
cgcugaucaaauggacug

SEQ ID NO: 9896 - RNA, 18 nt, artificial
  Chemically synthesized
auuccaugaagucagcga

SEQ ID NO: 9897 - RNA, 18 nt, artificial
  Chemically synthesized
ccgcugacauccuggcuc

SEQ ID NO: 9898 - RNA, 18 nt, artificial
  Chemically synthesized
uacuuggcucaguaugca

SEQ ID NO: 9899 - RNA, 18 nt, artificial
  Chemically synthesized
uacauccaacgcuuuuag

SEQ ID NO: 9900 - RNA, 18 nt, artificial
  Chemically synthesized
auagcuauggaaguuuuc

SEQ ID NO: 9901 - RNA, 18 nt, artificial
  Chemically synthesized
aagcagugauguaucuga

SEQ ID NO: 9902 - RNA, 18 nt, artificial
  Chemically synthesized
gauggucaauucuuaaca

SEQ ID NO: 9903 - RNA, 18 nt, artificial
  Chemically synthesized
ucccgcgaacccagccgc

SEQ ID NO: 9904 - RNA, 18 nt, artificial
  Chemically synthesized
caauauggcgguggaagg

SEQ ID NO: 9905 - RNA, 18 nt, artificial
  Chemically synthesized
guaugcaaccuuuuaagc

SEQ ID NO: 9906 - RNA, 18 nt, artificial
  Chemically synthesized
ugaggccaggcuucuugg

SEQ ID NO: 9907 - RNA, 18 nt, artificial
  Chemically synthesized
acgucaguuccucagccc

SEQ ID NO: 9908 - RNA, 18 nt, artificial
  Chemically synthesized
ucuuucucccgggucugc

SEQ ID NO: 9909 - RNA, 18 nt, artificial
  Chemically synthesized
ucguacuugcccucuagg

SEQ ID NO: 9910 - RNA, 18 nt, artificial
  Chemically synthesized
aaaaagccacaugcagcu

SEQ ID NO: 9911 - RNA, 18 nt, artificial
  Chemically synthesized
agcugcccuucuccaccu

SEQ ID NO: 9912 - RNA, 18 nt, artificial
  Chemically synthesized
auguauaucuuccuugcu

SEQ ID NO: 9913 - RNA, 18 nt, artificial
  Chemically synthesized
acuguguuuacacagccc

SEQ ID NO: 9914 - RNA, 18 nt, artificial
  Chemically synthesized
cuguccgacggaucaguc

SEQ ID NO: 9915 - RNA, 18 nt, artificial
  Chemically synthesized
aauuccacuugcgcuggc

SEQ ID NO: 9916 - RNA, 18 nt, artificial
  Chemically synthesized
cuugcgcuggcucgccuc

SEQ ID NO: 9917 - RNA, 18 nt, artificial
  Chemically synthesized
cuggagugaucaccauuc

SEQ ID NO: 9918 - RNA, 18 nt, artificial
  Chemically synthesized
guguuauuguguuguugu

SEQ ID NO: 9919 - RNA, 18 nt, artificial
  Chemically synthesized
cuucucuucaugcaaguc

SEQ ID NO: 9920 - RNA, 18 nt, artificial
  Chemically synthesized
cuuauuccugcgcauugc

SEQ ID NO: 9921 - RNA, 18 nt, artificial
  Chemically synthesized
agauguaguauccauuuc

SEQ ID NO: 9922 - RNA, 18 nt, artificial
  Chemically synthesized
uguuggcucuuuuguuuu

SEQ ID NO: 9923 - RNA, 18 nt, artificial
  Chemically synthesized
acaggcaaugaaauacug

SEQ ID NO: 9924 - RNA, 18 nt, artificial
  Chemically synthesized
uccaccaaaugcgugucc

SEQ ID NO: 9925 - RNA, 18 nt, artificial
  Chemically synthesized
uuauguacacagguacac

SEQ ID NO: 9926 - RNA, 18 nt, artificial
  Chemically synthesized
accuaauugcauaaugcu

SEQ ID NO: 9927 - RNA, 18 nt, artificial
  Chemically synthesized
gcuucuugggcgucugcu

SEQ ID NO: 9928 - RNA, 18 nt, artificial
  Chemically synthesized
aagaaucgucgguugcag

SEQ ID NO: 9929 - RNA, 18 nt, artificial
  Chemically synthesized
acugguaaauuccaacuu

SEQ ID NO: 9930 - RNA, 18 nt, artificial
  Chemically synthesized
agaucucccaaaugagaa

SEQ ID NO: 9931 - RNA, 18 nt, artificial
  Chemically synthesized
cgucugaaacauuuucuu

SEQ ID NO: 9932 - RNA, 18 nt, artificial
  Chemically synthesized
uccaacgcuuuuagaggc

SEQ ID NO: 9933 - RNA, 18 nt, artificial
  Chemically synthesized
uugcuucucuucaugcaa

SEQ ID NO: 9934 - RNA, 18 nt, artificial
  Chemically synthesized
aggcaaugaaauacuguu

SEQ ID NO: 9935 - RNA, 18 nt, artificial
  Chemically synthesized
acauuuucuucuguucug

SEQ ID NO: 9936 - RNA, 18 nt, artificial
  Chemically synthesized
acaucuuucucccggguc

SEQ ID NO: 9937 - RNA, 18 nt, artificial
  Chemically synthesized
ucggaagcccagcgacug

SEQ ID NO: 9938 - RNA, 18 nt, artificial
  Chemically synthesized
uuccugcgcauugcuccg

SEQ ID NO: 9939 - RNA, 18 nt, artificial
  Chemically synthesized
cuugcaggcaccuuuggg

SEQ ID NO: 9940 - RNA, 18 nt, artificial
  Chemically synthesized
gauguaguauccauuuca

SEQ ID NO: 9941 - RNA, 18 nt, artificial
  Chemically synthesized
acauccuggcucuccugc

SEQ ID NO: 9942 - RNA, 18 nt, artificial
  Chemically synthesized
aaaacucccaagcaccuc

SEQ ID NO: 9943 - RNA, 18 nt, artificial
  Chemically synthesized
ucuucaugcaagucaaau

SEQ ID NO: 9944 - RNA, 18 nt, artificial
  Chemically synthesized
caaaugcacaaaacaugc

SEQ ID NO: 9945 - RNA, 18 nt, artificial
  Chemically synthesized
aauuaucuuuagccagug

SEQ ID NO: 9946 - RNA, 18 nt, artificial
  Chemically synthesized
cucagaguuagccggagc

SEQ ID NO: 9947 - RNA, 18 nt, artificial
  Chemically synthesized
gcacguuugacaucuuuc

SEQ ID NO: 9948 - RNA, 18 nt, artificial
  Chemically synthesized
auagguuucuguugcuuu

SEQ ID NO: 9949 - RNA, 18 nt, artificial
  Chemically synthesized
aagcaccucggauuuuug

SEQ ID NO: 9950 - RNA, 18 nt, artificial
  Chemically synthesized
aaccgaacaaaacaaagc

SEQ ID NO: 9951 - RNA, 18 nt, artificial
  Chemically synthesized
ggcaagcugcccuucucc

SEQ ID NO: 9952 - RNA, 18 nt, artificial
  Chemically synthesized
uucaaaacucccaagcac

SEQ ID NO: 9953 - RNA, 18 nt, artificial
  Chemically synthesized
aucagucuuuggguccac

SEQ ID NO: 9954 - RNA, 18 nt, artificial
  Chemically synthesized
gcuuguauauugucuaga

SEQ ID NO: 9955 - RNA, 18 nt, artificial
  Chemically synthesized
agccaaaagacacagacc

SEQ ID NO: 9956 - RNA, 18 nt, artificial
  Chemically synthesized
auccgcuccaggcuaggg

SEQ ID NO: 9957 - RNA, 18 nt, artificial
  Chemically synthesized
ccgcuccacgucaguucc

SEQ ID NO: 9958 - RNA, 18 nt, artificial
  Chemically synthesized
aaagcccguccgagucug

SEQ ID NO: 9959 - RNA, 18 nt, artificial
  Chemically synthesized
augaaguaucagcugucu

SEQ ID NO: 9960 - RNA, 18 nt, artificial
  Chemically synthesized
cucguacuugcccucuag

SEQ ID NO: 9961 - RNA, 18 nt, artificial
  Chemically synthesized
acuugcgcuggcucgccu

SEQ ID NO: 9962 - RNA, 18 nt, artificial
  Chemically synthesized
agaggguggcaaagcccg

SEQ ID NO: 9963 - RNA, 18 nt, artificial
  Chemically synthesized
aauuauacuuggcucagu

SEQ ID NO: 9964 - RNA, 18 nt, artificial
  Chemically synthesized
gugauguaucugauaaac

SEQ ID NO: 9965 - RNA, 18 nt, artificial
  Chemically synthesized
ccaguguucaaauuuuug

SEQ ID NO: 9966 - RNA, 18 nt, artificial
  Chemically synthesized
uuaucuuuagccaguguu

SEQ ID NO: 9967 - RNA, 18 nt, artificial
  Chemically synthesized
uggcguccauccgcucca

SEQ ID NO: 9968 - RNA, 18 nt, artificial
  Chemically synthesized
guagaagaaucgucgguu

SEQ ID NO: 9969 - RNA, 18 nt, artificial
  Chemically synthesized
cguuagacacucgcacgu

SEQ ID NO: 9970 - RNA, 18 nt, artificial
  Chemically synthesized
uuguuguuuuucagugcu

SEQ ID NO: 9971 - RNA, 18 nt, artificial
  Chemically synthesized
gagccaaaagacacagac

SEQ ID NO: 9972 - RNA, 18 nt, artificial
  Chemically synthesized
cagaguuauguacacagg

SEQ ID NO: 9973 - RNA, 18 nt, artificial
  Chemically synthesized
cagccgcucuccaaaccu

SEQ ID NO: 9974 - RNA, 18 nt, artificial
  Chemically synthesized
uaucagcugucucugaaa

SEQ ID NO: 9975 - RNA, 18 nt, artificial
  Chemically synthesized
augcacaaaacaugccac

SEQ ID NO: 9976 - RNA, 18 nt, artificial
  Chemically synthesized
cucggagccaaaagacac

SEQ ID NO: 9977 - RNA, 18 nt, artificial
  Chemically synthesized
aacucccaagcaccucgg

SEQ ID NO: 9978 - RNA, 18 nt, artificial
  Chemically synthesized
ucccguuagacacucgca

SEQ ID NO: 9979 - RNA, 18 nt, artificial
  Chemically synthesized
aaaccgaacaaaacaaag

SEQ ID NO: 9980 - RNA, 18 nt, artificial
  Chemically synthesized
aaccuauucuacccaaca

SEQ ID NO: 9981 - RNA, 18 nt, artificial
  Chemically synthesized
aacaugccacuuuggcuu

SEQ ID NO: 9982 - RNA, 18 nt, artificial
  Chemically synthesized
gcgucugcuccacagaac

SEQ ID NO: 9983 - RNA, 18 nt, artificial
  Chemically synthesized
augaagucagcgauaugu

SEQ ID NO: 9984 - RNA, 18 nt, artificial
  Chemically synthesized
uggagugaucaccauucu

SEQ ID NO: 9985 - RNA, 18 nt, artificial
  Chemically synthesized
guccauccgcuccaggcu

SEQ ID NO: 9986 - RNA, 18 nt, artificial
  Chemically synthesized
aucgucgguugcaggucg

SEQ ID NO: 9987 - RNA, 18 nt, artificial
  Chemically synthesized
cggaucagucuuuggguc

SEQ ID NO: 9988 - RNA, 18 nt, artificial
  Chemically synthesized
agagguuccugcaggccg

SEQ ID NO: 9989 - RNA, 18 nt, artificial
  Chemically synthesized
uagggcucccguuagaca

SEQ ID NO: 9990 - RNA, 18 nt, artificial
  Chemically synthesized
uuccaugaagucagcgau

SEQ ID NO: 9991 - RNA, 18 nt, artificial
  Chemically synthesized
aaugcacaaaacaugcca

SEQ ID NO: 9992 - RNA, 18 nt, artificial
  Chemically synthesized
ggagaucaccagaucucc

SEQ ID NO: 9993 - RNA, 18 nt, artificial
  Chemically synthesized
caggauguccauuccaug

SEQ ID NO: 9994 - RNA, 18 nt, artificial
  Chemically synthesized
cgucuucugaggccaggc

SEQ ID NO: 9995 - RNA, 18 nt, artificial
  Chemically synthesized
uuuacguuugacgucuuc

SEQ ID NO: 9996 - RNA, 18 nt, artificial
  Chemically synthesized
aauaucgagggauuuaga

SEQ ID NO: 9997 - RNA, 18 nt, artificial
  Chemically synthesized
guaguacaaugaagcaaa

SEQ ID NO: 9998 - RNA, 18 nt, artificial
  Chemically synthesized
caggucgcuuccuuauuc

SEQ ID NO: 9999 - RNA, 18 nt, artificial
  Chemically synthesized
agucugggcgggugcaag

SEQ ID NO: 10000 - RNA, 18 nt, artificial
  Chemically synthesized
uugcaggucgcuuccuua

SEQ ID NO: 10001 - RNA, 18 nt, artificial
  Chemically synthesized
uugcgcuggcucgccucu

SEQ ID NO: 10002 - RNA, 18 nt, artificial
  Chemically synthesized
aaagggacauuacaucuu

SEQ ID NO: 10003 - RNA, 18 nt, artificial
  Chemically synthesized
agugugcuuuucucuaca

SEQ ID NO: 10004 - RNA, 18 nt, artificial
  Chemically synthesized
gagaggguggcaaagccc

SEQ ID NO: 10005 - RNA, 18 nt, artificial
  Chemically synthesized
cuuccuuauuccugcgca

SEQ ID NO: 10006 - RNA, 18 nt, artificial
  Chemically synthesized
caggcuucuugggcgucu

SEQ ID NO: 10007 - RNA, 18 nt, artificial
  Chemically synthesized
aauggacagaguaagcuu

SEQ ID NO: 10008 - RNA, 18 nt, artificial
  Chemically synthesized
ccgccucucucgcacucu

SEQ ID NO: 10009 - RNA, 18 nt, artificial
  Chemically synthesized
agcaccucggauuuuugc

SEQ ID NO: 10010 - RNA, 18 nt, artificial
  Chemically synthesized
guuccugcaggccgaggg

SEQ ID NO: 10011 - RNA, 18 nt, artificial
  Chemically synthesized
uggcucuccugcgccggc

SEQ ID NO: 10012 - RNA, 18 nt, artificial
  Chemically synthesized
aagcccagcgacugcccu

SEQ ID NO: 10013 - RNA, 18 nt, artificial
  Chemically synthesized
gugaggauagguuucugu

SEQ ID NO: 10014 - RNA, 18 nt, artificial
  Chemically synthesized
agcccguccgagucuggg

SEQ ID NO: 10015 - RNA, 18 nt, artificial
  Chemically synthesized
uuuacacagcccgaagug

SEQ ID NO: 10016 - RNA, 18 nt, artificial
  Chemically synthesized
ucaccauucugcugagua

SEQ ID NO: 10017 - RNA, 18 nt, artificial
  Chemically synthesized
ugucucugaaagggacau

SEQ ID NO: 10018 - RNA, 18 nt, artificial
  Chemically synthesized
uggcuguccgacggauca

SEQ ID NO: 10019 - RNA, 18 nt, artificial
  Chemically synthesized
cgcauugcuccgcuaacc

SEQ ID NO: 10020 - RNA, 18 nt, artificial
  Chemically synthesized
ugugaaguuacuuacaga

SEQ ID NO: 10021 - RNA, 18 nt, artificial
  Chemically synthesized
cagcgacugcccucggag

SEQ ID NO: 10022 - RNA, 18 nt, artificial
  Chemically synthesized
gcugaucaaauggacugg

SEQ ID NO: 10023 - RNA, 18 nt, artificial
  Chemically synthesized
ucucucgcacucucaaaa

SEQ ID NO: 10024 - RNA, 18 nt, artificial
  Chemically synthesized
ccagaucucccaaaugag

SEQ ID NO: 10025 - RNA, 18 nt, artificial
  Chemically synthesized
acauucaaaacucccaag

SEQ ID NO: 10026 - RNA, 18 nt, artificial
  Chemically synthesized
uugggcgucugcuccaca

SEQ ID NO: 10027 - RNA, 18 nt, artificial
  Chemically synthesized
cuuuagauagcuugggag

SEQ ID NO: 10028 - RNA, 18 nt, artificial
  Chemically synthesized
guuagacacucgcacguu

SEQ ID NO: 10029 - RNA, 18 nt, artificial
  Chemically synthesized
aacuuuagauagcuuggg

SEQ ID NO: 10030 - RNA, 18 nt, artificial
  Chemically synthesized
acucgcacguuugacauc

SEQ ID NO: 10031 - RNA, 18 nt, artificial
  Chemically synthesized
ucaaagcaagcucuucau

SEQ ID NO: 10032 - RNA, 18 nt, artificial
  Chemically synthesized
uacaugaaccuuccuuga

SEQ ID NO: 10033 - RNA, 18 nt, artificial
  Chemically synthesized
uucuacccaacacagcau

SEQ ID NO: 10034 - RNA, 18 nt, artificial
  Chemically synthesized
uguauaucuuccuugcuu

SEQ ID NO: 10035 - RNA, 18 nt, artificial
  Chemically synthesized
gccucuuccaugucucug

SEQ ID NO: 10036 - RNA, 18 nt, artificial
  Chemically synthesized
gcccguccgagucugggc

SEQ ID NO: 10037 - RNA, 18 nt, artificial
  Chemically synthesized
aagcccguccgagucugg

SEQ ID NO: 10038 - RNA, 18 nt, artificial
  Chemically synthesized
auuaaaggcgccgccggg

SEQ ID NO: 10039 - RNA, 18 nt, artificial
  Chemically synthesized
cuggcguccauccgcucc

SEQ ID NO: 10040 - RNA, 18 nt, artificial
  Chemically synthesized
cugcccuucuccaccucu

SEQ ID NO: 10041 - RNA, 18 nt, artificial
  Chemically synthesized
ucgucgguugcaggucgc

SEQ ID NO: 10042 - RNA, 18 nt, artificial
  Chemically synthesized
auucaaaacucccaagca

SEQ ID NO: 10043 - RNA, 18 nt, artificial
  Chemically synthesized
gugccuaaaauuuuagug

SEQ ID NO: 10044 - RNA, 18 nt, artificial
  Chemically synthesized
ugcccuucuccaccucuu

SEQ ID NO: 10045 - RNA, 18 nt, artificial
  Chemically synthesized
ucuuuggguccaccaaau

SEQ ID NO: 10046 - RNA, 18 nt, artificial
  Chemically synthesized
auguccauuccaugaagu

SEQ ID NO: 10047 - RNA, 18 nt, artificial
  Chemically synthesized
gcucuuuuguuuugagua

SEQ ID NO: 10048 - RNA, 18 nt, artificial
  Chemically synthesized
cuuuggcuuguauauugu

SEQ ID NO: 10049 - RNA, 18 nt, artificial
  Chemically synthesized
aguaucagcugucucuga

SEQ ID NO: 10050 - RNA, 18 nt, artificial
  Chemically synthesized
cgccucucucgcacucuc

SEQ ID NO: 10051 - RNA, 18 nt, artificial
  Chemically synthesized
gcuuuuagaggcagauca

SEQ ID NO: 10052 - RNA, 18 nt, artificial
  Chemically synthesized
cuggcucuccugcgccgg

SEQ ID NO: 10053 - RNA, 18 nt, artificial
  Chemically synthesized
gcgguggaagggaggcug

SEQ ID NO: 10054 - RNA, 18 nt, artificial
  Chemically synthesized
agcccagcgacugcccuc

SEQ ID NO: 10055 - RNA, 18 nt, artificial
  Chemically synthesized
gucuucugaggccaggcu

SEQ ID NO: 10056 - RNA, 18 nt, artificial
  Chemically synthesized
cgagcucuaggagcgcgc

SEQ ID NO: 10057 - RNA, 18 nt, artificial
  Chemically synthesized
auucgagcuguuuacguu

SEQ ID NO: 10058 - RNA, 18 nt, artificial
  Chemically synthesized
cuguaaaucaaagcaagc

SEQ ID NO: 10059 - RNA, 18 nt, artificial
  Chemically synthesized
cuacaagugugcuuuucu

SEQ ID NO: 10060 - RNA, 18 nt, artificial
  Chemically synthesized
uagaacucgggcaagcug

SEQ ID NO: 10061 - RNA, 18 nt, artificial
  Chemically synthesized
ugugcuacauaaaaggua

SEQ ID NO: 10062 - RNA, 18 nt, artificial
  Chemically synthesized
aacuuuaagagagacugg

SEQ ID NO: 10063 - RNA, 18 nt, artificial
  Chemically synthesized
ccacucguacuugcccuc

SEQ ID NO: 10064 - RNA, 18 nt, artificial
  Chemically synthesized
accauucugcugaguaau

SEQ ID NO: 10065 - RNA, 18 nt, artificial
  Chemically synthesized
acuauauacacagguagu

SEQ ID NO: 10066 - RNA, 18 nt, artificial
  Chemically synthesized
gucugggcgggugcaagc

SEQ ID NO: 10067 - RNA, 18 nt, artificial
  Chemically synthesized
cugucucugaaagggaca

SEQ ID NO: 10068 - RNA, 18 nt, artificial
  Chemically synthesized
caauuaaaggcgccgccg

SEQ ID NO: 10069 - RNA, 18 nt, artificial
  Chemically synthesized
aagucagcgauauguauu

SEQ ID NO: 10070 - RNA, 18 nt, artificial
  Chemically synthesized
uccaggcuagggcucccg

SEQ ID NO: 10071 - RNA, 18 nt, artificial
  Chemically synthesized
cauuuucuucuguucugu

SEQ ID NO: 10072 - RNA, 18 nt, artificial
  Chemically synthesized
ccucuugccacucguacu

SEQ ID NO: 10073 - RNA, 18 nt, artificial
  Chemically synthesized
caaugaagcaaauaagga

SEQ ID NO: 10074 - RNA, 18 nt, artificial
  Chemically synthesized
uugccggcgucggagucg

SEQ ID NO: 10075 - RNA, 18 nt, artificial
  Chemically synthesized
cgaacccagccgcucucc

SEQ ID NO: 10076 - RNA, 18 nt, artificial
  Chemically synthesized
cgacggaucagucuuugg

SEQ ID NO: 10077 - RNA, 18 nt, artificial
  Chemically synthesized
cggcucccgcugacaucc

SEQ ID NO: 10078 - RNA, 18 nt, artificial
  Chemically synthesized
auaucgagggauuuagaa

SEQ ID NO: 10079 - RNA, 18 nt, artificial
  Chemically synthesized
gcucuaggagcgcgcagg

SEQ ID NO: 10080 - RNA, 18 nt, artificial
  Chemically synthesized
uuuuuccauacacaggca

SEQ ID NO: 10081 - RNA, 18 nt, artificial
  Chemically synthesized
guaucagcugucucugaa

SEQ ID NO: 10082 - RNA, 18 nt, artificial
  Chemically synthesized
ccggcaccuugcaggcac

SEQ ID NO: 10083 - RNA, 18 nt, artificial
  Chemically synthesized
aaagccacaugcagcuau

SEQ ID NO: 10084 - RNA, 18 nt, artificial
  Chemically synthesized
ccaauauggcgguggaag

SEQ ID NO: 10085 - RNA, 18 nt, artificial
  Chemically synthesized
cucuugccacucguacuu

SEQ ID NO: 10086 - RNA, 18 nt, artificial
  Chemically synthesized
cuuauccuacaagugugc

SEQ ID NO: 10087 - RNA, 18 nt, artificial
  Chemically synthesized
ccagccgcucuccaaacc

SEQ ID NO: 10088 - RNA, 18 nt, artificial
  Chemically synthesized
caaccuuuuaagcauagc

SEQ ID NO: 10089 - RNA, 18 nt, artificial
  Chemically synthesized
auggacagaguaagcuuu

SEQ ID NO: 10090 - RNA, 18 nt, artificial
  Chemically synthesized
gugcuuauacaggauguc

SEQ ID NO: 10091 - RNA, 18 nt, artificial
  Chemically synthesized
cacucgcacguuugacau

SEQ ID NO: 10092 - RNA, 18 nt, artificial
  Chemically synthesized
uuauuccugcgcauugcu

SEQ ID NO: 10093 - RNA, 18 nt, artificial
  Chemically synthesized
cucgccucuuccaugucu

SEQ ID NO: 10094 - RNA, 18 nt, artificial
  Chemically synthesized
uacaggauguccauucca

SEQ ID NO: 10095 - RNA, 18 nt, artificial
  Chemically synthesized
caccuugcaggcaccuuu

SEQ ID NO: 10096 - RNA, 18 nt, artificial
  Chemically synthesized
cgaagugaaaagaaaaug

SEQ ID NO: 10097 - RNA, 18 nt, artificial
  Chemically synthesized
ugggcgggugcaagcccg

SEQ ID NO: 10098 - RNA, 18 nt, artificial
  Chemically synthesized
cuagggcucccguuagac

SEQ ID NO: 10099 - RNA, 18 nt, artificial
  Chemically synthesized
gagucuccgcugaucaaa

SEQ ID NO: 10100 - RNA, 18 nt, artificial
  Chemically synthesized
cuucaaaugguuuuucca

SEQ ID NO: 10101 - RNA, 18 nt, artificial
  Chemically synthesized
ugcagcuaucuaacaaac

SEQ ID NO: 10102 - RNA, 18 nt, artificial
  Chemically synthesized
accgaacaaaacaaagcg

SEQ ID NO: 10103 - RNA, 18 nt, artificial
  Chemically synthesized
uugggagaucaccagauc

SEQ ID NO: 10104 - RNA, 18 nt, artificial
  Chemically synthesized
uucuuaauucgagcuguu

SEQ ID NO: 10105 - RNA, 18 nt, artificial
  Chemically synthesized
ccgaacaaaacaaagcgc

SEQ ID NO: 10106 - RNA, 18 nt, artificial
  Chemically synthesized
agggcggagaggagaggg

SEQ ID NO: 10107 - RNA, 18 nt, artificial
  Chemically synthesized
uucaucaagcagugaugu

SEQ ID NO: 10108 - RNA, 18 nt, artificial
  Chemically synthesized
ucugcacgaccgccucuc

SEQ ID NO: 10109 - RNA, 18 nt, artificial
  Chemically synthesized
gaucauuuaagagugccu

SEQ ID NO: 10110 - RNA, 18 nt, artificial
  Chemically synthesized
uuuagccaguguucaaau

SEQ ID NO: 10111 - RNA, 18 nt, artificial
  Chemically synthesized
aaaugcguguccucagag

SEQ ID NO: 10112 - RNA, 18 nt, artificial
  Chemically synthesized
cucaguaugcaaccuuuu

SEQ ID NO: 10113 - RNA, 18 nt, artificial
  Chemically synthesized
uccaaaccuugccggcgu

SEQ ID NO: 10114 - RNA, 18 nt, artificial
  Chemically synthesized
uauaucuuccuugcuuca

SEQ ID NO: 10115 - RNA, 18 nt, artificial
  Chemically synthesized
agccgcucuccaaaccuu

SEQ ID NO: 10116 - RNA, 18 nt, artificial
  Chemically synthesized
cccguccgagucugggcg

SEQ ID NO: 10117 - RNA, 18 nt, artificial
  Chemically synthesized
acucgggcaagcugcccu

SEQ ID NO: 10118 - RNA, 18 nt, artificial
  Chemically synthesized
gcaagcugcccuucucca

SEQ ID NO: 10119 - RNA, 18 nt, artificial
  Chemically synthesized
cacuucaaaugguuuuuc

SEQ ID NO: 10120 - RNA, 18 nt, artificial
  Chemically synthesized
aucauuuaagagugccua

SEQ ID NO: 10121 - RNA, 18 nt, artificial
  Chemically synthesized
ggcuucuugggcgucugc

SEQ ID NO: 10122 - RNA, 18 nt, artificial
  Chemically synthesized
gugaucaccauucugcug

SEQ ID NO: 10123 - RNA, 18 nt, artificial
  Chemically synthesized
cccuucuccaccucuugc

SEQ ID NO: 10124 - RNA, 18 nt, artificial
  Chemically synthesized
uggacuggcgagcgggag

SEQ ID NO: 10125 - RNA, 18 nt, artificial
  Chemically synthesized
gcuuccuuauuccugcgc

SEQ ID NO: 10126 - RNA, 18 nt, artificial
  Chemically synthesized
accgucugaaacauuuuc

SEQ ID NO: 10127 - RNA, 18 nt, artificial
  Chemically synthesized
gcuauggaaguuuucuuu

SEQ ID NO: 10128 - RNA, 18 nt, artificial
  Chemically synthesized
cugccuggcguccauccg

SEQ ID NO: 10129 - RNA, 18 nt, artificial
  Chemically synthesized
agcagauggucaauucuu

SEQ ID NO: 10130 - RNA, 18 nt, artificial
  Chemically synthesized
caaaauugcuucucuuca

SEQ ID NO: 10131 - RNA, 18 nt, artificial
  Chemically synthesized
accuugcaggcaccuuug

SEQ ID NO: 10132 - RNA, 18 nt, artificial
  Chemically synthesized
caagucccggguuaacuc

SEQ ID NO: 10133 - RNA, 18 nt, artificial
  Chemically synthesized
agcagugauguaucugau

SEQ ID NO: 10134 - RNA, 18 nt, artificial
  Chemically synthesized
ggccgaagagguuccugc

SEQ ID NO: 10135 - RNA, 18 nt, artificial
  Chemically synthesized
uuccuuauuccugcgcau

SEQ ID NO: 10136 - RNA, 18 nt, artificial
  Chemically synthesized
ucuccugcgccggcaccu

SEQ ID NO: 10137 - RNA, 18 nt, artificial
  Chemically synthesized
ucccgggucugcacgacc

SEQ ID NO: 10138 - RNA, 18 nt, artificial
  Chemically synthesized
gaacaaaacaaagcgccc

SEQ ID NO: 10139 - RNA, 18 nt, artificial
  Chemically synthesized
uccacgucaguuccucag

SEQ ID NO: 10140 - RNA, 18 nt, artificial
  Chemically synthesized
caggcaaugaaauacugu

SEQ ID NO: 10141 - RNA, 18 nt, artificial
  Chemically synthesized
agugaggauagguuucug

SEQ ID NO: 10142 - RNA, 18 nt, artificial
  Chemically synthesized
cacgucaguuccucagcc

SEQ ID NO: 10143 - RNA, 18 nt, artificial
  Chemically synthesized
cggguuaacucuucgugg

SEQ ID NO: 10144 - RNA, 18 nt, artificial
  Chemically synthesized
gacuggcgagcgggaggg

SEQ ID NO: 10145 - RNA, 18 nt, artificial
  Chemically synthesized
aaauaacacuuuccugug

SEQ ID NO: 10146 - RNA, 18 nt, artificial
  Chemically synthesized
cuguguuuacacagcccg

SEQ ID NO: 10147 - RNA, 18 nt, artificial
  Chemically synthesized
agcauuuacaaaugcaca

SEQ ID NO: 10148 - RNA, 18 nt, artificial
  Chemically synthesized
ucuucgugguccaccggg

SEQ ID NO: 10149 - RNA, 18 nt, artificial
  Chemically synthesized
cuccaggcuagggcuccc

SEQ ID NO: 10150 - RNA, 18 nt, artificial
  Chemically synthesized
ggccaggcuucuugggcg

SEQ ID NO: 10151 - RNA, 18 nt, artificial
  Chemically synthesized
aagggacauuacaucuuu

SEQ ID NO: 10152 - RNA, 18 nt, artificial
  Chemically synthesized
cucuuccaugucucugca

SEQ ID NO: 10153 - RNA, 18 nt, artificial
  Chemically synthesized
gcaauuaucuuuagccag

SEQ ID NO: 10154 - RNA, 18 nt, artificial
  Chemically synthesized
ucccgcugacauccuggc

SEQ ID NO: 10155 - RNA, 18 nt, artificial
  Chemically synthesized
ucaagcagugauguaucu

SEQ ID NO: 10156 - RNA, 18 nt, artificial
  Chemically synthesized
gaaaacaauucaaacccu

SEQ ID NO: 10157 - RNA, 18 nt, artificial
  Chemically synthesized
uauacacagguaguacaa

SEQ ID NO: 10158 - RNA, 18 nt, artificial
  Chemically synthesized
cuguggauaaauggacag

SEQ ID NO: 10159 - RNA, 18 nt, artificial
  Chemically synthesized
auacacaggcaaugaaau

SEQ ID NO: 10160 - RNA, 18 nt, artificial
  Chemically synthesized
gucccgcgaacccagccg

SEQ ID NO: 10161 - RNA, 18 nt, artificial
  Chemically synthesized
ccucucggaagcccagcg

SEQ ID NO: 10162 - RNA, 18 nt, artificial
  Chemically synthesized
cucccgcugacauccugg

SEQ ID NO: 10163 - RNA, 18 nt, artificial
  Chemically synthesized
ccggguuaacucuucgug

SEQ ID NO: 10164 - RNA, 18 nt, artificial
  Chemically synthesized
aucucccaaaugagaaua

SEQ ID NO: 10165 - RNA, 18 nt, artificial
  Chemically synthesized
aagagguuccugcaggcc

SEQ ID NO: 10166 - RNA, 18 nt, artificial
  Chemically synthesized
cgaagagguuccugcagg

SEQ ID NO: 10167 - RNA, 18 nt, artificial
  Chemically synthesized
uccauuucacuuauccua

SEQ ID NO: 10168 - RNA, 18 nt, artificial
  Chemically synthesized
gcagaucauuuaagagug

SEQ ID NO: 10169 - RNA, 18 nt, artificial
  Chemically synthesized
acagaaccggcauuuggg

SEQ ID NO: 10170 - RNA, 18 nt, artificial
  Chemically synthesized
caagugugcuuuucucua

SEQ ID NO: 10171 - RNA, 18 nt, artificial
  Chemically synthesized
cccuacgcagcccgaacc

SEQ ID NO: 10172 - RNA, 18 nt, artificial
  Chemically synthesized
gaacccagccgcucucca

SEQ ID NO: 10173 - RNA, 18 nt, artificial
  Chemically synthesized
uucugaggccaggcuucu

SEQ ID NO: 10174 - RNA, 18 nt, artificial
  Chemically synthesized
gccucucucgcacucuca

SEQ ID NO: 10175 - RNA, 18 nt, artificial
  Chemically synthesized
guggaagggaggcugacg

SEQ ID NO: 10176 - RNA, 18 nt, artificial
  Chemically synthesized
ggucgcuuccuuauuccu

SEQ ID NO: 10177 - RNA, 18 nt, artificial
  Chemically synthesized
ugaagucagcgauaugua

SEQ ID NO: 10178 - RNA, 18 nt, artificial
  Chemically synthesized
uuagacacucgcacguuu

SEQ ID NO: 10179 - RNA, 18 nt, artificial
  Chemically synthesized
ucuggcuguccgacggau

SEQ ID NO: 10180 - RNA, 18 nt, artificial
  Chemically synthesized
uggauaaauggacagagu

SEQ ID NO: 10181 - RNA, 18 nt, artificial
  Chemically synthesized
uagguuucuguugcuuuu

SEQ ID NO: 10182 - RNA, 18 nt, artificial
  Chemically synthesized
cccuuuuuuuaguggccc

SEQ ID NO: 10183 - RNA, 18 nt, artificial
  Chemically synthesized
acaaaacaugccacuuug

SEQ ID NO: 10184 - RNA, 18 nt, artificial
  Chemically synthesized
cagugaggauagguuucu

SEQ ID NO: 10185 - RNA, 18 nt, artificial
  Chemically synthesized
gggcaagcugcccuucuc

SEQ ID NO: 10186 - RNA, 18 nt, artificial
  Chemically synthesized
cccgcuccacgucaguuc

SEQ ID NO: 10187 - RNA, 18 nt, artificial
  Chemically synthesized
gcuccaggcuagggcucc

SEQ ID NO: 10188 - RNA, 18 nt, artificial
  Chemically synthesized
acgucuucugaggccagg

SEQ ID NO: 10189 - RNA, 18 nt, artificial
  Chemically synthesized
gcaaauaaggaaaaaccu

SEQ ID NO: 10190 - RNA, 18 nt, artificial
  Chemically synthesized
cauucugcugaguaauua

SEQ ID NO: 10191 - RNA, 18 nt, artificial
  Chemically synthesized
acagcauuuacaaaugca

SEQ ID NO: 10192 - RNA, 18 nt, artificial
  Chemically synthesized
agcgacugcccucggagc

SEQ ID NO: 10193 - RNA, 18 nt, artificial
  Chemically synthesized
ggucccgcgaacccagcc

SEQ ID NO: 10194 - RNA, 18 nt, artificial
  Chemically synthesized
auauggcgguggaaggga

SEQ ID NO: 10195 - RNA, 18 nt, artificial
  Chemically synthesized
gugcaagcccgcgggucc

SEQ ID NO: 10196 - RNA, 18 nt, artificial
  Chemically synthesized
gaaaaccuauucuaccca

SEQ ID NO: 10197 - RNA, 18 nt, artificial
  Chemically synthesized
aagucccggguuaacucu

SEQ ID NO: 10198 - RNA, 18 nt, artificial
  Chemically synthesized
guagaacucgggcaagcu

SEQ ID NO: 10199 - RNA, 18 nt, artificial
  Chemically synthesized
ugaggauagguuucuguu

SEQ ID NO: 10200 - RNA, 18 nt, artificial
  Chemically synthesized
gauguccauuccaugaag

SEQ ID NO: 10201 - RNA, 18 nt, artificial
  Chemically synthesized
gaacucgggcaagcugcc

SEQ ID NO: 10202 - RNA, 18 nt, artificial
  Chemically synthesized
gcgaacccagccgcucuc

SEQ ID NO: 10203 - RNA, 18 nt, artificial
  Chemically synthesized
accagaucucccaaauga

SEQ ID NO: 10204 - RNA, 18 nt, artificial
  Chemically synthesized
ggccgccgagucuccgcu

SEQ ID NO: 10205 - RNA, 18 nt, artificial
  Chemically synthesized
cauuccaugaagucagcg

SEQ ID NO: 10206 - RNA, 18 nt, artificial
  Chemically synthesized
ucaccagaucucccaaau

SEQ ID NO: 10207 - RNA, 18 nt, artificial
  Chemically synthesized
cuucuccaagucccgggu

SEQ ID NO: 10208 - RNA, 18 nt, artificial
  Chemically synthesized
gagccgugagcaagcggg

SEQ ID NO: 10209 - RNA, 18 nt, artificial
  Chemically synthesized
ccacccugcccucccuuc

SEQ ID NO: 10210 - RNA, 18 nt, artificial
  Chemically synthesized
aaccuugccggcgucgga

SEQ ID NO: 10211 - RNA, 18 nt, artificial
  Chemically synthesized
gccgagucuccgcugauc

SEQ ID NO: 10212 - RNA, 18 nt, artificial
  Chemically synthesized
ugcacaaaacaugccacu

SEQ ID NO: 10213 - RNA, 18 nt, artificial
  Chemically synthesized
uguuuacacagcccgaag

SEQ ID NO: 10214 - RNA, 18 nt, artificial
  Chemically synthesized
cacaugcagcuaucuaac

SEQ ID NO: 10215 - RNA, 18 nt, artificial
  Chemically synthesized
acucguacuugcccucua

SEQ ID NO: 10216 - RNA, 18 nt, artificial
  Chemically synthesized
cccaaacuaccuggagug

SEQ ID NO: 10217 - RNA, 18 nt, artificial
  Chemically synthesized
agucgcagagccgugagc

SEQ ID NO: 10218 - RNA, 18 nt, artificial
  Chemically synthesized
cggcaccuugcaggcacc

SEQ ID NO: 10219 - RNA, 18 nt, artificial
  Chemically synthesized
uuaacucuucguggucca

SEQ ID NO: 10220 - RNA, 18 nt, artificial
  Chemically synthesized
cacuuuggcuuguauauu

SEQ ID NO: 10221 - RNA, 18 nt, artificial
  Chemically synthesized
acacagcauuuacaaaug

SEQ ID NO: 10222 - RNA, 18 nt, artificial
  Chemically synthesized
ucccaagcaccucggauu

SEQ ID NO: 10223 - RNA, 18 nt, artificial
  Chemically synthesized
ugcuuuucucuacaugaa

SEQ ID NO: 10224 - RNA, 18 nt, artificial
  Chemically synthesized
gucggagucgcagagccg

SEQ ID NO: 10225 - RNA, 18 nt, artificial
  Chemically synthesized
uggcgguggaagggaggc

SEQ ID NO: 10226 - RNA, 18 nt, artificial
  Chemically synthesized
aacaaaaccgaacaaaac

SEQ ID NO: 10227 - RNA, 18 nt, artificial
  Chemically synthesized
gcacucucaaaaaaacaa

SEQ ID NO: 10228 - RNA, 18 nt, artificial
  Chemically synthesized
ccuacgcagcccgaaccc

SEQ ID NO: 10229 - RNA, 18 nt, artificial
  Chemically synthesized
cauccgcuccaggcuagg

SEQ ID NO: 10230 - RNA, 18 nt, artificial
  Chemically synthesized
cuguuuacguuugacguc

SEQ ID NO: 10231 - RNA, 18 nt, artificial
  Chemically synthesized
uccaccucuugccacucg

SEQ ID NO: 10232 - RNA, 18 nt, artificial
  Chemically synthesized
guugcaggucgcuuccuu

SEQ ID NO: 10233 - RNA, 18 nt, artificial
  Chemically synthesized
gaagagaagcaauuuugg

SEQ ID NO: 10234 - RNA, 18 nt, artificial
  Chemically synthesized
gagugucuaacgggagcc

SEQ ID NO: 10235 - RNA, 18 nt, artificial
  Chemically synthesized
aagccuggccucagaaga

SEQ ID NO: 10236 - RNA, 18 nt, artificial
  Chemically synthesized
aaaaauuugaacacuggc

SEQ ID NO: 10237 - RNA, 18 nt, artificial
  Chemically synthesized
uacaagccaaaguggcau

SEQ ID NO: 10238 - RNA, 18 nt, artificial
  Chemically synthesized
uguagcacauaaacuuug

SEQ ID NO: 10239 - RNA, 18 nt, artificial
  Chemically synthesized
gccugcaggaaccucuuc

SEQ ID NO: 10240 - RNA, 18 nt, artificial
  Chemically synthesized
gucggacagccagacggg

SEQ ID NO: 10241 - RNA, 18 nt, artificial
  Chemically synthesized
aaauguuucagacgguuc

SEQ ID NO: 10242 - RNA, 18 nt, artificial
  Chemically synthesized
gagguggagaagggcagc

SEQ ID NO: 10243 - RNA, 18 nt, artificial
  Chemically synthesized
acgucaaacguaaacagc

SEQ ID NO: 10244 - RNA, 18 nt, artificial
  Chemically synthesized
ugcaauuagguuuuuccu

SEQ ID NO: 10245 - RNA, 18 nt, artificial
  Chemically synthesized
gcggcgccuuuaauuggg

SEQ ID NO: 10246 - RNA, 18 nt, artificial
  Chemically synthesized
uacuaccuguguauauag

SEQ ID NO: 10247 - RNA, 18 nt, artificial
  Chemically synthesized
gccugcaaggugccggcg

SEQ ID NO: 10248 - RNA, 18 nt, artificial
  Chemically synthesized
uauuucauugccugugua

SEQ ID NO: 10249 - RNA, 18 nt, artificial
  Chemically synthesized
ugugaaaaagaugccaau

SEQ ID NO: 10250 - RNA, 18 nt, artificial
  Chemically synthesized
cgagugucuaacgggagc

SEQ ID NO: 10251 - RNA, 18 nt, artificial
  Chemically synthesized
uagccuggagcggaugga

SEQ ID NO: 10252 - RNA, 18 nt, artificial
  Chemically synthesized
caagccaaaguggcaugu

SEQ ID NO: 10253 - RNA, 18 nt, artificial
  Chemically synthesized
aaagacugauccgucgga

SEQ ID NO: 10254 - RNA, 18 nt, artificial
  Chemically synthesized
ccuggagcggauggacgc

SEQ ID NO: 10255 - RNA, 18 nt, artificial
  Chemically synthesized
cugcaaggugccggcgca

SEQ ID NO: 10256 - RNA, 18 nt, artificial
  Chemically synthesized
aucugccucuaaaagcgu

SEQ ID NO: 10257 - RNA, 18 nt, artificial
  Chemically synthesized
gauaagugaaauggauac

SEQ ID NO: 10258 - RNA, 18 nt, artificial
  Chemically synthesized
agcacacuuguaggauaa

SEQ ID NO: 10259 - RNA, 18 nt, artificial
  Chemically synthesized
cgguucuguggagcagac

SEQ ID NO: 10260 - RNA, 18 nt, artificial
  Chemically synthesized
cucuuaaaugaucugccu

SEQ ID NO: 10261 - RNA, 18 nt, artificial
  Chemically synthesized
auucucauuugggagauc

SEQ ID NO: 10262 - RNA, 18 nt, artificial
  Chemically synthesized
aaugaucugccucuaaaa

SEQ ID NO: 10263 - RNA, 18 nt, artificial
  Chemically synthesized
cuugcccgaguucuacua

SEQ ID NO: 10264 - RNA, 18 nt, artificial
  Chemically synthesized
aaacaguauuucauugcc

SEQ ID NO: 10265 - RNA, 18 nt, artificial
  Chemically synthesized
caaggugccggcgcagga

SEQ ID NO: 10266 - RNA, 18 nt, artificial
  Chemically synthesized
auuugaaguguaccugug

SEQ ID NO: 10267 - RNA, 18 nt, artificial
  Chemically synthesized
uuauucucauuugggaga

SEQ ID NO: 10268 - RNA, 18 nt, artificial
  Chemically synthesized
ugcuucauuguacuaccu

SEQ ID NO: 10269 - RNA, 18 nt, artificial
  Chemically synthesized
gggcagcuugcccgaguu

SEQ ID NO: 10270 - RNA, 18 nt, artificial
  Chemically synthesized
aaaguuggaauuuaccag

SEQ ID NO: 10271 - RNA, 18 nt, artificial
  Chemically synthesized
aaauacauaucgcugacu

SEQ ID NO: 10272 - RNA, 18 nt, artificial
  Chemically synthesized
acauccuguauaagcacu

SEQ ID NO: 10273 - RNA, 18 nt, artificial
  Chemically synthesized
acugauccgucggacagc

SEQ ID NO: 10274 - RNA, 18 nt, artificial
  Chemically synthesized
uugaaguguaccugugua

SEQ ID NO: 10275 - RNA, 18 nt, artificial
  Chemically synthesized
ucucauuugggagaucug

SEQ ID NO: 10276 - RNA, 18 nt, artificial
  Chemically synthesized
uugcuucauuguacuacc

SEQ ID NO: 10277 - RNA, 18 nt, artificial
  Chemically synthesized
auggacauccuguauaag

SEQ ID NO: 10278 - RNA, 18 nt, artificial
  Chemically synthesized
auauacaagccaaagugg

SEQ ID NO: 10279 - RNA, 18 nt, artificial
  Chemically synthesized
uccgucggacagccagac

SEQ ID NO: 10280 - RNA, 18 nt, artificial
  Chemically synthesized
ggaaccucuucggcccgg

SEQ ID NO: 10281 - RNA, 18 nt, artificial
  Chemically synthesized
auguagagaaaagcacac

SEQ ID NO: 10282 - RNA, 18 nt, artificial
  Chemically synthesized
uuggguagaauagguuuu

SEQ ID NO: 10283 - RNA, 18 nt, artificial
  Chemically synthesized
uuaagaauugaccaucug

SEQ ID NO: 10284 - RNA, 18 nt, artificial
  Chemically synthesized
uaccuguguacauaacuc

SEQ ID NO: 10285 - RNA, 18 nt, artificial
  Chemically synthesized
auacugagccaaguauaa

SEQ ID NO: 10286 - RNA, 18 nt, artificial
  Chemically synthesized
ucauggaauggacauccu

SEQ ID NO: 10287 - RNA, 18 nt, artificial
  Chemically synthesized
aucacuccagguaguuug

SEQ ID NO: 10288 - RNA, 18 nt, artificial
  Chemically synthesized
ccaaaugccgguucugug

SEQ ID NO: 10289 - RNA, 18 nt, artificial
  Chemically synthesized
uguaccuguguacauaac

SEQ ID NO: 10290 - RNA, 18 nt, artificial
  Chemically synthesized
uaagaauugaccaucugc

SEQ ID NO: 10291 - RNA, 18 nt, artificial
  Chemically synthesized
gaucugccucuaaaagcg

SEQ ID NO: 10292 - RNA, 18 nt, artificial
  Chemically synthesized
auacaagccaaaguggca

SEQ ID NO: 10293 - RNA, 18 nt, artificial
  Chemically synthesized
uuucauugccuguguaug

SEQ ID NO: 10294 - RNA, 18 nt, artificial
  Chemically synthesized
gcccggcggcgccuuuaa

SEQ ID NO: 10295 - RNA, 18 nt, artificial
  Chemically synthesized
ggugccggcgcaggagag

SEQ ID NO: 10296 - RNA, 18 nt, artificial
  Chemically synthesized
uugaccaucugcuuuuau

SEQ ID NO: 10297 - RNA, 18 nt, artificial
  Chemically synthesized
aucuggugaucucccaag

SEQ ID NO: 10298 - RNA, 18 nt, artificial
  Chemically synthesized
ugaggacacgcauuuggu

SEQ ID NO: 10299 - RNA, 18 nt, artificial
  Chemically synthesized
uuugggagaucuggugau

SEQ ID NO: 10300 - RNA, 18 nt, artificial
  Chemically synthesized
ccaaaguggcauguuuug

SEQ ID NO: 10301 - RNA, 18 nt, artificial
  Chemically synthesized
acuggcuaaagauaauug

SEQ ID NO: 10302 - RNA, 18 nt, artificial
  Chemically synthesized
acacuggcuaaagauaau

SEQ ID NO: 10303 - RNA, 18 nt, artificial
  Chemically synthesized
cugccucuaaaagcguug

SEQ ID NO: 10304 - RNA, 18 nt, artificial
  Chemically synthesized
gaugucagcgggagccgc

SEQ ID NO: 10305 - RNA, 18 nt, artificial
  Chemically synthesized
cugaggacacgcauuugg

SEQ ID NO: 10306 - RNA, 18 nt, artificial
  Chemically synthesized
accugcaaccgacgauuc

SEQ ID NO: 10307 - RNA, 18 nt, artificial
  Chemically synthesized
aaaauguuucagacgguu

SEQ ID NO: 10308 - RNA, 18 nt, artificial
  Chemically synthesized
cuaaaauuuuaggcacuc

SEQ ID NO: 10309 - RNA, 18 nt, artificial
  Chemically synthesized
agagccaggaugucagcg

SEQ ID NO: 10310 - RNA, 18 nt, artificial
  Chemically synthesized
aagcgaccugcaaccgac

SEQ ID NO: 10311 - RNA, 18 nt, artificial
  Chemically synthesized
gacgcccaagaagccugg

SEQ ID NO: 10312 - RNA, 18 nt, artificial
  Chemically synthesized
gucagccucccuuccacc

SEQ ID NO: 10313 - RNA, 18 nt, artificial
  Chemically synthesized
gcacucuuaaaugaucug

SEQ ID NO: 10314 - RNA, 18 nt, artificial
  Chemically synthesized
augaucugccucuaaaag

SEQ ID NO: 10315 - RNA, 18 nt, artificial
  Chemically synthesized
ucuucgucagccucccuu

SEQ ID NO: 10316 - RNA, 18 nt, artificial
  Chemically synthesized
auugggccacuaaaaaaa

SEQ ID NO: 10317 - RNA, 18 nt, artificial
  Chemically synthesized
acucuuaaaugaucugcc

SEQ ID NO: 10318 - RNA, 18 nt, artificial
  Chemically synthesized
aauggacauccuguauaa

SEQ ID NO: 10319 - RNA, 18 nt, artificial
  Chemically synthesized
uugaacacuggcuaaaga

SEQ ID NO: 10320 - RNA, 18 nt, artificial
  Chemically synthesized
uugaugaagcaaggaaga

SEQ ID NO: 10321 - RNA, 18 nt, artificial
  Chemically synthesized
gacauggaagaggcgagc

SEQ ID NO: 10322 - RNA, 18 nt, artificial
  Chemically synthesized
ugccgguucuguggagca

SEQ ID NO: 10323 - RNA, 18 nt, artificial
  Chemically synthesized
ugcaaccgacgauucuuc

SEQ ID NO: 10324 - RNA, 18 nt, artificial
  Chemically synthesized
uagcauuaugcaauuagg

SEQ ID NO: 10325 - RNA, 18 nt, artificial
  Chemically synthesized
agugucuaacgggagccc

SEQ ID NO: 10326 - RNA, 18 nt, artificial
  Chemically synthesized
acgcccaagaagccuggc

SEQ ID NO: 10327 - RNA, 18 nt, artificial
  Chemically synthesized
uaaaagcguuggauguag

SEQ ID NO: 10328 - RNA, 18 nt, artificial
  Chemically synthesized
ucucucuuaaaguuggaa

SEQ ID NO: 10329 - RNA, 18 nt, artificial
  Chemically synthesized
ucgucagccucccuucca

SEQ ID NO: 10330 - RNA, 18 nt, artificial
  Chemically synthesized
ucuuaaaugaucugccuc

SEQ ID NO: 10331 - RNA, 18 nt, artificial
  Chemically synthesized
uguaggauaagugaaaug

SEQ ID NO: 10332 - RNA, 18 nt, artificial
  Chemically synthesized
cugcaggaaccucuucgg

SEQ ID NO: 10333 - RNA, 18 nt, artificial
  Chemically synthesized
aaagcguuggauguagca

SEQ ID NO: 10334 - RNA, 18 nt, artificial
  Chemically synthesized
aacccgggacuuggagaa

SEQ ID NO: 10335 - RNA, 18 nt, artificial
  Chemically synthesized
aagagaagcaauuuuggg

SEQ ID NO: 10336 - RNA, 18 nt, artificial
  Chemically synthesized
augcaauuagguuuuucc

SEQ ID NO: 10337 - RNA, 18 nt, artificial
  Chemically synthesized
uucauggaauggacaucc

SEQ ID NO: 10338 - RNA, 18 nt, artificial
  Chemically synthesized
cuucgucagccucccuuc

SEQ ID NO: 10339 - RNA, 18 nt, artificial
  Chemically synthesized
gugccggcgcaggagagc

SEQ ID NO: 10340 - RNA, 18 nt, artificial
  Chemically synthesized
uuaggcacucuuaaauga

SEQ ID NO: 10341 - RNA, 18 nt, artificial
  Chemically synthesized
aauguuucagacgguucc

SEQ ID NO: 10342 - RNA, 18 nt, artificial
  Chemically synthesized
guagcacauaaacuuugg

SEQ ID NO: 10343 - RNA, 18 nt, artificial
  Chemically synthesized
uauggcuaugcuuaaaag

SEQ ID NO: 10344 - RNA, 18 nt, artificial
  Chemically synthesized
aaaguggcauguuuugug

SEQ ID NO: 10345 - RNA, 18 nt, artificial
  Chemically synthesized
gagagccaggaugucagc

SEQ ID NO: 10346 - RNA, 18 nt, artificial
  Chemically synthesized
aggaagcgaccugcaacc

SEQ ID NO: 10347 - RNA, 18 nt, artificial
  Chemically synthesized
uucauuguacuaccugug

SEQ ID NO: 10348 - RNA, 18 nt, artificial
  Chemically synthesized
auugaccaucugcuuuua

SEQ ID NO: 10349 - RNA, 18 nt, artificial
  Chemically synthesized
ugcaaggugccggcgcag

SEQ ID NO: 10350 - RNA, 18 nt, artificial
  Chemically synthesized
caggaugucagcgggagc

SEQ ID NO: 10351 - RNA, 18 nt, artificial
  Chemically synthesized
uugugcauuuguaaaugc

SEQ ID NO: 10352 - RNA, 18 nt, artificial
  Chemically synthesized
ugcaggaaccucuucggc

SEQ ID NO: 10353 - RNA, 18 nt, artificial
  Chemically synthesized
aagggagggcaggguggg

SEQ ID NO: 10354 - RNA, 18 nt, artificial
  Chemically synthesized
ucugccucuaaaagcguu

SEQ ID NO: 10355 - RNA, 18 nt, artificial
  Chemically synthesized
aaugugugaaaaagaugc

SEQ ID NO: 10356 - RNA, 18 nt, artificial
  Chemically synthesized
aggaugucagcgggagcc

SEQ ID NO: 10357 - RNA, 18 nt, artificial
  Chemically synthesized
aaaugccgguucugugga

SEQ ID NO: 10358 - RNA, 18 nt, artificial
  Chemically synthesized
uucuguggagcagacgcc

SEQ ID NO: 10359 - RNA, 18 nt, artificial
  Chemically synthesized
uuaaagauguaauguccc

SEQ ID NO: 10360 - RNA, 18 nt, artificial
  Chemically synthesized
gaaccucuucggcccggu

SEQ ID NO: 10361 - RNA, 18 nt, artificial
  Chemically synthesized
uugggagaucuggugauc

SEQ ID NO: 10362 - RNA, 18 nt, artificial
  Chemically synthesized
ucugaggacacgcauuug

SEQ ID NO: 10363 - RNA, 18 nt, artificial
  Chemically synthesized
aaaauacauaucgcugac

SEQ ID NO: 10364 - RNA, 18 nt, artificial
  Chemically synthesized
uaaagauguaaugucccu

SEQ ID NO: 10365 - RNA, 18 nt, artificial
  Chemically synthesized
uccaccgccauauugggc

SEQ ID NO: 10366 - RNA, 18 nt, artificial
  Chemically synthesized
ugggccacuaaaaaaagg

SEQ ID NO: 10367 - RNA, 18 nt, artificial
  Chemically synthesized
caggaaccucuucggccc

SEQ ID NO: 10368 - RNA, 18 nt, artificial
  Chemically synthesized
acaagccaaaguggcaug

SEQ ID NO: 10369 - RNA, 18 nt, artificial
  Chemically synthesized
auguuucagacgguuccc

SEQ ID NO: 10370 - RNA, 18 nt, artificial
  Chemically synthesized
ugucagcgggagccgccc

SEQ ID NO: 10371 - RNA, 18 nt, artificial
  Chemically synthesized
ucagccucccuuccaccg

SEQ ID NO: 10372 - RNA, 18 nt, artificial
  Chemically synthesized
augucagcgggagccgcc

SEQ ID NO: 10373 - RNA, 18 nt, artificial
  Chemically synthesized
aaaagcacacuuguagga

SEQ ID NO: 10374 - RNA, 18 nt, artificial
  Chemically synthesized
ugccugcaaggugccggc

SEQ ID NO: 10375 - RNA, 18 nt, artificial
  Chemically synthesized
aaugccgguucuguggag

SEQ ID NO: 10376 - RNA, 18 nt, artificial
  Chemically synthesized
cuucuucgucagccuccc

SEQ ID NO: 10377 - RNA, 18 nt, artificial
  Chemically synthesized
uugggccacuaaaaaaag

SEQ ID NO: 10378 - RNA, 18 nt, artificial
  Chemically synthesized
uuccaccgccauauuggg

SEQ ID NO: 10379 - RNA, 18 nt, artificial
  Chemically synthesized
aggaaccucuucggcccg

SEQ ID NO: 10380 - RNA, 18 nt, artificial
  Chemically synthesized
uagcacauaaacuuuggg

SEQ ID NO: 10381 - RNA, 18 nt, artificial
  Chemically synthesized
ucacuccagguaguuugg

SEQ ID NO: 10382 - RNA, 18 nt, artificial
  Chemically synthesized
uucuucgucagccucccu

SEQ ID NO: 10383 - RNA, 18 nt, artificial
  Chemically synthesized
ccaaaauugcuucucuuc

SEQ ID NO: 10384 - RNA, 18 nt, artificial
  Chemically synthesized
ggcucccguuagacacuc

SEQ ID NO: 10385 - RNA, 18 nt, artificial
  Chemically synthesized
ucuucugaggccaggcuu

SEQ ID NO: 10386 - RNA, 18 nt, artificial
  Chemically synthesized
gccaguguucaaauuuuu

SEQ ID NO: 10387 - RNA, 18 nt, artificial
  Chemically synthesized
augccacuuuggcuugua

SEQ ID NO: 10388 - RNA, 18 nt, artificial
  Chemically synthesized
caaaguuuaugugcuaca

SEQ ID NO: 10389 - RNA, 18 nt, artificial
  Chemically synthesized
gaagagguuccugcaggc

SEQ ID NO: 10390 - RNA, 18 nt, artificial
  Chemically synthesized
cccgucuggcuguccgac

SEQ ID NO: 10391 - RNA, 18 nt, artificial
  Chemically synthesized
gaaccgucugaaacauuu

SEQ ID NO: 10392 - RNA, 18 nt, artificial
  Chemically synthesized
gcugcccuucuccaccuc

SEQ ID NO: 10393 - RNA, 18 nt, artificial
  Chemically synthesized
gcuguuuacguuugacgu

SEQ ID NO: 10394 - RNA, 18 nt, artificial
  Chemically synthesized
aggaaaaaccuaauugca

SEQ ID NO: 10395 - RNA, 18 nt, artificial
  Chemically synthesized
cccaauuaaaggcgccgc

SEQ ID NO: 10396 - RNA, 18 nt, artificial
  Chemically synthesized
cuauauacacagguagua

SEQ ID NO: 10397 - RNA, 18 nt, artificial
  Chemically synthesized
cgccggcaccuugcaggc

SEQ ID NO: 10398 - RNA, 18 nt, artificial
  Chemically synthesized
uacacaggcaaugaaaua

SEQ ID NO: 10399 - RNA, 18 nt, artificial
  Chemically synthesized
auuggcaucuuuuucaca

SEQ ID NO: 10400 - RNA, 18 nt, artificial
  Chemically synthesized
gcucccguuagacacucg

SEQ ID NO: 10401 - RNA, 18 nt, artificial
  Chemically synthesized
uccauccgcuccaggcua

SEQ ID NO: 10402 - RNA, 18 nt, artificial
  Chemically synthesized
acaugccacuuuggcuug

SEQ ID NO: 10403 - RNA, 18 nt, artificial
  Chemically synthesized
uccgacggaucagucuuu

SEQ ID NO: 10404 - RNA, 18 nt, artificial
  Chemically synthesized
gcguccauccgcuccagg

SEQ ID NO: 10405 - RNA, 18 nt, artificial
  Chemically synthesized
ugcgccggcaccuugcag

SEQ ID NO: 10406 - RNA, 18 nt, artificial
  Chemically synthesized
acgcuuuuagaggcagau

SEQ ID NO: 10407 - RNA, 18 nt, artificial
  Chemically synthesized
guauccauuucacuuauc

SEQ ID NO: 10408 - RNA, 18 nt, artificial
  Chemically synthesized
uuauccuacaagugugcu

SEQ ID NO: 10409 - RNA, 18 nt, artificial
  Chemically synthesized
gucugcuccacagaaccg

SEQ ID NO: 10410 - RNA, 18 nt, artificial
  Chemically synthesized
aggcagaucauuuaagag

SEQ ID NO: 10411 - RNA, 18 nt, artificial
  Chemically synthesized
gaucucccaaaugagaau

SEQ ID NO: 10412 - RNA, 18 nt, artificial
  Chemically synthesized
uuuuagaggcagaucauu

SEQ ID NO: 10413 - RNA, 18 nt, artificial
  Chemically synthesized
uaguagaacucgggcaag

SEQ ID NO: 10414 - RNA, 18 nt, artificial
  Chemically synthesized
ggcaaugaaauacuguuu

SEQ ID NO: 10415 - RNA, 18 nt, artificial
  Chemically synthesized
uccugcgccggcaccuug

SEQ ID NO: 10416 - RNA, 18 nt, artificial
  Chemically synthesized
cacagguacacuucaaau

SEQ ID NO: 10417 - RNA, 18 nt, artificial
  Chemically synthesized
ucucccaaaugagaauaa

SEQ ID NO: 10418 - RNA, 18 nt, artificial
  Chemically synthesized
agguaguacaaugaagca

SEQ ID NO: 10419 - RNA, 18 nt, artificial
  Chemically synthesized
aacucgggcaagcugccc

SEQ ID NO: 10420 - RNA, 18 nt, artificial
  Chemically synthesized
cugguaaauuccaacuuu

SEQ ID NO: 10421 - RNA, 18 nt, artificial
  Chemically synthesized
agucagcgauauguauuu

SEQ ID NO: 10422 - RNA, 18 nt, artificial
  Chemically synthesized
agugcuuauacaggaugu

SEQ ID NO: 10423 - RNA, 18 nt, artificial
  Chemically synthesized
gcuguccgacggaucagu

SEQ ID NO: 10424 - RNA, 18 nt, artificial
  Chemically synthesized
uacacagguacacuucaa

SEQ ID NO: 10425 - RNA, 18 nt, artificial
  Chemically synthesized
cagaucucccaaaugaga

SEQ ID NO: 10426 - RNA, 18 nt, artificial
  Chemically synthesized
gguaguacaaugaagcaa

SEQ ID NO: 10427 - RNA, 18 nt, artificial
  Chemically synthesized
cuuauacaggauguccau

SEQ ID NO: 10428 - RNA, 18 nt, artificial
  Chemically synthesized
ccacuuuggcuuguauau

SEQ ID NO: 10429 - RNA, 18 nt, artificial
  Chemically synthesized
gucuggcuguccgacgga

SEQ ID NO: 10430 - RNA, 18 nt, artificial
  Chemically synthesized
ccgggccgaagagguucc

SEQ ID NO: 10431 - RNA, 18 nt, artificial
  Chemically synthesized
gugugcuuuucucuacau

SEQ ID NO: 10432 - RNA, 18 nt, artificial
  Chemically synthesized
aaaaccuauucuacccaa

SEQ ID NO: 10433 - RNA, 18 nt, artificial
  Chemically synthesized
cagauggucaauucuuaa

SEQ ID NO: 10434 - RNA, 18 nt, artificial
  Chemically synthesized
gaguuauguacacaggua

SEQ ID NO: 10435 - RNA, 18 nt, artificial
  Chemically synthesized
uuauacuuggcucaguau

SEQ ID NO: 10436 - RNA, 18 nt, artificial
  Chemically synthesized
aggauguccauuccauga

SEQ ID NO: 10437 - RNA, 18 nt, artificial
  Chemically synthesized
caaacuaccuggagugau

SEQ ID NO: 10438 - RNA, 18 nt, artificial
  Chemically synthesized
cacagaaccggcauuugg

SEQ ID NO: 10439 - RNA, 18 nt, artificial
  Chemically synthesized
guuauguacacagguaca

SEQ ID NO: 10440 - RNA, 18 nt, artificial
  Chemically synthesized
gcagauggucaauucuua

SEQ ID NO: 10441 - RNA, 18 nt, artificial
  Chemically synthesized
cgcuuuuagaggcagauc

SEQ ID NO: 10442 - RNA, 18 nt, artificial
  Chemically synthesized
ugccacuuuggcuuguau

SEQ ID NO: 10443 - RNA, 18 nt, artificial
  Chemically synthesized
cauacacaggcaaugaaa

SEQ ID NO: 10444 - RNA, 18 nt, artificial
  Chemically synthesized
uuaaaggcgccgccgggc

SEQ ID NO: 10445 - RNA, 18 nt, artificial
  Chemically synthesized
cucuccugcgccggcacc

SEQ ID NO: 10446 - RNA, 18 nt, artificial
  Chemically synthesized
auaaaagcagauggucaa

SEQ ID NO: 10447 - RNA, 18 nt, artificial
  Chemically synthesized
cuugggagaucaccagau

SEQ ID NO: 10448 - RNA, 18 nt, artificial
  Chemically synthesized
accaaaugcguguccuca

SEQ ID NO: 10449 - RNA, 18 nt, artificial
  Chemically synthesized
aucaccagaucucccaaa

SEQ ID NO: 10450 - RNA, 18 nt, artificial
  Chemically synthesized
caaaacaugccacuuugg

SEQ ID NO: 10451 - RNA, 18 nt, artificial
  Chemically synthesized
caauuaucuuuagccagu

SEQ ID NO: 10452 - RNA, 18 nt, artificial
  Chemically synthesized
auuaucuuuagccagugu

SEQ ID NO: 10453 - RNA, 18 nt, artificial
  Chemically synthesized
caacgcuuuuagaggcag

SEQ ID NO: 10454 - RNA, 18 nt, artificial
  Chemically synthesized
gcggcucccgcugacauc

SEQ ID NO: 10455 - RNA, 18 nt, artificial
  Chemically synthesized
ccaaaugcguguccucag

SEQ ID NO: 10456 - RNA, 18 nt, artificial
  Chemically synthesized
gaaucgucgguugcaggu

SEQ ID NO: 10457 - RNA, 18 nt, artificial
  Chemically synthesized
aaccgucugaaacauuuu

SEQ ID NO: 10458 - RNA, 18 nt, artificial
  Chemically synthesized
gagugccuaaaauuuuag

SEQ ID NO: 10459 - RNA, 18 nt, artificial
  Chemically synthesized
cgcugacauccuggcucu

SEQ ID NO: 10460 - RNA, 18 nt, artificial
  Chemically synthesized
gucgguugcaggucgcuu

SEQ ID NO: 10461 - RNA, 18 nt, artificial
  Chemically synthesized
ccaggcuucuugggcguc

SEQ ID NO: 10462 - RNA, 18 nt, artificial
  Chemically synthesized
gguggaagggaggcugac

SEQ ID NO: 10463 - RNA, 18 nt, artificial
  Chemically synthesized
cagaucauuuaagagugc

SEQ ID NO: 10464 - RNA, 18 nt, artificial
  Chemically synthesized
cuuuuagaggcagaucau

SEQ ID NO: 10465 - RNA, 18 nt, artificial
  Chemically synthesized
aagggaggcugacgaaga

SEQ ID NO: 10466 - RNA, 18 nt, artificial
  Chemically synthesized
uuuuuuuaguggcccaau

SEQ ID NO: 10467 - RNA, 18 nt, artificial
  Chemically synthesized
ggcagaucauuuaagagu

SEQ ID NO: 10468 - RNA, 18 nt, artificial
  Chemically synthesized
uuauacaggauguccauu

SEQ ID NO: 10469 - RNA, 18 nt, artificial
  Chemically synthesized
ucuuuagccaguguucaa

SEQ ID NO: 10470 - RNA, 18 nt, artificial
  Chemically synthesized
ucuuccuugcuucaucaa

SEQ ID NO: 10471 - RNA, 18 nt, artificial
  Chemically synthesized
gcucgccucuuccauguc

SEQ ID NO: 10472 - RNA, 18 nt, artificial
  Chemically synthesized
ugcuccacagaaccggca

SEQ ID NO: 10473 - RNA, 18 nt, artificial
  Chemically synthesized
gaagaaucgucgguugca

SEQ ID NO: 10474 - RNA, 18 nt, artificial
  Chemically synthesized
ccuaauugcauaaugcua

SEQ ID NO: 10475 - RNA, 18 nt, artificial
  Chemically synthesized
gggcucccguuagacacu

SEQ ID NO: 10476 - RNA, 18 nt, artificial
  Chemically synthesized
gccaggcuucuugggcgu

SEQ ID NO: 10477 - RNA, 18 nt, artificial
  Chemically synthesized
cuacauccaacgcuuuua

SEQ ID NO: 10478 - RNA, 18 nt, artificial
  Chemically synthesized
uuccaacuuuaagagaga

SEQ ID NO: 10479 - RNA, 18 nt, artificial
  Chemically synthesized
uggaagggaggcugacga

SEQ ID NO: 10480 - RNA, 18 nt, artificial
  Chemically synthesized
gaggcagaucauuuaaga

SEQ ID NO: 10481 - RNA, 18 nt, artificial
  Chemically synthesized
cauuucacuuauccuaca

SEQ ID NO: 10482 - RNA, 18 nt, artificial
  Chemically synthesized
ccgaagagguuccugcag

SEQ ID NO: 10483 - RNA, 18 nt, artificial
  Chemically synthesized
ugcuacauccaacgcuuu

SEQ ID NO: 10484 - RNA, 18 nt, artificial
  Chemically synthesized
uucuccaagucccggguu

SEQ ID NO: 10485 - RNA, 18 nt, artificial
  Chemically synthesized
cccaaaauugcuucucuu

SEQ ID NO: 10486 - RNA, 18 nt, artificial
  Chemically synthesized
ggaaaaaccuaauugcau

SEQ ID NO: 10487 - RNA, 18 nt, artificial
  Chemically synthesized
ggauguccauuccaugaa

SEQ ID NO: 10488 - RNA, 18 nt, artificial
  Chemically synthesized
gaagggaggcugacgaag

SEQ ID NO: 10489 - RNA, 18 nt, artificial
  Chemically synthesized
gcucuccugcgccggcac

SEQ ID NO: 10490 - RNA, 18 nt, artificial
  Chemically synthesized
ucauuuaagagugccuaa

SEQ ID NO: 10491 - RNA, 18 nt, artificial
  Chemically synthesized
ggaaccgucugaaacauu

SEQ ID NO: 10492 - RNA, 18 nt, artificial
  Chemically synthesized
ccaaaguuuaugugcuac

SEQ ID NO: 10493 - RNA, 18 nt, artificial
  Chemically synthesized
cuuuuaagcauagccaua

SEQ ID NO: 10494 - RNA, 18 nt, artificial
  Chemically synthesized
cacaaaacaugccacuuu

SEQ ID NO: 10495 - RNA, 18 nt, artificial
  Chemically synthesized
gcugacauccuggcucuc

SEQ ID NO: 10496 - RNA, 18 nt, artificial
  Chemically synthesized
gguugcaggucgcuuccu

SEQ ID NO: 10497 - RNA, 18 nt, artificial
  Chemically synthesized
cacagguaguacaaugaa

SEQ ID NO: 10498 - RNA, 18 nt, artificial
  Chemically synthesized
uaaaagcagauggucaau

SEQ ID NO: 10499 - RNA, 18 nt, artificial
  Chemically synthesized
cugcgccggcaccuugca

SEQ ID NO: 10500 - RNA, 18 nt, artificial
  Chemically synthesized
gcucccgcugacauccug

SEQ ID NO: 10501 - RNA, 18 nt, artificial
  Chemically synthesized
gcauuuacaaaugcacaa

SEQ ID NO: 10502 - RNA, 18 nt, artificial
  Chemically synthesized
gccgaagagguuccugca

SEQ ID NO: 10503 - RNA, 18 nt, artificial
  Chemically synthesized
cccacccugcccucccuu

SEQ ID NO: 10504 - RNA, 18 nt, artificial
  Chemically synthesized
aacgcuuuuagaggcaga

SEQ ID NO: 10505 - RNA, 18 nt, artificial
  Chemically synthesized
gcaucuuuuucacacauu

SEQ ID NO: 10506 - RNA, 18 nt, artificial
  Chemically synthesized
ggcucccgcugacauccu

SEQ ID NO: 10507 - RNA, 18 nt, artificial
  Chemically synthesized
uccacagaaccggcauuu

SEQ ID NO: 10508 - RNA, 18 nt, artificial
  Chemically synthesized
ggcgucugcuccacagaa

SEQ ID NO: 10509 - RNA, 18 nt, artificial
  Chemically synthesized
gggacauuacaucuuuaa

SEQ ID NO: 10510 - RNA, 18 nt, artificial
  Chemically synthesized
accgggccgaagagguuc

SEQ ID NO: 10511 - RNA, 18 nt, artificial
  Chemically synthesized
gaucaccagaucucccaa

SEQ ID NO: 10512 - RNA, 18 nt, artificial
  Chemically synthesized
caaaugcguguccucaga

SEQ ID NO: 10513 - RNA, 18 nt, artificial
  Chemically synthesized
gucagcgauauguauuuu

SEQ ID NO: 10514 - RNA, 18 nt, artificial
  Chemically synthesized
agggacauuacaucuuua

SEQ ID NO: 10515 - RNA, 18 nt, artificial
  Chemically synthesized
gcccaauauggcggugga

SEQ ID NO: 10516 - RNA, 18 nt, artificial
  Chemically synthesized
ccuuuuuuuaguggccca

SEQ ID NO: 10517 - RNA, 18 nt, artificial
  Chemically synthesized
gggccgaagagguuccug

SEQ ID NO: 10518 - RNA, 18 nt, artificial
  Chemically synthesized
caugccacuuuggcuugu

SEQ ID NO: 10519 - RNA, 18 nt, artificial
  Chemically synthesized
gggaaccgucugaaacau

SEQ ID NO: 10520 - RNA, 18 nt, artificial
  Chemically synthesized
gggcggcucccgcugaca

SEQ ID NO: 10521 - RNA, 18 nt, artificial
  Chemically synthesized
cgguggaagggaggcuga

SEQ ID NO: 10522 - RNA, 18 nt, artificial
  Chemically synthesized
ggcggcucccgcugacau

SEQ ID NO: 10523 - RNA, 18 nt, artificial
  Chemically synthesized
uccuacaagugugcuuuu

SEQ ID NO: 10524 - RNA, 18 nt, artificial
  Chemically synthesized
gccggcaccuugcaggca

SEQ ID NO: 10525 - RNA, 18 nt, artificial
  Chemically synthesized
cuccacagaaccggcauu

SEQ ID NO: 10526 - RNA, 18 nt, artificial
  Chemically synthesized
gggaggcugacgaagaag

SEQ ID NO: 10527 - RNA, 18 nt, artificial
  Chemically synthesized
cuuuuuuuaguggcccaa

SEQ ID NO: 10528 - RNA, 18 nt, artificial
  Chemically synthesized
cccaauauggcgguggaa

SEQ ID NO: 10529 - RNA, 18 nt, artificial
  Chemically synthesized
cgggccgaagagguuccu

SEQ ID NO: 10530 - RNA, 18 nt, artificial
  Chemically synthesized
cccaaaguuuaugugcua

SEQ ID NO: 10531 - RNA, 18 nt, artificial
  Chemically synthesized
ccaaacuaccuggaguga

SEQ ID NO: 10532 - RNA, 18 nt, Artificial Sequence
  Chemically synthesized
agggaggcugacgaagaa

SEQ ID NO: 10533 - RNA, 19 nt, artificial
  Chemically synthesized
ggagaucggagcuuuuuaa

SEQ ID NO: 10534 - RNA, 19 nt, artificial
  Chemically synthesized
gacuggcaguucugauuua

SEQ ID NO: 10535 - RNA, 19 nt, artificial
  Chemically synthesized
ccuccuucucuuugauuua

SEQ ID NO: 10536 - RNA, 19 nt, artificial
  Chemically synthesized
gggaaaggaugguugaguu

SEQ ID NO: 10537 - RNA, 19 nt, artificial
  Chemically synthesized
ggcaguucugauuuaguua

SEQ ID NO: 10538 - RNA, 19 nt, artificial
  Chemically synthesized
ccacuaugcuuaauguuaa

SEQ ID NO: 10539 - RNA, 19 nt, artificial
  Chemically synthesized
agaaaaagacggagaggaa

SEQ ID NO: 10540 - RNA, 19 nt, artificial
  Chemically synthesized
ggugaauguacaaacuguu

SEQ ID NO: 10541 - RNA, 19 nt, artificial
  Chemically synthesized
cuguuuuucuccuuguaua

SEQ ID NO: 10542 - RNA, 19 nt, artificial
  Chemically synthesized
ggcaagcccuauagaccuu

SEQ ID NO: 10543 - RNA, 19 nt, artificial
  Chemically synthesized
cagugugugcggaacgcaa

SEQ ID NO: 10544 - RNA, 19 nt, artificial
  Chemically synthesized
cgccgacgagaccggauca

SEQ ID NO: 10545 - RNA, 19 nt, artificial
  Chemically synthesized
ggacggagaucggagcuuu

SEQ ID NO: 10546 - RNA, 19 nt, artificial
  Chemically synthesized
ggacuaucggaguuuggga

SEQ ID NO: 10547 - RNA, 19 nt, artificial
  Chemically synthesized
aaaggaugguugaguuuua

SEQ ID NO: 10548 - RNA, 19 nt, artificial
  Chemically synthesized
ggccagaaaaagacggaga

SEQ ID NO: 10549 - RNA, 19 nt, artificial
  Chemically synthesized
gccuccuucucuuugauuu

SEQ ID NO: 10550 - RNA, 19 nt, artificial
  Chemically synthesized
cggagaucggagcuuuuua

SEQ ID NO: 10551 - RNA, 19 nt, artificial
  Chemically synthesized
ggaucucaaauucacaaau

SEQ ID NO: 10552 - RNA, 19 nt, artificial
  Chemically synthesized
ccuauagcagaaaggugaa

SEQ ID NO: 10553 - RNA, 19 nt, artificial
  Chemically synthesized
ggaccgucuucggacauca

SEQ ID NO: 10554 - RNA, 19 nt, artificial
  Chemically synthesized
gaucugcuaagcuagaaaa

SEQ ID NO: 10555 - RNA, 19 nt, artificial
  Chemically synthesized
gggaucagugugugcggaa

SEQ ID NO: 10556 - RNA, 19 nt, artificial
  Chemically synthesized
aggugaauguacaaacugu

SEQ ID NO: 10557 - RNA, 19 nt, artificial
  Chemically synthesized
aaaaagacggagaggaaua

SEQ ID NO: 10558 - RNA, 19 nt, artificial
  Chemically synthesized
agaaggagagugcggacga

SEQ ID NO: 10559 - RNA, 19 nt, artificial
  Chemically synthesized
ggaaaggaugguugaguuu

SEQ ID NO: 10560 - RNA, 19 nt, artificial
  Chemically synthesized
gguuuguugguuuacuuuu

SEQ ID NO: 10561 - RNA, 19 nt, artificial
  Chemically synthesized
ggcugguacccagugcuuu

SEQ ID NO: 10562 - RNA, 19 nt, artificial
  Chemically synthesized
cggaucucaaauucacaaa

SEQ ID NO: 10563 - RNA, 19 nt, artificial
  Chemically synthesized
aguuuuaaccagaggcaaa

SEQ ID NO: 10564 - RNA, 19 nt, artificial
  Chemically synthesized
cuaaagguuuguugguuua

SEQ ID NO: 10565 - RNA, 19 nt, artificial
  Chemically synthesized
gccgacgagaccggaucaa

SEQ ID NO: 10566 - RNA, 19 nt, artificial
  Chemically synthesized
gagagccgcugauagguua

SEQ ID NO: 10567 - RNA, 19 nt, artificial
  Chemically synthesized
ccagaaugauuccguuuuu

SEQ ID NO: 10568 - RNA, 19 nt, artificial
  Chemically synthesized
gcuucgaguucgacugguu

SEQ ID NO: 10569 - RNA, 19 nt, artificial
  Chemically synthesized
gcagggaucugcuaagcua

SEQ ID NO: 10570 - RNA, 19 nt, artificial
  Chemically synthesized
ggacgagaauggaaacuug

SEQ ID NO: 10571 - RNA, 19 nt, artificial
  Chemically synthesized
gucauguauuagcaguuuu

SEQ ID NO: 10572 - RNA, 19 nt, artificial
  Chemically synthesized
cagaaaggugaauguacaa

SEQ ID NO: 10573 - RNA, 19 nt, artificial
  Chemically synthesized
agugcggacgagaauggaa

SEQ ID NO: 10574 - RNA, 19 nt, artificial
  Chemically synthesized
ggacuggcaguucugauuu

SEQ ID NO: 10575 - RNA, 19 nt, artificial
  Chemically synthesized
gaguuuuccuuuuggugca

SEQ ID NO: 10576 - RNA, 19 nt, artificial
  Chemically synthesized
uggucaauugaguaguaca

SEQ ID NO: 10577 - RNA, 19 nt, artificial
  Chemically synthesized
cagcuuuauccaagaaaga

SEQ ID NO: 10578 - RNA, 19 nt, artificial
  Chemically synthesized
aauagugaguauaagccaa

SEQ ID NO: 10579 - RNA, 19 nt, artificial
  Chemically synthesized
ccagauuuuggccagaaaa

SEQ ID NO: 10580 - RNA, 19 nt, artificial
  Chemically synthesized
ggugcauggaacugugguu

SEQ ID NO: 10581 - RNA, 19 nt, artificial
  Chemically synthesized
gacagauuaagguguugua

SEQ ID NO: 10582 - RNA, 19 nt, artificial
  Chemically synthesized
gggaaugccuggcagaagu

SEQ ID NO: 10583 - RNA, 19 nt, artificial
  Chemically synthesized
ccaacuacaucuucccaga

SEQ ID NO: 10584 - RNA, 19 nt, artificial
  Chemically synthesized
cuaucggaguuugggauuu

SEQ ID NO: 10585 - RNA, 19 nt, artificial
  Chemically synthesized
acuacaucuucccagauuu

SEQ ID NO: 10586 - RNA, 19 nt, artificial
  Chemically synthesized
auugaguaguacaguggaa

SEQ ID NO: 10587 - RNA, 19 nt, artificial
  Chemically synthesized
ggagaaggagagugcggac

SEQ ID NO: 10588 - RNA, 19 nt, artificial
  Chemically synthesized
accggaucaauaacaguuu

SEQ ID NO: 10589 - RNA, 19 nt, artificial
  Chemically synthesized
aguguugguggaaaggaaa

SEQ ID NO: 10590 - RNA, 19 nt, artificial
  Chemically synthesized
aguuugucugagcugagaa

SEQ ID NO: 10591 - RNA, 19 nt, artificial
  Chemically synthesized
agcuuuauccaagaaagaa

SEQ ID NO: 10592 - RNA, 19 nt, artificial
  Chemically synthesized
gagaaggcugguacccagu

SEQ ID NO: 10593 - RNA, 19 nt, artificial
  Chemically synthesized
gagaauggaaacuugaguu

SEQ ID NO: 10594 - RNA, 19 nt, artificial
  Chemically synthesized
cagauuuuggccagaaaaa

SEQ ID NO: 10595 - RNA, 19 nt, artificial
  Chemically synthesized
gcaucauugaaggacuaga

SEQ ID NO: 10596 - RNA, 19 nt, artificial
  Chemically synthesized
ggaguuugggauuucggga

SEQ ID NO: 10597 - RNA, 19 nt, artificial
  Chemically synthesized
gacugguuucgcaucucaa

SEQ ID NO: 10598 - RNA, 19 nt, artificial
  Chemically synthesized
gcugguacccagugcuuuu

SEQ ID NO: 10599 - RNA, 19 nt, artificial
  Chemically synthesized
cccagcaacacaaagaauu

SEQ ID NO: 10600 - RNA, 19 nt, artificial
  Chemically synthesized
ccguggaucaccugaaaau

SEQ ID NO: 10601 - RNA, 19 nt, artificial
  Chemically synthesized
cccagauuuuggccagaaa

SEQ ID NO: 10602 - RNA, 19 nt, artificial
  Chemically synthesized
ggaucagugugugcggaac

SEQ ID NO: 10603 - RNA, 19 nt, artificial
  Chemically synthesized
gaguuuuaaccagaggcaa

SEQ ID NO: 10604 - RNA, 19 nt, artificial
  Chemically synthesized
ugguugccaagguauuuaa

SEQ ID NO: 10605 - RNA, 19 nt, artificial
  Chemically synthesized
gguuuguacugugccuaau

SEQ ID NO: 10606 - RNA, 19 nt, artificial
  Chemically synthesized
gaaaaagacggagaggaau

SEQ ID NO: 10607 - RNA, 19 nt, artificial
  Chemically synthesized
gcguugacaaaucagauga

SEQ ID NO: 10608 - RNA, 19 nt, artificial
  Chemically synthesized
agucgucaguaaaaguaaa

SEQ ID NO: 10609 - RNA, 19 nt, artificial
  Chemically synthesized
gacuaucggaguuugggau

SEQ ID NO: 10610 - RNA, 19 nt, artificial
  Chemically synthesized
cuccuucucuuugauuuau

SEQ ID NO: 10611 - RNA, 19 nt, artificial
  Chemically synthesized
guauaguuauggucuguuu

SEQ ID NO: 10612 - RNA, 19 nt, artificial
  Chemically synthesized
cgcccuugcuauggacuau

SEQ ID NO: 10613 - RNA, 19 nt, artificial
  Chemically synthesized
cuuuauccaagaaagaaga

SEQ ID NO: 10614 - RNA, 19 nt, artificial
  Chemically synthesized
cagaaaaagacggagagga

SEQ ID NO: 10615 - RNA, 19 nt, artificial
  Chemically synthesized
gagugcggacgagaaugga

SEQ ID NO: 10616 - RNA, 19 nt, artificial
  Chemically synthesized
ugaguauaagccaacacuu

SEQ ID NO: 10617 - RNA, 19 nt, artificial
  Chemically synthesized
cguuuuugccucaaaauuu

SEQ ID NO: 10618 - RNA, 19 nt, artificial
  Chemically synthesized
uauccaagaaagaagacua

SEQ ID NO: 10619 - RNA, 19 nt, artificial
  Chemically synthesized
gggaaucuuaacauuuagu

SEQ ID NO: 10620 - RNA, 19 nt, artificial
  Chemically synthesized
ccuccacugaacuggguuu

SEQ ID NO: 10621 - RNA, 19 nt, artificial
  Chemically synthesized
cacgcaggcugcaaaccuu

SEQ ID NO: 10622 - RNA, 19 nt, artificial
  Chemically synthesized
aacacuuugugauagguuu

SEQ ID NO: 10623 - RNA, 19 nt, artificial
  Chemically synthesized
ugaucagcuuuauccaaga

SEQ ID NO: 10624 - RNA, 19 nt, artificial
  Chemically synthesized
ccuuaaagucgucaguaaa

SEQ ID NO: 10625 - RNA, 19 nt, artificial
  Chemically synthesized
gagagugcggacgagaaug

SEQ ID NO: 10626 - RNA, 19 nt, artificial
  Chemically synthesized
aagguuuguugguuuacuu

SEQ ID NO: 10627 - RNA, 19 nt, artificial
  Chemically synthesized
cacggaucucaaauucaca

SEQ ID NO: 10628 - RNA, 19 nt, artificial
  Chemically synthesized
uggagaaggagagugcgga

SEQ ID NO: 10629 - RNA, 19 nt, artificial
  Chemically synthesized
gagaagcagggaucugcua

SEQ ID NO: 10630 - RNA, 19 nt, artificial
  Chemically synthesized
ccagugcuuuugagaagca

SEQ ID NO: 10631 - RNA, 19 nt, artificial
  Chemically synthesized
agguuuguugguuuacuuu

SEQ ID NO: 10632 - RNA, 19 nt, artificial
  Chemically synthesized
agaccggaucaauaacagu

SEQ ID NO: 10633 - RNA, 19 nt, artificial
  Chemically synthesized
gcggagaggcgccgcugua

SEQ ID NO: 10634 - RNA, 19 nt, artificial
  Chemically synthesized
auagaauacgccugcauuu

SEQ ID NO: 10635 - RNA, 19 nt, artificial
  Chemically synthesized
cugugguugccaagguauu

SEQ ID NO: 10636 - RNA, 19 nt, artificial
  Chemically synthesized
ugguugaguuuuaaccaga

SEQ ID NO: 10637 - RNA, 19 nt, artificial
  Chemically synthesized
ggaaugccuggcagaaguu

SEQ ID NO: 10638 - RNA, 19 nt, artificial
  Chemically synthesized
ggugugcgaguggucaauu

SEQ ID NO: 10639 - RNA, 19 nt, artificial
  Chemically synthesized
cggaucaauaacaguuugu

SEQ ID NO: 10640 - RNA, 19 nt, artificial
  Chemically synthesized
ugagcaucauugaaggacu

SEQ ID NO: 10641 - RNA, 19 nt, artificial
  Chemically synthesized
gcguuaucugagcaucauu

SEQ ID NO: 10642 - RNA, 19 nt, artificial
  Chemically synthesized
cguugacaaaucagaugau

SEQ ID NO: 10643 - RNA, 19 nt, artificial
  Chemically synthesized
gagggaaagguuacuuuga

SEQ ID NO: 10644 - RNA, 19 nt, artificial
  Chemically synthesized
gaguucgacugguuucgca

SEQ ID NO: 10645 - RNA, 19 nt, artificial
  Chemically synthesized
cugagaaggcugguaccca

SEQ ID NO: 10646 - RNA, 19 nt, artificial
  Chemically synthesized
gguuucgcaucucaacaac

SEQ ID NO: 10647 - RNA, 19 nt, artificial
  Chemically synthesized
ccgagauccugcagaugac

SEQ ID NO: 10648 - RNA, 19 nt, artificial
  Chemically synthesized
ggucuguuuuucuccuugu

SEQ ID NO: 10649 - RNA, 19 nt, artificial
  Chemically synthesized
gugaguauaagccaacacu

SEQ ID NO: 10650 - RNA, 19 nt, artificial
  Chemically synthesized
gaugguugaguuuuaacca

SEQ ID NO: 10651 - RNA, 19 nt, artificial
  Chemically synthesized
cuauggacuaucggaguuu

SEQ ID NO: 10652 - RNA, 19 nt, artificial
  Chemically synthesized
gugguugccaagguauuua

SEQ ID NO: 10653 - RNA, 19 nt, artificial
  Chemically synthesized
ugguuucgcaucucaacaa

SEQ ID NO: 10654 - RNA, 19 nt, artificial
  Chemically synthesized
cacccacgcaggcugcaaa

SEQ ID NO: 10655 - RNA, 19 nt, artificial
  Chemically synthesized
aagacggagaggaauaauu

SEQ ID NO: 10656 - RNA, 19 nt, artificial
  Chemically synthesized
gcggaacgcaagcagccga

SEQ ID NO: 10657 - RNA, 19 nt, artificial
  Chemically synthesized
caugucauguauuagcagu

SEQ ID NO: 10658 - RNA, 19 nt, artificial
  Chemically synthesized
agcuggacgagaccaucga

SEQ ID NO: 10659 - RNA, 19 nt, artificial
  Chemically synthesized
gagaucggagcuuuuuaaa

SEQ ID NO: 10660 - RNA, 19 nt, artificial
  Chemically synthesized
ccagcaugaagcgagcuca

SEQ ID NO: 10661 - RNA, 19 nt, artificial
  Chemically synthesized
aaaggaaacugaagguaau

SEQ ID NO: 10662 - RNA, 19 nt, artificial
  Chemically synthesized
gcgagcuggacgagaccau

SEQ ID NO: 10663 - RNA, 19 nt, artificial
  Chemically synthesized
ggaggcgccugcuuugcga

SEQ ID NO: 10664 - RNA, 19 nt, artificial
  Chemically synthesized
gacuaaagguuuguugguu

SEQ ID NO: 10665 - RNA, 19 nt, artificial
  Chemically synthesized
ggcucagcgugggaaagga

SEQ ID NO: 10666 - RNA, 19 nt, artificial
  Chemically synthesized
ugguggaaaggaaacugaa

SEQ ID NO: 10667 - RNA, 19 nt, artificial
  Chemically synthesized
aggucucauuuggaguguu

SEQ ID NO: 10668 - RNA, 19 nt, artificial
  Chemically synthesized
ggaguguugguggaaagga

SEQ ID NO: 10669 - RNA, 19 nt, artificial
  Chemically synthesized
cauuuggaguguuggugga

SEQ ID NO: 10670 - RNA, 19 nt, artificial
  Chemically synthesized
cugagcaaagcguugacaa

SEQ ID NO: 10671 - RNA, 19 nt, artificial
  Chemically synthesized
cagguuuauucuuuuagca

SEQ ID NO: 10672 - RNA, 19 nt, artificial
  Chemically synthesized
gcuuuauccaagaaagaag

SEQ ID NO: 10673 - RNA, 19 nt, artificial
  Chemically synthesized
uccuauagcagaaagguga

SEQ ID NO: 10674 - RNA, 19 nt, artificial
  Chemically synthesized
aggacuggcaguucugauu

SEQ ID NO: 10675 - RNA, 19 nt, artificial
  Chemically synthesized
cuugcuauggacuaucgga

SEQ ID NO: 10676 - RNA, 19 nt, artificial
  Chemically synthesized
ggaacgcaagcagccgaga

SEQ ID NO: 10677 - RNA, 19 nt, artificial
  Chemically synthesized
agaaaggugaauguacaaa

SEQ ID NO: 10678 - RNA, 19 nt, artificial
  Chemically synthesized
gguggaaaggaaacugaag

SEQ ID NO: 10679 - RNA, 19 nt, artificial
  Chemically synthesized
agguuuguacugugccuaa

SEQ ID NO: 10680 - RNA, 19 nt, artificial
  Chemically synthesized
cggacgagaauggaaacuu

SEQ ID NO: 10681 - RNA, 19 nt, artificial
  Chemically synthesized
agaugaucagcuuuaucca

SEQ ID NO: 10682 - RNA, 19 nt, artificial
  Chemically synthesized
aucugcuaagcuagaaaaa

SEQ ID NO: 10683 - RNA, 19 nt, artificial
  Chemically synthesized
cgagaauggaaacuugagu

SEQ ID NO: 10684 - RNA, 19 nt, artificial
  Chemically synthesized
guugccaagguauuuaaaa

SEQ ID NO: 10685 - RNA, 19 nt, artificial
  Chemically synthesized
gucugagcugagaaggcug

SEQ ID NO: 10686 - RNA, 19 nt, artificial
  Chemically synthesized
ugucauguauuagcaguuu

SEQ ID NO: 10687 - RNA, 19 nt, artificial
  Chemically synthesized
gguugaguuuuaaccagag

SEQ ID NO: 10688 - RNA, 19 nt, artificial
  Chemically synthesized
ggcucuagguuccaugucc

SEQ ID NO: 10689 - RNA, 19 nt, artificial
  Chemically synthesized
aucggagcuuuuuaaagaa

SEQ ID NO: 10690 - RNA, 19 nt, artificial
  Chemically synthesized
gaaggagagugcggacgag

SEQ ID NO: 10691 - RNA, 19 nt, artificial
  Chemically synthesized
aaaagacggagaggaauaa

SEQ ID NO: 10692 - RNA, 19 nt, artificial
  Chemically synthesized
cugguuucgcaucucaaca

SEQ ID NO: 10693 - RNA, 19 nt, artificial
  Chemically synthesized
ugcagaugaccguggauca

SEQ ID NO: 10694 - RNA, 19 nt, artificial
  Chemically synthesized
ggucucauuuggaguguug

SEQ ID NO: 10695 - RNA, 19 nt, artificial
  Chemically synthesized
gccagaaaaagacggagag

SEQ ID NO: 10696 - RNA, 19 nt, artificial
  Chemically synthesized
agcuagaaaaagccgagau

SEQ ID NO: 10697 - RNA, 19 nt, artificial
  Chemically synthesized
agaagcagggaucugcuaa

SEQ ID NO: 10698 - RNA, 19 nt, artificial
  Chemically synthesized
guauaagccaacacuuugu

SEQ ID NO: 10699 - RNA, 19 nt, artificial
  Chemically synthesized
cacacggaucucaaauuca

SEQ ID NO: 10700 - RNA, 19 nt, artificial
  Chemically synthesized
cccugaauccaucugacca

SEQ ID NO: 10701 - RNA, 19 nt, artificial
  Chemically synthesized
ccguuuuugccucaaaauu

SEQ ID NO: 10702 - RNA, 19 nt, artificial
  Chemically synthesized
gcgugagcgggaucagugu

SEQ ID NO: 10703 - RNA, 19 nt, artificial
  Chemically synthesized
gcaagcagccgagagcgga

SEQ ID NO: 10704 - RNA, 19 nt, artificial
  Chemically synthesized
gagaccggaucaauaacag

SEQ ID NO: 10705 - RNA, 19 nt, artificial
  Chemically synthesized
ggcuuuccugccuccuucu

SEQ ID NO: 10706 - RNA, 19 nt, artificial
  Chemically synthesized
acgagaccaucgaggugga

SEQ ID NO: 10707 - RNA, 19 nt, artificial
  Chemically synthesized
uaaucacacggaucucaaa

SEQ ID NO: 10708 - RNA, 19 nt, artificial
  Chemically synthesized
gaggcgccgcuguaguuaa

SEQ ID NO: 10709 - RNA, 19 nt, artificial
  Chemically synthesized
agguauuuaaaagggcuuu

SEQ ID NO: 10710 - RNA, 19 nt, artificial
  Chemically synthesized
guaguacaguggaaacugu

SEQ ID NO: 10711 - RNA, 19 nt, artificial
  Chemically synthesized
cgggaucagugugugcgga

SEQ ID NO: 10712 - RNA, 19 nt, artificial
  Chemically synthesized
ggucaauugaguaguacag

SEQ ID NO: 10713 - RNA, 19 nt, artificial
  Chemically synthesized
augucauguauuagcaguu

SEQ ID NO: 10714 - RNA, 19 nt, artificial
  Chemically synthesized
ggauaagugaucauggugu

SEQ ID NO: 10715 - RNA, 19 nt, artificial
  Chemically synthesized
cccagaacggccacgggaa

SEQ ID NO: 10716 - RNA, 19 nt, artificial
  Chemically synthesized
ccgaguacagcuccucgga

SEQ ID NO: 10717 - RNA, 19 nt, artificial
  Chemically synthesized
aaggaugguugaguuuuaa

SEQ ID NO: 10718 - RNA, 19 nt, artificial
  Chemically synthesized
ggaauaauugagaagcgcc

SEQ ID NO: 10719 - RNA, 19 nt, artificial
  Chemically synthesized
uccaaaccacuaugcuuaa

SEQ ID NO: 10720 - RNA, 19 nt, artificial
  Chemically synthesized
ccugccuccuucucuuuga

SEQ ID NO: 10721 - RNA, 19 nt, artificial
  Chemically synthesized
cggacagcgagcuggacga

SEQ ID NO: 10722 - RNA, 19 nt, artificial
  Chemically synthesized
gggaaaguuuaaaauccca

SEQ ID NO: 10723 - RNA, 19 nt, artificial
  Chemically synthesized
accacuaugcuuaauguua

SEQ ID NO: 10724 - RNA, 19 nt, artificial
  Chemically synthesized
accuuaaagucgucaguaa

SEQ ID NO: 10725 - RNA, 19 nt, artificial
  Chemically synthesized
uacccagugcuuuugagaa

SEQ ID NO: 10726 - RNA, 19 nt, artificial
  Chemically synthesized
gaaaggaugguugaguuuu

SEQ ID NO: 10727 - RNA, 19 nt, artificial
  Chemically synthesized
guuuguacugugccuaauu

SEQ ID NO: 10728 - RNA, 19 nt, artificial
  Chemically synthesized
ggaucaauaacaguuuguc

SEQ ID NO: 10729 - RNA, 19 nt, artificial
  Chemically synthesized
guugccaacaucaccuuaa

SEQ ID NO: 10730 - RNA, 19 nt, artificial
  Chemically synthesized
ugagaaggcugguacccag

SEQ ID NO: 10731 - RNA, 19 nt, artificial
  Chemically synthesized
cgcgggccucggacacauu

SEQ ID NO: 10732 - RNA, 19 nt, artificial
  Chemically synthesized
cuucgaguucgacugguuu

SEQ ID NO: 10733 - RNA, 19 nt, artificial
  Chemically synthesized
gaauagaauacgccugcau

SEQ ID NO: 10734 - RNA, 19 nt, artificial
  Chemically synthesized
ggagagagccgcugauagg

SEQ ID NO: 10735 - RNA, 19 nt, artificial
  Chemically synthesized
aaacuugaguucggcucua

SEQ ID NO: 10736 - RNA, 19 nt, artificial
  Chemically synthesized
ugaccguggaucaccugaa

SEQ ID NO: 10737 - RNA, 19 nt, artificial
  Chemically synthesized
gguaauugaauagaauacg

SEQ ID NO: 10738 - RNA, 19 nt, artificial
  Chemically synthesized
ugaccucuguuguacugau

SEQ ID NO: 10739 - RNA, 19 nt, artificial
  Chemically synthesized
cugauuuaguuaggagaga

SEQ ID NO: 10740 - RNA, 19 nt, artificial
  Chemically synthesized
gugugcgaguggucaauug

SEQ ID NO: 10741 - RNA, 19 nt, artificial
  Chemically synthesized
gauuuuggccagaaaaaga

SEQ ID NO: 10742 - RNA, 19 nt, artificial
  Chemically synthesized
ggcaaagcgugagcgggau

SEQ ID NO: 10743 - RNA, 19 nt, artificial
  Chemically synthesized
ugagcugagaaggcuggua

SEQ ID NO: 10744 - RNA, 19 nt, artificial
  Chemically synthesized
aguuugggauuucgggaau

SEQ ID NO: 10745 - RNA, 19 nt, artificial
  Chemically synthesized
guuugucugagcugagaag

SEQ ID NO: 10746 - RNA, 19 nt, artificial
  Chemically synthesized
ggcuggacuguugccaaca

SEQ ID NO: 10747 - RNA, 19 nt, artificial
  Chemically synthesized
cgugggaaaggaugguuga

SEQ ID NO: 10748 - RNA, 19 nt, artificial
  Chemically synthesized
agcaaagcguugacaaauc

SEQ ID NO: 10749 - RNA, 19 nt, artificial
  Chemically synthesized
agcagaaaggugaauguac

SEQ ID NO: 10750 - RNA, 19 nt, artificial
  Chemically synthesized
gguggagaaggagagugcg

SEQ ID NO: 10751 - RNA, 19 nt, artificial
  Chemically synthesized
cuuaaagucgucaguaaaa

SEQ ID NO: 10752 - RNA, 19 nt, artificial
  Chemically synthesized
agagagccgcugauagguu

SEQ ID NO: 10753 - RNA, 19 nt, artificial
  Chemically synthesized
cgagguggagaaggagagu

SEQ ID NO: 10754 - RNA, 19 nt, artificial
  Chemically synthesized
agcgccgacgagaccggau

SEQ ID NO: 10755 - RNA, 19 nt, artificial
  Chemically synthesized
gaucggagcuuuuuaaaga

SEQ ID NO: 10756 - RNA, 19 nt, artificial
  Chemically synthesized
cuugaguucggcucuaggu

SEQ ID NO: 10757 - RNA, 19 nt, artificial
  Chemically synthesized
cuacaucuucccagauuuu

SEQ ID NO: 10758 - RNA, 19 nt, artificial
  Chemically synthesized
cucugacccgcuucgaguu

SEQ ID NO: 10759 - RNA, 19 nt, artificial
  Chemically synthesized
gaguggucaauugaguagu

SEQ ID NO: 10760 - RNA, 19 nt, artificial
  Chemically synthesized
cuggcaguucugauuuagu

SEQ ID NO: 10761 - RNA, 19 nt, artificial
  Chemically synthesized
cgccucugcucuccucagu

SEQ ID NO: 10762 - RNA, 19 nt, artificial
  Chemically synthesized
ccuucucuuucggcuccuu

SEQ ID NO: 10763 - RNA, 19 nt, artificial
  Chemically synthesized
ucagcuuuauccaagaaag

SEQ ID NO: 10764 - RNA, 19 nt, artificial
  Chemically synthesized
gcgccgacgagaccggauc

SEQ ID NO: 10765 - RNA, 19 nt, artificial
  Chemically synthesized
cuguuguacugauguguug

SEQ ID NO: 10766 - RNA, 19 nt, artificial
  Chemically synthesized
cccaaugcacugagcccuu

SEQ ID NO: 10767 - RNA, 19 nt, artificial
  Chemically synthesized
gcuggacuguugccaacau

SEQ ID NO: 10768 - RNA, 19 nt, artificial
  Chemically synthesized
gucaauugaguaguacagu

SEQ ID NO: 10769 - RNA, 19 nt, artificial
  Chemically synthesized
agaugaccguggaucaccu

SEQ ID NO: 10770 - RNA, 19 nt, artificial
  Chemically synthesized
gcuagaaaaagccgagauc

SEQ ID NO: 10771 - RNA, 19 nt, artificial
  Chemically synthesized
cuaagcuagaaaaagccga

SEQ ID NO: 10772 - RNA, 19 nt, artificial
  Chemically synthesized
guacaguggaaacuguuaa

SEQ ID NO: 10773 - RNA, 19 nt, artificial
  Chemically synthesized
auggugugcgaguggucaa

SEQ ID NO: 10774 - RNA, 19 nt, artificial
  Chemically synthesized
aacaguuugucugagcuga

SEQ ID NO: 10775 - RNA, 19 nt, artificial
  Chemically synthesized
cuguuaaaugcauaaccua

SEQ ID NO: 10776 - RNA, 19 nt, artificial
  Chemically synthesized
gagaggcgccgcuguaguu

SEQ ID NO: 10777 - RNA, 19 nt, artificial
  Chemically synthesized
ggagccagcaugaagcgag

SEQ ID NO: 10778 - RNA, 19 nt, artificial
  Chemically synthesized
cggagcuuuuuaaagaacu

SEQ ID NO: 10779 - RNA, 19 nt, artificial
  Chemically synthesized
ugugguugccaagguauuu

SEQ ID NO: 10780 - RNA, 19 nt, artificial
  Chemically synthesized
uagugaguauaagccaaca

SEQ ID NO: 10781 - RNA, 19 nt, artificial
  Chemically synthesized
ugugcgaguggucaauuga

SEQ ID NO: 10782 - RNA, 19 nt, artificial
  Chemically synthesized
gaauguacaaacuguuggu

SEQ ID NO: 10783 - RNA, 19 nt, artificial
  Chemically synthesized
gaggaauaauugagaagcg

SEQ ID NO: 10784 - RNA, 19 nt, artificial
  Chemically synthesized
gagaggaauaauugagaag

SEQ ID NO: 10785 - RNA, 19 nt, artificial
  Chemically synthesized
cuuuguaaaccagaaugau

SEQ ID NO: 10786 - RNA, 19 nt, artificial
  Chemically synthesized
caaaccuuggcaagcccua

SEQ ID NO: 10787 - RNA, 19 nt, artificial
  Chemically synthesized
ugcgaguggucaauugagu

SEQ ID NO: 10788 - RNA, 19 nt, artificial
  Chemically synthesized
agggaucugcuaagcuaga

SEQ ID NO: 10789 - RNA, 19 nt, artificial
  Chemically synthesized
guuugaccucuguuguacu

SEQ ID NO: 10790 - RNA, 19 nt, artificial
  Chemically synthesized
caaaucagaugaucagcuu

SEQ ID NO: 10791 - RNA, 19 nt, artificial
  Chemically synthesized
agacuaaagguuuguuggu

SEQ ID NO: 10792 - RNA, 19 nt, artificial
  Chemically synthesized
cacaaauguuaacauggau

SEQ ID NO: 10793 - RNA, 19 nt, artificial
  Chemically synthesized
gaauuuuuaaucacacgga

SEQ ID NO: 10794 - RNA, 19 nt, artificial
  Chemically synthesized
aguacaguggaaacuguua

SEQ ID NO: 10795 - RNA, 19 nt, artificial
  Chemically synthesized
aauagaauacgccugcauu

SEQ ID NO: 10796 - RNA, 19 nt, artificial
  Chemically synthesized
caagguauuuaaaagggcu

SEQ ID NO: 10797 - RNA, 19 nt, artificial
  Chemically synthesized
gguuuauucuuuuagcagg

SEQ ID NO: 10798 - RNA, 19 nt, artificial
  Chemically synthesized
ccucggacagcgagcugga

SEQ ID NO: 10799 - RNA, 19 nt, artificial
  Chemically synthesized
uggcaagcccuauagaccu

SEQ ID NO: 10800 - RNA, 19 nt, artificial
  Chemically synthesized
acggaucucaaauucacaa

SEQ ID NO: 10801 - RNA, 19 nt, artificial
  Chemically synthesized
acuaucggaguuugggauu

SEQ ID NO: 10802 - RNA, 19 nt, artificial
  Chemically synthesized
ggagggaaagguuacuuug

SEQ ID NO: 10803 - RNA, 19 nt, artificial
  Chemically synthesized
gggacugccauauuuucuu

SEQ ID NO: 10804 - RNA, 19 nt, artificial
  Chemically synthesized
cuuacugucucccaaugca

SEQ ID NO: 10805 - RNA, 19 nt, artificial
  Chemically synthesized
gaaaggugaauguacaaac

SEQ ID NO: 10806 - RNA, 19 nt, artificial
  Chemically synthesized
ugucugagcugagaaggcu

SEQ ID NO: 10807 - RNA, 19 nt, artificial
  Chemically synthesized
ggagaggcgccgcuguagu

SEQ ID NO: 10808 - RNA, 19 nt, artificial
  Chemically synthesized
aucacacggaucucaaauu

SEQ ID NO: 10809 - RNA, 19 nt, artificial
  Chemically synthesized
ccacggaaccgcaccacca

SEQ ID NO: 10810 - RNA, 19 nt, artificial
  Chemically synthesized
aaaccagaaugauuccguu

SEQ ID NO: 10811 - RNA, 19 nt, artificial
  Chemically synthesized
aaucagaugaucagcuuua

SEQ ID NO: 10812 - RNA, 19 nt, artificial
  Chemically synthesized
aucagaugaucagcuuuau

SEQ ID NO: 10813 - RNA, 19 nt, artificial
  Chemically synthesized
aaauugucugccuccuaua

SEQ ID NO: 10814 - RNA, 19 nt, artificial
  Chemically synthesized
gggcuuuccugccuccuuc

SEQ ID NO: 10815 - RNA, 19 nt, artificial
  Chemically synthesized
cugcuaagcuagaaaaagc

SEQ ID NO: 10816 - RNA, 19 nt, artificial
  Chemically synthesized
ggagcuuuuuaaagaacug

SEQ ID NO: 10817 - RNA, 19 nt, artificial
  Chemically synthesized
acuuugugauagguuugua

SEQ ID NO: 10818 - RNA, 19 nt, artificial
  Chemically synthesized
gaguaguacaguggaaacu

SEQ ID NO: 10819 - RNA, 19 nt, artificial
  Chemically synthesized
guacccagugcuuuugaga

SEQ ID NO: 10820 - RNA, 19 nt, artificial
  Chemically synthesized
cucuguuguacugaugugu

SEQ ID NO: 10821 - RNA, 19 nt, artificial
  Chemically synthesized
aaggagagugcggacgaga

SEQ ID NO: 10822 - RNA, 19 nt, artificial
  Chemically synthesized
gcuuuugagaagcagggau

SEQ ID NO: 10823 - RNA, 19 nt, artificial
  Chemically synthesized
accagaaugauuccguuuu

SEQ ID NO: 10824 - RNA, 19 nt, artificial
  Chemically synthesized
ugcuauggacuaucggagu

SEQ ID NO: 10825 - RNA, 19 nt, artificial
  Chemically synthesized
caccugaaaaugcugcaua

SEQ ID NO: 10826 - RNA, 19 nt, artificial
  Chemically synthesized
gagagagccgcugauaggu

SEQ ID NO: 10827 - RNA, 19 nt, artificial
  Chemically synthesized
acgagaccggaucaauaac

SEQ ID NO: 10828 - RNA, 19 nt, artificial
  Chemically synthesized
acuuuguaaaccagaauga

SEQ ID NO: 10829 - RNA, 19 nt, artificial
  Chemically synthesized
accuaauuuuccugggacu

SEQ ID NO: 10830 - RNA, 19 nt, artificial
  Chemically synthesized
ccuccuauagcagaaaggu

SEQ ID NO: 10831 - RNA, 19 nt, artificial
  Chemically synthesized
gaguucggcucuagguucc

SEQ ID NO: 10832 - RNA, 19 nt, artificial
  Chemically synthesized
cgucaguaaaaguaaaaag

SEQ ID NO: 10833 - RNA, 19 nt, artificial
  Chemically synthesized
ccuuuuggugcauggaacu

SEQ ID NO: 10834 - RNA, 19 nt, artificial
  Chemically synthesized
caaugcacugagcccuuca

SEQ ID NO: 10835 - RNA, 19 nt, artificial
  Chemically synthesized
agcugagaaggcugguacc

SEQ ID NO: 10836 - RNA, 19 nt, artificial
  Chemically synthesized
cuuucggcuccuuccacuu

SEQ ID NO: 10837 - RNA, 19 nt, artificial
  Chemically synthesized
aggcugguacccagugcuu

SEQ ID NO: 10838 - RNA, 19 nt, artificial
  Chemically synthesized
gucgucaguaaaaguaaaa

SEQ ID NO: 10839 - RNA, 19 nt, artificial
  Chemically synthesized
aggcugcaaaccuuggcaa

SEQ ID NO: 10840 - RNA, 19 nt, artificial
  Chemically synthesized
cugaagguaauugaauaga

SEQ ID NO: 10841 - RNA, 19 nt, artificial
  Chemically synthesized
cuauagcagaaaggugaau

SEQ ID NO: 10842 - RNA, 19 nt, artificial
  Chemically synthesized
ggcugcaaaccuuggcaag

SEQ ID NO: 10843 - RNA, 19 nt, artificial
  Chemically synthesized
aaccuuggcaagcccuaua

SEQ ID NO: 10844 - RNA, 19 nt, artificial
  Chemically synthesized
aagugaucauggugugcga

SEQ ID NO: 10845 - RNA, 19 nt, artificial
  Chemically synthesized
uggugugcgaguggucaau

SEQ ID NO: 10846 - RNA, 19 nt, artificial
  Chemically synthesized
aauugaguaguacagugga

SEQ ID NO: 10847 - RNA, 19 nt, artificial
  Chemically synthesized
gguauuuaaaagggcuuuc

SEQ ID NO: 10848 - RNA, 19 nt, artificial
  Chemically synthesized
aucgagguggagaaggaga

SEQ ID NO: 10849 - RNA, 19 nt, artificial
  Chemically synthesized
ccugggacugccauauuuu

SEQ ID NO: 10850 - RNA, 19 nt, artificial
  Chemically synthesized
cccagggagccagcaugaa

SEQ ID NO: 10851 - RNA, 19 nt, artificial
  Chemically synthesized
aacuguugguggcccugaa

SEQ ID NO: 10852 - RNA, 19 nt, artificial
  Chemically synthesized
uugacaaaucagaugauca

SEQ ID NO: 10853 - RNA, 19 nt, artificial
  Chemically synthesized
aacugugguugccaaggua

SEQ ID NO: 10854 - RNA, 19 nt, artificial
  Chemically synthesized
guuuauucuuuuagcaggu

SEQ ID NO: 10855 - RNA, 19 nt, artificial
  Chemically synthesized
aaauagugaguauaagcca

SEQ ID NO: 10856 - RNA, 19 nt, artificial
  Chemically synthesized
gcugguaucugccaggacu

SEQ ID NO: 10857 - RNA, 19 nt, artificial
  Chemically synthesized
auggaacugugguugccaa

SEQ ID NO: 10858 - RNA, 19 nt, artificial
  Chemically synthesized
agcgagcuggacgagacca

SEQ ID NO: 10859 - RNA, 19 nt, artificial
  Chemically synthesized
gcaguucugauuuaguuag

SEQ ID NO: 10860 - RNA, 19 nt, artificial
  Chemically synthesized
cuggguuugaccucuguug

SEQ ID NO: 10861 - RNA, 19 nt, artificial
  Chemically synthesized
cagcaacacaaagaauuuu

SEQ ID NO: 10862 - RNA, 19 nt, artificial
  Chemically synthesized
gaaacuugaguucggcucu

SEQ ID NO: 10863 - RNA, 19 nt, artificial
  Chemically synthesized
gagaccaucgagguggaga

SEQ ID NO: 10864 - RNA, 19 nt, artificial
  Chemically synthesized
ugaauagaauacgccugca

SEQ ID NO: 10865 - RNA, 19 nt, artificial
  Chemically synthesized
aguauaagccaacacuuug

SEQ ID NO: 10866 - RNA, 19 nt, artificial
  Chemically synthesized
gcuggacgagaccaucgag

SEQ ID NO: 10867 - RNA, 19 nt, artificial
  Chemically synthesized
gaagacuaguaaauugucu

SEQ ID NO: 10868 - RNA, 19 nt, artificial
  Chemically synthesized
gcccuucagcacccacgca

SEQ ID NO: 10869 - RNA, 19 nt, artificial
  Chemically synthesized
gagcugagaaggcugguac

SEQ ID NO: 10870 - RNA, 19 nt, artificial
  Chemically synthesized
aucagcuuuauccaagaaa

SEQ ID NO: 10871 - RNA, 19 nt, artificial
  Chemically synthesized
guuaggagagagccgcuga

SEQ ID NO: 10872 - RNA, 19 nt, artificial
  Chemically synthesized
gcggacgagaauggaaacu

SEQ ID NO: 10873 - RNA, 19 nt, artificial
  Chemically synthesized
accguggaucaccugaaaa

SEQ ID NO: 10874 - RNA, 19 nt, artificial
  Chemically synthesized
aaagcguugacaaaucaga

SEQ ID NO: 10875 - RNA, 19 nt, artificial
  Chemically synthesized
uggacuguugccaacauca

SEQ ID NO: 10876 - RNA, 19 nt, artificial
  Chemically synthesized
agguggagaaggagagugc

SEQ ID NO: 10877 - RNA, 19 nt, artificial
  Chemically synthesized
ccucuguuguacugaugug

SEQ ID NO: 10878 - RNA, 19 nt, artificial
  Chemically synthesized
caucucaacaacuacgcuu

SEQ ID NO: 10879 - RNA, 19 nt, artificial
  Chemically synthesized
cagggaucugcuaagcuag

SEQ ID NO: 10880 - RNA, 19 nt, artificial
  Chemically synthesized
cccuagcggcagccucgga

SEQ ID NO: 10881 - RNA, 19 nt, artificial
  Chemically synthesized
uccacuuacugucucccaa

SEQ ID NO: 10882 - RNA, 19 nt, artificial
  Chemically synthesized
acgcccuugcuauggacua

SEQ ID NO: 10883 - RNA, 19 nt, artificial
  Chemically synthesized
cuccuauagcagaaaggug

SEQ ID NO: 10884 - RNA, 19 nt, artificial
  Chemically synthesized
acccagugcuuuugagaag

SEQ ID NO: 10885 - RNA, 19 nt, artificial
  Chemically synthesized
aagcguugacaaaucagau

SEQ ID NO: 10886 - RNA, 19 nt, artificial
  Chemically synthesized
ggaugguugaguuuuaacc

SEQ ID NO: 10887 - RNA, 19 nt, artificial
  Chemically synthesized
uugaguaguacaguggaaa

SEQ ID NO: 10888 - RNA, 19 nt, artificial
  Chemically synthesized
cgcguuaucugagcaucau

SEQ ID NO: 10889 - RNA, 19 nt, artificial
  Chemically synthesized
aauugagaagcgccgacga

SEQ ID NO: 10890 - RNA, 19 nt, artificial
  Chemically synthesized
uauucuuuuagcaggugua

SEQ ID NO: 10891 - RNA, 19 nt, artificial
  Chemically synthesized
guucggcucuagguuccau

SEQ ID NO: 10892 - RNA, 19 nt, artificial
  Chemically synthesized
aaagguuuguugguuuacu

SEQ ID NO: 10893 - RNA, 19 nt, artificial
  Chemically synthesized
ugaguucggcucuagguuc

SEQ ID NO: 10894 - RNA, 19 nt, artificial
  Chemically synthesized
ugaguuuuaaccagaggca

SEQ ID NO: 10895 - RNA, 19 nt, artificial
  Chemically synthesized
guaauugaauagaauacgc

SEQ ID NO: 10896 - RNA, 19 nt, artificial
  Chemically synthesized
ccuuguauaguuauggucu

SEQ ID NO: 10897 - RNA, 19 nt, artificial
  Chemically synthesized
uggguuugaccucuguugu

SEQ ID NO: 10898 - RNA, 19 nt, artificial
  Chemically synthesized
aguucgacugguuucgcau

SEQ ID NO: 10899 - RNA, 19 nt, artificial
  Chemically synthesized
gucaguaaaaguaaaaagg

SEQ ID NO: 10900 - RNA, 19 nt, artificial
  Chemically synthesized
uuaaaaagcuccgaucucc

SEQ ID NO: 10901 - RNA, 19 nt, artificial
  Chemically synthesized
uaaaucagaacugccaguc

SEQ ID NO: 10902 - RNA, 19 nt, artificial
  Chemically synthesized
uaaaucaaagagaaggagg

SEQ ID NO: 10903 - RNA, 19 nt, artificial
  Chemically synthesized
aacucaaccauccuuuccc

SEQ ID NO: 10904 - RNA, 19 nt, artificial
  Chemically synthesized
uaacuaaaucagaacugcc

SEQ ID NO: 10905 - RNA, 19 nt, artificial
  Chemically synthesized
uuaacauuaagcauagugg

SEQ ID NO: 10906 - RNA, 19 nt, artificial
  Chemically synthesized
uuccucuccgucuuuuucu

SEQ ID NO: 10907 - RNA, 19 nt, artificial
  Chemically synthesized
aacaguuuguacauucacc

SEQ ID NO: 10908 - RNA, 19 nt, artificial
  Chemically synthesized
uauacaaggagaaaaacag

SEQ ID NO: 10909 - RNA, 19 nt, artificial
  Chemically synthesized
aaggucuauagggcuugcc

SEQ ID NO: 10910 - RNA, 19 nt, artificial
  Chemically synthesized
uugcguuccgcacacacug

SEQ ID NO: 10911 - RNA, 19 nt, artificial
  Chemically synthesized
ugauccggucucgucggcg

SEQ ID NO: 10912 - RNA, 19 nt, artificial
  Chemically synthesized
aaagcuccgaucuccgucc

SEQ ID NO: 10913 - RNA, 19 nt, artificial
  Chemically synthesized
ucccaaacuccgauagucc

SEQ ID NO: 10914 - RNA, 19 nt, artificial
  Chemically synthesized
uaaaacucaaccauccuuu

SEQ ID NO: 10915 - RNA, 19 nt, artificial
  Chemically synthesized
ucuccgucuuuuucuggcc

SEQ ID NO: 10916 - RNA, 19 nt, artificial
  Chemically synthesized
aaaucaaagagaaggaggc

SEQ ID NO: 10917 - RNA, 19 nt, artificial
  Chemically synthesized
uaaaaagcuccgaucuccg

SEQ ID NO: 10918 - RNA, 19 nt, artificial
  Chemically synthesized
auuugugaauuugagaucc

SEQ ID NO: 10919 - RNA, 19 nt, artificial
  Chemically synthesized
uucaccuuucugcuauagg

SEQ ID NO: 10920 - RNA, 19 nt, artificial
  Chemically synthesized
ugauguccgaagacggucc

SEQ ID NO: 10921 - RNA, 19 nt, artificial
  Chemically synthesized
uuuucuagcuuagcagauc

SEQ ID NO: 10922 - RNA, 19 nt, artificial
  Chemically synthesized
uuccgcacacacugauccc

SEQ ID NO: 10923 - RNA, 19 nt, artificial
  Chemically synthesized
acaguuuguacauucaccu

SEQ ID NO: 10924 - RNA, 19 nt, artificial
  Chemically synthesized
uauuccucuccgucuuuuu

SEQ ID NO: 10925 - RNA, 19 nt, artificial
  Chemically synthesized
ucguccgcacucuccuucu

SEQ ID NO: 10926 - RNA, 19 nt, artificial
  Chemically synthesized
aaacucaaccauccuuucc

SEQ ID NO: 10927 - RNA, 19 nt, artificial
  Chemically synthesized
aaaaguaaaccaacaaacc

SEQ ID NO: 10928 - RNA, 19 nt, artificial
  Chemically synthesized
aaagcacuggguaccagcc

SEQ ID NO: 10929 - RNA, 19 nt, artificial
  Chemically synthesized
uuugugaauuugagauccg

SEQ ID NO: 10930 - RNA, 19 nt, artificial
  Chemically synthesized
uuugccucugguuaaaacu

SEQ ID NO: 10931 - RNA, 19 nt, artificial
  Chemically synthesized
uaaaccaacaaaccuuuag

SEQ ID NO: 10932 - RNA, 19 nt, artificial
  Chemically synthesized
uugauccggucucgucggc

SEQ ID NO: 10933 - RNA, 19 nt, artificial
  Chemically synthesized
uaaccuaucagcggcucuc

SEQ ID NO: 10934 - RNA, 19 nt, artificial
  Chemically synthesized
aaaaacggaaucauucugg

SEQ ID NO: 10935 - RNA, 19 nt, artificial
  Chemically synthesized
aaccagucgaacucgaagc

SEQ ID NO: 10936 - RNA, 19 nt, artificial
  Chemically synthesized
uagcuuagcagaucccugc

SEQ ID NO: 10937 - RNA, 19 nt, artificial
  Chemically synthesized
caaguuuccauucucgucc

SEQ ID NO: 10938 - RNA, 19 nt, artificial
  Chemically synthesized
aaaacugcuaauacaugac

SEQ ID NO: 10939 - RNA, 19 nt, artificial
  Chemically synthesized
uuguacauucaccuuucug

SEQ ID NO: 10940 - RNA, 19 nt, artificial
  Chemically synthesized
uuccauucucguccgcacu

SEQ ID NO: 10941 - RNA, 19 nt, artificial
  Chemically synthesized
aaaucagaacugccagucc

SEQ ID NO: 10942 - RNA, 19 nt, artificial
  Chemically synthesized
ugcaccaaaaggaaaacuc

SEQ ID NO: 10943 - RNA, 19 nt, artificial
  Chemically synthesized
uguacuacucaauugacca

SEQ ID NO: 10944 - RNA, 19 nt, artificial
  Chemically synthesized
ucuuucuuggauaaagcug

SEQ ID NO: 10945 - RNA, 19 nt, artificial
  Chemically synthesized
uuggcuuauacucacuauu

SEQ ID NO: 10946 - RNA, 19 nt, artificial
  Chemically synthesized
uuuucuggccaaaaucugg

SEQ ID NO: 10947 - RNA, 19 nt, artificial
  Chemically synthesized
aaccacaguuccaugcacc

SEQ ID NO: 10948 - RNA, 19 nt, artificial
  Chemically synthesized
uacaacaccuuaaucuguc

SEQ ID NO: 10949 - RNA, 19 nt, artificial
  Chemically synthesized
acuucugccaggcauuccc

SEQ ID NO: 10950 - RNA, 19 nt, artificial
  Chemically synthesized
ucugggaagauguaguugg

SEQ ID NO: 10951 - RNA, 19 nt, artificial
  Chemically synthesized
aaaucccaaacuccgauag

SEQ ID NO: 10952 - RNA, 19 nt, artificial
  Chemically synthesized
aaaucugggaagauguagu

SEQ ID NO: 10953 - RNA, 19 nt, artificial
  Chemically synthesized
uuccacuguacuacucaau

SEQ ID NO: 10954 - RNA, 19 nt, artificial
  Chemically synthesized
guccgcacucuccuucucc

SEQ ID NO: 10955 - RNA, 19 nt, artificial
  Chemically synthesized
aaacuguuauugauccggu

SEQ ID NO: 10956 - RNA, 19 nt, artificial
  Chemically synthesized
uuuccuuuccaccaacacu

SEQ ID NO: 10957 - RNA, 19 nt, artificial
  Chemically synthesized
uucucagcucagacaaacu

SEQ ID NO: 10958 - RNA, 19 nt, artificial
  Chemically synthesized
uucuuucuuggauaaagcu

SEQ ID NO: 10959 - RNA, 19 nt, artificial
  Chemically synthesized
acuggguaccagccuucuc

SEQ ID NO: 10960 - RNA, 19 nt, artificial
  Chemically synthesized
aacucaaguuuccauucuc

SEQ ID NO: 10961 - RNA, 19 nt, artificial
  Chemically synthesized
uuuuucuggccaaaaucug

SEQ ID NO: 10962 - RNA, 19 nt, artificial
  Chemically synthesized
ucuaguccuucaaugaugc

SEQ ID NO: 10963 - RNA, 19 nt, artificial
  Chemically synthesized
ucccgaaaucccaaacucc

SEQ ID NO: 10964 - RNA, 19 nt, artificial
  Chemically synthesized
uugagaugcgaaaccaguc

SEQ ID NO: 10965 - RNA, 19 nt, artificial
  Chemically synthesized
aaaagcacuggguaccagc

SEQ ID NO: 10966 - RNA, 19 nt, artificial
  Chemically synthesized
aauucuuuguguugcuggg

SEQ ID NO: 10967 - RNA, 19 nt, artificial
  Chemically synthesized
auuuucaggugauccacgg

SEQ ID NO: 10968 - RNA, 19 nt, artificial
  Chemically synthesized
uuucuggccaaaaucuggg

SEQ ID NO: 10969 - RNA, 19 nt, artificial
  Chemically synthesized
guuccgcacacacugaucc

SEQ ID NO: 10970 - RNA, 19 nt, artificial
  Chemically synthesized
uugccucugguuaaaacuc

SEQ ID NO: 10971 - RNA, 19 nt, artificial
  Chemically synthesized
uuaaauaccuuggcaacca

SEQ ID NO: 10972 - RNA, 19 nt, artificial
  Chemically synthesized
auuaggcacaguacaaacc

SEQ ID NO: 10973 - RNA, 19 nt, artificial
  Chemically synthesized
auuccucuccgucuuuuuc

SEQ ID NO: 10974 - RNA, 19 nt, artificial
  Chemically synthesized
ucaucugauuugucaacgc

SEQ ID NO: 10975 - RNA, 19 nt, artificial
  Chemically synthesized
uuuacuuuuacugacgacu

SEQ ID NO: 10976 - RNA, 19 nt, artificial
  Chemically synthesized
aucccaaacuccgauaguc

SEQ ID NO: 10977 - RNA, 19 nt, artificial
  Chemically synthesized
auaaaucaaagagaaggag

SEQ ID NO: 10978 - RNA, 19 nt, artificial
  Chemically synthesized
aaacagaccauaacuauac

SEQ ID NO: 10979 - RNA, 19 nt, artificial
  Chemically synthesized
auaguccauagcaagggcg

SEQ ID NO: 10980 - RNA, 19 nt, artificial
  Chemically synthesized
ucuucuuucuuggauaaag

SEQ ID NO: 10981 - RNA, 19 nt, artificial
  Chemically synthesized
uccucuccgucuuuuucug

SEQ ID NO: 10982 - RNA, 19 nt, artificial
  Chemically synthesized
uccauucucguccgcacuc

SEQ ID NO: 10983 - RNA, 19 nt, artificial
  Chemically synthesized
aaguguuggcuuauacuca

SEQ ID NO: 10984 - RNA, 19 nt, artificial
  Chemically synthesized
aaauuuugaggcaaaaacg

SEQ ID NO: 10985 - RNA, 19 nt, artificial
  Chemically synthesized
uagucuucuuucuuggaua

SEQ ID NO: 10986 - RNA, 19 nt, artificial
  Chemically synthesized
acuaaauguuaagauuccc

SEQ ID NO: 10987 - RNA, 19 nt, artificial
  Chemically synthesized
aaacccaguucaguggagg

SEQ ID NO: 10988 - RNA, 19 nt, artificial
  Chemically synthesized
aagguuugcagccugcgug

SEQ ID NO: 10989 - RNA, 19 nt, artificial
  Chemically synthesized
aaaccuaucacaaaguguu

SEQ ID NO: 10990 - RNA, 19 nt, artificial
  Chemically synthesized
ucuuggauaaagcugauca

SEQ ID NO: 10991 - RNA, 19 nt, artificial
  Chemically synthesized
uuuacugacgacuuuaagg

SEQ ID NO: 10992 - RNA, 19 nt, artificial
  Chemically synthesized
cauucucguccgcacucuc

SEQ ID NO: 10993 - RNA, 19 nt, artificial
  Chemically synthesized
aaguaaaccaacaaaccuu

SEQ ID NO: 10994 - RNA, 19 nt, artificial
  Chemically synthesized
ugugaauuugagauccgug

SEQ ID NO: 10995 - RNA, 19 nt, artificial
  Chemically synthesized
uccgcacucuccuucucca

SEQ ID NO: 10996 - RNA, 19 nt, artificial
  Chemically synthesized
uagcagaucccugcuucuc

SEQ ID NO: 10997 - RNA, 19 nt, artificial
  Chemically synthesized
ugcuucucaaaagcacugg

SEQ ID NO: 10998 - RNA, 19 nt, artificial
  Chemically synthesized
aaaguaaaccaacaaaccu

SEQ ID NO: 10999 - RNA, 19 nt, artificial
  Chemically synthesized
acuguuauugauccggucu

SEQ ID NO: 11000 - RNA, 19 nt, artificial
  Chemically synthesized
uacagcggcgccucuccgc

SEQ ID NO: 11001 - RNA, 19 nt, artificial
  Chemically synthesized
aaaugcaggcguauucuau

SEQ ID NO: 11002 - RNA, 19 nt, artificial
  Chemically synthesized
aauaccuuggcaaccacag

SEQ ID NO: 11003 - RNA, 19 nt, artificial
  Chemically synthesized
ucugguuaaaacucaacca

SEQ ID NO: 11004 - RNA, 19 nt, artificial
  Chemically synthesized
aacuucugccaggcauucc

SEQ ID NO: 11005 - RNA, 19 nt, artificial
  Chemically synthesized
aauugaccacucgcacacc

SEQ ID NO: 11006 - RNA, 19 nt, artificial
  Chemically synthesized
acaaacuguuauugauccg

SEQ ID NO: 11007 - RNA, 19 nt, artificial
  Chemically synthesized
aguccuucaaugaugcuca

SEQ ID NO: 11008 - RNA, 19 nt, artificial
  Chemically synthesized
aaugaugcucagauaacgc

SEQ ID NO: 11009 - RNA, 19 nt, artificial
  Chemically synthesized
aucaucugauuugucaacg

SEQ ID NO: 11010 - RNA, 19 nt, artificial
  Chemically synthesized
ucaaaguaaccuuucccuc

SEQ ID NO: 11011 - RNA, 19 nt, artificial
  Chemically synthesized
ugcgaaaccagucgaacuc

SEQ ID NO: 11012 - RNA, 19 nt, artificial
  Chemically synthesized
uggguaccagccuucucag

SEQ ID NO: 11013 - RNA, 19 nt, artificial
  Chemically synthesized
guuguugagaugcgaaacc

SEQ ID NO: 11014 - RNA, 19 nt, artificial
  Chemically synthesized
gucaucugcaggaucucgg

SEQ ID NO: 11015 - RNA, 19 nt, artificial
  Chemically synthesized
acaaggagaaaaacagacc

SEQ ID NO: 11016 - RNA, 19 nt, artificial
  Chemically synthesized
aguguuggcuuauacucac

SEQ ID NO: 11017 - RNA, 19 nt, artificial
  Chemically synthesized
ugguuaaaacucaaccauc

SEQ ID NO: 11018 - RNA, 19 nt, artificial
  Chemically synthesized
aaacuccgauaguccauag

SEQ ID NO: 11019 - RNA, 19 nt, artificial
  Chemically synthesized
uaaauaccuuggcaaccac

SEQ ID NO: 11020 - RNA, 19 nt, artificial
  Chemically synthesized
uuguugagaugcgaaacca

SEQ ID NO: 11021 - RNA, 19 nt, artificial
  Chemically synthesized
uuugcagccugcgugggug

SEQ ID NO: 11022 - RNA, 19 nt, artificial
  Chemically synthesized
aauuauuccucuccgucuu

SEQ ID NO: 11023 - RNA, 19 nt, artificial
  Chemically synthesized
ucggcugcuugcguuccgc

SEQ ID NO: 11024 - RNA, 19 nt, artificial
  Chemically synthesized
acugcuaauacaugacaug

SEQ ID NO: 11025 - RNA, 19 nt, artificial
  Chemically synthesized
ucgauggucucguccagcu

SEQ ID NO: 11026 - RNA, 19 nt, artificial
  Chemically synthesized
uuuaaaaagcuccgaucuc

SEQ ID NO: 11027 - RNA, 19 nt, artificial
  Chemically synthesized
ugagcucgcuucaugcugg

SEQ ID NO: 11028 - RNA, 19 nt, artificial
  Chemically synthesized
auuaccuucaguuuccuuu

SEQ ID NO: 11029 - RNA, 19 nt, artificial
  Chemically synthesized
auggucucguccagcucgc

SEQ ID NO: 11030 - RNA, 19 nt, artificial
  Chemically synthesized
ucgcaaagcaggcgccucc

SEQ ID NO: 11031 - RNA, 19 nt, artificial
  Chemically synthesized
aaccaacaaaccuuuaguc

SEQ ID NO: 11032 - RNA, 19 nt, artificial
  Chemically synthesized
uccuuucccacgcugagcc

SEQ ID NO: 11033 - RNA, 19 nt, artificial
  Chemically synthesized
uucaguuuccuuuccacca

SEQ ID NO: 11034 - RNA, 19 nt, artificial
  Chemically synthesized
aacacuccaaaugagaccu

SEQ ID NO: 11035 - RNA, 19 nt, artificial
  Chemically synthesized
uccuuuccaccaacacucc

SEQ ID NO: 11036 - RNA, 19 nt, artificial
  Chemically synthesized
uccaccaacacuccaaaug

SEQ ID NO: 11037 - RNA, 19 nt, artificial
  Chemically synthesized
uugucaacgcuuugcucag

SEQ ID NO: 11038 - RNA, 19 nt, artificial
  Chemically synthesized
ugcuaaaagaauaaaccug

SEQ ID NO: 11039 - RNA, 19 nt, artificial
  Chemically synthesized
cuucuuucuuggauaaagc

SEQ ID NO: 11040 - RNA, 19 nt, artificial
  Chemically synthesized
ucaccuuucugcuauagga

SEQ ID NO: 11041 - RNA, 19 nt, artificial
  Chemically synthesized
aaucagaacugccaguccu

SEQ ID NO: 11042 - RNA, 19 nt, artificial
  Chemically synthesized
uccgauaguccauagcaag

SEQ ID NO: 11043 - RNA, 19 nt, artificial
  Chemically synthesized
ucucggcugcuugcguucc

SEQ ID NO: 11044 - RNA, 19 nt, artificial
  Chemically synthesized
uuuguacauucaccuuucu

SEQ ID NO: 11045 - RNA, 19 nt, artificial
  Chemically synthesized
cuucaguuuccuuuccacc

SEQ ID NO: 11046 - RNA, 19 nt, artificial
  Chemically synthesized
uuaggcacaguacaaaccu

SEQ ID NO: 11047 - RNA, 19 nt, artificial
  Chemically synthesized
aaguuuccauucucguccg

SEQ ID NO: 11048 - RNA, 19 nt, artificial
  Chemically synthesized
uggauaaagcugaucaucu

SEQ ID NO: 11049 - RNA, 19 nt, artificial
  Chemically synthesized
uuuuucuagcuuagcagau

SEQ ID NO: 11050 - RNA, 19 nt, artificial
  Chemically synthesized
acucaaguuuccauucucg

SEQ ID NO: 11051 - RNA, 19 nt, artificial
  Chemically synthesized
uuuuaaauaccuuggcaac

SEQ ID NO: 11052 - RNA, 19 nt, artificial
  Chemically synthesized
cagccuucucagcucagac

SEQ ID NO: 11053 - RNA, 19 nt, artificial
  Chemically synthesized
aaacugcuaauacaugaca

SEQ ID NO: 11054 - RNA, 19 nt, artificial
  Chemically synthesized
cucugguuaaaacucaacc

SEQ ID NO: 11055 - RNA, 19 nt, artificial
  Chemically synthesized
ggacauggaaccuagagcc

SEQ ID NO: 11056 - RNA, 19 nt, artificial
  Chemically synthesized
uucuuuaaaaagcuccgau

SEQ ID NO: 11057 - RNA, 19 nt, artificial
  Chemically synthesized
cucguccgcacucuccuuc

SEQ ID NO: 11058 - RNA, 19 nt, artificial
  Chemically synthesized
uuauuccucuccgucuuuu

SEQ ID NO: 11059 - RNA, 19 nt, artificial
  Chemically synthesized
uguugagaugcgaaaccag

SEQ ID NO: 11060 - RNA, 19 nt, artificial
  Chemically synthesized
ugauccacggucaucugca

SEQ ID NO: 11061 - RNA, 19 nt, artificial
  Chemically synthesized
caacacuccaaaugagacc

SEQ ID NO: 11062 - RNA, 19 nt, artificial
  Chemically synthesized
cucuccgucuuuuucuggc

SEQ ID NO: 11063 - RNA, 19 nt, artificial
  Chemically synthesized
aucucggcuuuuucuagcu

SEQ ID NO: 11064 - RNA, 19 nt, artificial
  Chemically synthesized
uuagcagaucccugcuucu

SEQ ID NO: 11065 - RNA, 19 nt, artificial
  Chemically synthesized
acaaaguguuggcuuauac

SEQ ID NO: 11066 - RNA, 19 nt, artificial
  Chemically synthesized
ugaauuugagauccgugug

SEQ ID NO: 11067 - RNA, 19 nt, artificial
  Chemically synthesized
uggucagauggauucaggg

SEQ ID NO: 11068 - RNA, 19 nt, artificial
  Chemically synthesized
aauuuugaggcaaaaacgg

SEQ ID NO: 11069 - RNA, 19 nt, artificial
  Chemically synthesized
acacugaucccgcucacgc

SEQ ID NO: 11070 - RNA, 19 nt, artificial
  Chemically synthesized
uccgcucucggcugcuugc

SEQ ID NO: 11071 - RNA, 19 nt, artificial
  Chemically synthesized
cuguuauugauccggucuc

SEQ ID NO: 11072 - RNA, 19 nt, artificial
  Chemically synthesized
agaaggaggcaggaaagcc

SEQ ID NO: 11073 - RNA, 19 nt, artificial
  Chemically synthesized
uccaccucgauggucucgu

SEQ ID NO: 11074 - RNA, 19 nt, artificial
  Chemically synthesized
uuugagauccgugugauua

SEQ ID NO: 11075 - RNA, 19 nt, artificial
  Chemically synthesized
uuaacuacagcggcgccuc

SEQ ID NO: 11076 - RNA, 19 nt, artificial
  Chemically synthesized
aaagcccuuuuaaauaccu

SEQ ID NO: 11077 - RNA, 19 nt, artificial
  Chemically synthesized
acaguuuccacuguacuac

SEQ ID NO: 11078 - RNA, 19 nt, artificial
  Chemically synthesized
uccgcacacacugaucccg

SEQ ID NO: 11079 - RNA, 19 nt, artificial
  Chemically synthesized
cuguacuacucaauugacc

SEQ ID NO: 11080 - RNA, 19 nt, artificial
  Chemically synthesized
aacugcuaauacaugacau

SEQ ID NO: 11081 - RNA, 19 nt, artificial
  Chemically synthesized
acaccaugaucacuuaucc

SEQ ID NO: 11082 - RNA, 19 nt, artificial
  Chemically synthesized
uucccguggccguucuggg

SEQ ID NO: 11083 - RNA, 19 nt, artificial
  Chemically synthesized
uccgaggagcuguacucgg

SEQ ID NO: 11084 - RNA, 19 nt, artificial
  Chemically synthesized
uuaaaacucaaccauccuu

SEQ ID NO: 11085 - RNA, 19 nt, artificial
  Chemically synthesized
ggcgcuucucaauuauucc

SEQ ID NO: 11086 - RNA, 19 nt, artificial
  Chemically synthesized
uuaagcauagugguuugga

SEQ ID NO: 11087 - RNA, 19 nt, artificial
  Chemically synthesized
ucaaagagaaggaggcagg

SEQ ID NO: 11088 - RNA, 19 nt, artificial
  Chemically synthesized
ucguccagcucgcuguccg

SEQ ID NO: 11089 - RNA, 19 nt, artificial
  Chemically synthesized
ugggauuuuaaacuuuccc

SEQ ID NO: 11090 - RNA, 19 nt, artificial
  Chemically synthesized
uaacauuaagcauaguggu

SEQ ID NO: 11091 - RNA, 19 nt, artificial
  Chemically synthesized
uuacugacgacuuuaaggu

SEQ ID NO: 11092 - RNA, 19 nt, artificial
  Chemically synthesized
uucucaaaagcacugggua

SEQ ID NO: 11093 - RNA, 19 nt, artificial
  Chemically synthesized
aaaacucaaccauccuuuc

SEQ ID NO: 11094 - RNA, 19 nt, artificial
  Chemically synthesized
aauuaggcacaguacaaac

SEQ ID NO: 11095 - RNA, 19 nt, artificial
  Chemically synthesized
gacaaacuguuauugaucc

SEQ ID NO: 11096 - RNA, 19 nt, artificial
  Chemically synthesized
uuaaggugauguuggcaac

SEQ ID NO: 11097 - RNA, 19 nt, artificial
  Chemically synthesized
cuggguaccagccuucuca

SEQ ID NO: 11098 - RNA, 19 nt, artificial
  Chemically synthesized
aauguguccgaggcccgcg

SEQ ID NO: 11099 - RNA, 19 nt, artificial
  Chemically synthesized
aaaccagucgaacucgaag

SEQ ID NO: 11100 - RNA, 19 nt, artificial
  Chemically synthesized
augcaggcguauucuauuc

SEQ ID NO: 11101 - RNA, 19 nt, artificial
  Chemically synthesized
ccuaucagcggcucucucc

SEQ ID NO: 11102 - RNA, 19 nt, artificial
  Chemically synthesized
uagagccgaacucaaguuu

SEQ ID NO: 11103 - RNA, 19 nt, artificial
  Chemically synthesized
uucaggugauccacgguca

SEQ ID NO: 11104 - RNA, 19 nt, artificial
  Chemically synthesized
cguauucuauucaauuacc

SEQ ID NO: 11105 - RNA, 19 nt, artificial
  Chemically synthesized
aucaguacaacagagguca

SEQ ID NO: 11106 - RNA, 19 nt, artificial
  Chemically synthesized
ucucuccuaacuaaaucag

SEQ ID NO: 11107 - RNA, 19 nt, artificial
  Chemically synthesized
caauugaccacucgcacac

SEQ ID NO: 11108 - RNA, 19 nt, artificial
  Chemically synthesized
ucuuuuucuggccaaaauc

SEQ ID NO: 11109 - RNA, 19 nt, artificial
  Chemically synthesized
aucccgcucacgcuuugcc

SEQ ID NO: 11110 - RNA, 19 nt, artificial
  Chemically synthesized
uaccagccuucucagcuca

SEQ ID NO: 11111 - RNA, 19 nt, artificial
  Chemically synthesized
auucccgaaaucccaaacu

SEQ ID NO: 11112 - RNA, 19 nt, artificial
  Chemically synthesized
cuucucagcucagacaaac

SEQ ID NO: 11113 - RNA, 19 nt, artificial
  Chemically synthesized
uguuggcaacaguccagcc

SEQ ID NO: 11114 - RNA, 19 nt, artificial
  Chemically synthesized
ucaaccauccuuucccacg

SEQ ID NO: 11115 - RNA, 19 nt, artificial
  Chemically synthesized
gauuugucaacgcuuugcu

SEQ ID NO: 11116 - RNA, 19 nt, artificial
  Chemically synthesized
guacauucaccuuucugcu

SEQ ID NO: 11117 - RNA, 19 nt, artificial
  Chemically synthesized
cgcacucuccuucuccacc

SEQ ID NO: 11118 - RNA, 19 nt, artificial
  Chemically synthesized
uuuuacugacgacuuuaag

SEQ ID NO: 11119 - RNA, 19 nt, artificial
  Chemically synthesized
aaccuaucagcggcucucu

SEQ ID NO: 11120 - RNA, 19 nt, artificial
  Chemically synthesized
acucuccuucuccaccucg

SEQ ID NO: 11121 - RNA, 19 nt, artificial
  Chemically synthesized
auccggucucgucggcgcu

SEQ ID NO: 11122 - RNA, 19 nt, artificial
  Chemically synthesized
ucuuuaaaaagcuccgauc

SEQ ID NO: 11123 - RNA, 19 nt, artificial
  Chemically synthesized
accuagagccgaacucaag

SEQ ID NO: 11124 - RNA, 19 nt, artificial
  Chemically synthesized
aaaaucugggaagauguag

SEQ ID NO: 11125 - RNA, 19 nt, artificial
  Chemically synthesized
aacucgaagcgggucagag

SEQ ID NO: 11126 - RNA, 19 nt, artificial
  Chemically synthesized
acuacucaauugaccacuc

SEQ ID NO: 11127 - RNA, 19 nt, artificial
  Chemically synthesized
acuaaaucagaacugccag

SEQ ID NO: 11128 - RNA, 19 nt, artificial
  Chemically synthesized
acugaggagagcagaggcg

SEQ ID NO: 11129 - RNA, 19 nt, artificial
  Chemically synthesized
aaggagccgaaagagaagg

SEQ ID NO: 11130 - RNA, 19 nt, artificial
  Chemically synthesized
cuuucuuggauaaagcuga

SEQ ID NO: 11131 - RNA, 19 nt, artificial
  Chemically synthesized
gauccggucucgucggcgc

SEQ ID NO: 11132 - RNA, 19 nt, artificial
  Chemically synthesized
caacacaucaguacaacag

SEQ ID NO: 11133 - RNA, 19 nt, artificial
  Chemically synthesized
aagggcucagugcauuggg

SEQ ID NO: 11134 - RNA, 19 nt, artificial
  Chemically synthesized
auguuggcaacaguccagc

SEQ ID NO: 11135 - RNA, 19 nt, artificial
  Chemically synthesized
acuguacuacucaauugac

SEQ ID NO: 11136 - RNA, 19 nt, artificial
  Chemically synthesized
aggugauccacggucaucu

SEQ ID NO: 11137 - RNA, 19 nt, artificial
  Chemically synthesized
gaucucggcuuuuucuagc

SEQ ID NO: 11138 - RNA, 19 nt, artificial
  Chemically synthesized
ucggcuuuuucuagcuuag

SEQ ID NO: 11139 - RNA, 19 nt, artificial
  Chemically synthesized
uuaacaguuuccacuguac

SEQ ID NO: 11140 - RNA, 19 nt, artificial
  Chemically synthesized
uugaccacucgcacaccau

SEQ ID NO: 11141 - RNA, 19 nt, artificial
  Chemically synthesized
ucagcucagacaaacuguu

SEQ ID NO: 11142 - RNA, 19 nt, artificial
  Chemically synthesized
uagguuaugcauuuaacag

SEQ ID NO: 11143 - RNA, 19 nt, artificial
  Chemically synthesized
aacuacagcggcgccucuc

SEQ ID NO: 11144 - RNA, 19 nt, artificial
  Chemically synthesized
cucgcuucaugcuggcucc

SEQ ID NO: 11145 - RNA, 19 nt, artificial
  Chemically synthesized
aguucuuuaaaaagcuccg

SEQ ID NO: 11146 - RNA, 19 nt, artificial
  Chemically synthesized
aaauaccuuggcaaccaca

SEQ ID NO: 11147 - RNA, 19 nt, artificial
  Chemically synthesized
uguuggcuuauacucacua

SEQ ID NO: 11148 - RNA, 19 nt, artificial
  Chemically synthesized
ucaauugaccacucgcaca

SEQ ID NO: 11149 - RNA, 19 nt, artificial
  Chemically synthesized
accaacaguuuguacauuc

SEQ ID NO: 11150 - RNA, 19 nt, artificial
  Chemically synthesized
cgcuucucaauuauuccuc

SEQ ID NO: 11151 - RNA, 19 nt, artificial
  Chemically synthesized
cuucucaauuauuccucuc

SEQ ID NO: 11152 - RNA, 19 nt, artificial
  Chemically synthesized
aucauucugguuuacaaag

SEQ ID NO: 11153 - RNA, 19 nt, artificial
  Chemically synthesized
uagggcuugccaagguuug

SEQ ID NO: 11154 - RNA, 19 nt, artificial
  Chemically synthesized
acucaauugaccacucgca

SEQ ID NO: 11155 - RNA, 19 nt, artificial
  Chemically synthesized
ucuagcuuagcagaucccu

SEQ ID NO: 11156 - RNA, 19 nt, artificial
  Chemically synthesized
aguacaacagaggucaaac

SEQ ID NO: 11157 - RNA, 19 nt, artificial
  Chemically synthesized
aagcugaucaucugauuug

SEQ ID NO: 11158 - RNA, 19 nt, artificial
  Chemically synthesized
accaacaaaccuuuagucu

SEQ ID NO: 11159 - RNA, 19 nt, artificial
  Chemically synthesized
auccauguuaacauuugug

SEQ ID NO: 11160 - RNA, 19 nt, artificial
  Chemically synthesized
uccgugugauuaaaaauuc

SEQ ID NO: 11161 - RNA, 19 nt, artificial
  Chemically synthesized
uaacaguuuccacuguacu

SEQ ID NO: 11162 - RNA, 19 nt, artificial
  Chemically synthesized
aaugcaggcguauucuauu

SEQ ID NO: 11163 - RNA, 19 nt, artificial
  Chemically synthesized
agcccuuuuaaauaccuug

SEQ ID NO: 11164 - RNA, 19 nt, artificial
  Chemically synthesized
ccugcuaaaagaauaaacc

SEQ ID NO: 11165 - RNA, 19 nt, artificial
  Chemically synthesized
uccagcucgcuguccgagg

SEQ ID NO: 11166 - RNA, 19 nt, artificial
  Chemically synthesized
aggucuauagggcuugcca

SEQ ID NO: 11167 - RNA, 19 nt, artificial
  Chemically synthesized
uugugaauuugagauccgu

SEQ ID NO: 11168 - RNA, 19 nt, artificial
  Chemically synthesized
aaucccaaacuccgauagu

SEQ ID NO: 11169 - RNA, 19 nt, artificial
  Chemically synthesized
caaaguaaccuuucccucc

SEQ ID NO: 11170 - RNA, 19 nt, artificial
  Chemically synthesized
aagaaaauauggcaguccc

SEQ ID NO: 11171 - RNA, 19 nt, artificial
  Chemically synthesized
ugcauugggagacaguaag

SEQ ID NO: 11172 - RNA, 19 nt, artificial
  Chemically synthesized
guuuguacauucaccuuuc

SEQ ID NO: 11173 - RNA, 19 nt, artificial
  Chemically synthesized
agccuucucagcucagaca

SEQ ID NO: 11174 - RNA, 19 nt, artificial
  Chemically synthesized
acuacagcggcgccucucc

SEQ ID NO: 11175 - RNA, 19 nt, artificial
  Chemically synthesized
aauuugagauccgugugau

SEQ ID NO: 11176 - RNA, 19 nt, artificial
  Chemically synthesized
ugguggugcgguuccgugg

SEQ ID NO: 11177 - RNA, 19 nt, artificial
  Chemically synthesized
aacggaaucauucugguuu

SEQ ID NO: 11178 - RNA, 19 nt, artificial
  Chemically synthesized
uaaagcugaucaucugauu

SEQ ID NO: 11179 - RNA, 19 nt, artificial
  Chemically synthesized
auaaagcugaucaucugau

SEQ ID NO: 11180 - RNA, 19 nt, artificial
  Chemically synthesized
uauaggaggcagacaauuu

SEQ ID NO: 11181 - RNA, 19 nt, artificial
  Chemically synthesized
gaaggaggcaggaaagccc

SEQ ID NO: 11182 - RNA, 19 nt, artificial
  Chemically synthesized
gcuuuuucuagcuuagcag

SEQ ID NO: 11183 - RNA, 19 nt, artificial
  Chemically synthesized
caguucuuuaaaaagcucc

SEQ ID NO: 11184 - RNA, 19 nt, artificial
  Chemically synthesized
uacaaaccuaucacaaagu

SEQ ID NO: 11185 - RNA, 19 nt, artificial
  Chemically synthesized
aguuuccacuguacuacuc

SEQ ID NO: 11186 - RNA, 19 nt, artificial
  Chemically synthesized
ucucaaaagcacuggguac

SEQ ID NO: 11187 - RNA, 19 nt, artificial
  Chemically synthesized
acacaucaguacaacagag

SEQ ID NO: 11188 - RNA, 19 nt, artificial
  Chemically synthesized
ucucguccgcacucuccuu

SEQ ID NO: 11189 - RNA, 19 nt, artificial
  Chemically synthesized
aucccugcuucucaaaagc

SEQ ID NO: 11190 - RNA, 19 nt, artificial
  Chemically synthesized
aaaacggaaucauucuggu

SEQ ID NO: 11191 - RNA, 19 nt, artificial
  Chemically synthesized
acuccgauaguccauagca

SEQ ID NO: 11192 - RNA, 19 nt, artificial
  Chemically synthesized
uaugcagcauuuucaggug

SEQ ID NO: 11193 - RNA, 19 nt, artificial
  Chemically synthesized
accuaucagcggcucucuc

SEQ ID NO: 11194 - RNA, 19 nt, artificial
  Chemically synthesized
guuauugauccggucucgu

SEQ ID NO: 11195 - RNA, 19 nt, artificial
  Chemically synthesized
ucauucugguuuacaaagu

SEQ ID NO: 11196 - RNA, 19 nt, artificial
  Chemically synthesized
agucccaggaaaauuaggu

SEQ ID NO: 11197 - RNA, 19 nt, artificial
  Chemically synthesized
accuuucugcuauaggagg

SEQ ID NO: 11198 - RNA, 19 nt, artificial
  Chemically synthesized
ggaaccuagagccgaacuc

SEQ ID NO: 11199 - RNA, 19 nt, artificial
  Chemically synthesized
cuuuuuacuuuuacugacg

SEQ ID NO: 11200 - RNA, 19 nt, artificial
  Chemically synthesized
aguuccaugcaccaaaagg

SEQ ID NO: 11201 - RNA, 19 nt, artificial
  Chemically synthesized
ugaagggcucagugcauug

SEQ ID NO: 11202 - RNA, 19 nt, artificial
  Chemically synthesized
gguaccagccuucucagcu

SEQ ID NO: 11203 - RNA, 19 nt, artificial
  Chemically synthesized
aaguggaaggagccgaaag

SEQ ID NO: 11204 - RNA, 19 nt, artificial
  Chemically synthesized
aagcacuggguaccagccu

SEQ ID NO: 11205 - RNA, 19 nt, artificial
  Chemically synthesized
uuuuacuuuuacugacgac

SEQ ID NO: 11206 - RNA, 19 nt, artificial
  Chemically synthesized
uugccaagguuugcagccu

SEQ ID NO: 11207 - RNA, 19 nt, artificial
  Chemically synthesized
ucuauucaauuaccuucag

SEQ ID NO: 11208 - RNA, 19 nt, artificial
  Chemically synthesized
auucaccuuucugcuauag

SEQ ID NO: 11209 - RNA, 19 nt, artificial
  Chemically synthesized
cuugccaagguuugcagcc

SEQ ID NO: 11210 - RNA, 19 nt, artificial
  Chemically synthesized
uauagggcuugccaagguu

SEQ ID NO: 11211 - RNA, 19 nt, artificial
  Chemically synthesized
ucgcacaccaugaucacuu

SEQ ID NO: 11212 - RNA, 19 nt, artificial
  Chemically synthesized
auugaccacucgcacacca

SEQ ID NO: 11213 - RNA, 19 nt, artificial
  Chemically synthesized
uccacuguacuacucaauu

SEQ ID NO: 11214 - RNA, 19 nt, artificial
  Chemically synthesized
gaaagcccuuuuaaauacc

SEQ ID NO: 11215 - RNA, 19 nt, artificial
  Chemically synthesized
ucuccuucuccaccucgau

SEQ ID NO: 11216 - RNA, 19 nt, artificial
  Chemically synthesized
aaaauauggcagucccagg

SEQ ID NO: 11217 - RNA, 19 nt, artificial
  Chemically synthesized
uucaugcuggcucccuggg

SEQ ID NO: 11218 - RNA, 19 nt, artificial
  Chemically synthesized
uucagggccaccaacaguu

SEQ ID NO: 11219 - RNA, 19 nt, artificial
  Chemically synthesized
ugaucaucugauuugucaa

SEQ ID NO: 11220 - RNA, 19 nt, artificial
  Chemically synthesized
uaccuuggcaaccacaguu

SEQ ID NO: 11221 - RNA, 19 nt, artificial
  Chemically synthesized
accugcuaaaagaauaaac

SEQ ID NO: 11222 - RNA, 19 nt, artificial
  Chemically synthesized
uggcuuauacucacuauuu

SEQ ID NO: 11223 - RNA, 19 nt, artificial
  Chemically synthesized
aguccuggcagauaccagc

SEQ ID NO: 11224 - RNA, 19 nt, artificial
  Chemically synthesized
uuggcaaccacaguuccau

SEQ ID NO: 11225 - RNA, 19 nt, artificial
  Chemically synthesized
uggucucguccagcucgcu

SEQ ID NO: 11226 - RNA, 19 nt, artificial
  Chemically synthesized
cuaacuaaaucagaacugc

SEQ ID NO: 11227 - RNA, 19 nt, artificial
  Chemically synthesized
caacagaggucaaacccag

SEQ ID NO: 11228 - RNA, 19 nt, artificial
  Chemically synthesized
aaaauucuuuguguugcug

SEQ ID NO: 11229 - RNA, 19 nt, artificial
  Chemically synthesized
agagccgaacucaaguuuc

SEQ ID NO: 11230 - RNA, 19 nt, artificial
  Chemically synthesized
ucuccaccucgauggucuc

SEQ ID NO: 11231 - RNA, 19 nt, artificial
  Chemically synthesized
ugcaggcguauucuauuca

SEQ ID NO: 11232 - RNA, 19 nt, artificial
  Chemically synthesized
caaaguguuggcuuauacu

SEQ ID NO: 11233 - RNA, 19 nt, artificial
  Chemically synthesized
cucgauggucucguccagc

SEQ ID NO: 11234 - RNA, 19 nt, artificial
  Chemically synthesized
agacaauuuacuagucuuc

SEQ ID NO: 11235 - RNA, 19 nt, artificial
  Chemically synthesized
ugcgugggugcugaagggc

SEQ ID NO: 11236 - RNA, 19 nt, artificial
  Chemically synthesized
guaccagccuucucagcuc

SEQ ID NO: 11237 - RNA, 19 nt, artificial
  Chemically synthesized
uuucuuggauaaagcugau

SEQ ID NO: 11238 - RNA, 19 nt, artificial
  Chemically synthesized
ucagcggcucucuccuaac

SEQ ID NO: 11239 - RNA, 19 nt, artificial
  Chemically synthesized
aguuuccauucucguccgc

SEQ ID NO: 11240 - RNA, 19 nt, artificial
  Chemically synthesized
uuuucaggugauccacggu

SEQ ID NO: 11241 - RNA, 19 nt, artificial
  Chemically synthesized
ucugauuugucaacgcuuu

SEQ ID NO: 11242 - RNA, 19 nt, artificial
  Chemically synthesized
ugauguuggcaacagucca

SEQ ID NO: 11243 - RNA, 19 nt, artificial
  Chemically synthesized
gcacucuccuucuccaccu

SEQ ID NO: 11244 - RNA, 19 nt, artificial
  Chemically synthesized
cacaucaguacaacagagg

SEQ ID NO: 11245 - RNA, 19 nt, artificial
  Chemically synthesized
aagcguaguuguugagaug

SEQ ID NO: 11246 - RNA, 19 nt, artificial
  Chemically synthesized
cuagcuuagcagaucccug

SEQ ID NO: 11247 - RNA, 19 nt, artificial
  Chemically synthesized
uccgaggcugccgcuaggg

SEQ ID NO: 11248 - RNA, 19 nt, artificial
  Chemically synthesized
uugggagacaguaagugga

SEQ ID NO: 11249 - RNA, 19 nt, artificial
  Chemically synthesized
uaguccauagcaagggcgu

SEQ ID NO: 11250 - RNA, 19 nt, artificial
  Chemically synthesized
caccuuucugcuauaggag

SEQ ID NO: 11251 - RNA, 19 nt, artificial
  Chemically synthesized
cuucucaaaagcacugggu

SEQ ID NO: 11252 - RNA, 19 nt, artificial
  Chemically synthesized
aucugauuugucaacgcuu

SEQ ID NO: 11253 - RNA, 19 nt, artificial
  Chemically synthesized
gguuaaaacucaaccaucc

SEQ ID NO: 11254 - RNA, 19 nt, artificial
  Chemically synthesized
uuuccacuguacuacucaa

SEQ ID NO: 11255 - RNA, 19 nt, artificial
  Chemically synthesized
augaugcucagauaacgcg

SEQ ID NO: 11256 - RNA, 19 nt, artificial
  Chemically synthesized
ucgucggcgcuucucaauu

SEQ ID NO: 11257 - RNA, 19 nt, artificial
  Chemically synthesized
uacaccugcuaaaagaaua

SEQ ID NO: 11258 - RNA, 19 nt, artificial
  Chemically synthesized
auggaaccuagagccgaac

SEQ ID NO: 11259 - RNA, 19 nt, artificial
  Chemically synthesized
aguaaaccaacaaaccuuu

SEQ ID NO: 11260 - RNA, 19 nt, artificial
  Chemically synthesized
gaaccuagagccgaacuca

SEQ ID NO: 11261 - RNA, 19 nt, artificial
  Chemically synthesized
ugccucugguuaaaacuca

SEQ ID NO: 11262 - RNA, 19 nt, artificial
  Chemically synthesized
gcguauucuauucaauuac

SEQ ID NO: 11263 - RNA, 19 nt, artificial
  Chemically synthesized
agaccauaacuauacaagg

SEQ ID NO: 11264 - RNA, 19 nt, artificial
  Chemically synthesized
acaacagaggucaaaccca

SEQ ID NO: 11265 - RNA, 19 nt, artificial
  Chemically synthesized
augcgaaaccagucgaacu

SEQ ID NO: 11266 - RNA, 19 nt, Artificial Sequence
  Chemically synthesized
ccuuuuuacuuuuacugac

SEQ ID NO: 11267 - RNA, 19 nt, artificial
  Chemically synthesized
ggacgagaccaucgaggug

SEQ ID NO: 11268 - RNA, 19 nt, artificial
  Chemically synthesized
uuaucugagcaucauugaa

SEQ ID NO: 11269 - RNA, 19 nt, artificial
  Chemically synthesized
ccugcagaugaccguggau

SEQ ID NO: 11270 - RNA, 19 nt, artificial
  Chemically synthesized
acagcgagcuggacgagac

SEQ ID NO: 11271 - RNA, 19 nt, artificial
  Chemically synthesized
ugcggacgagaauggaaac

SEQ ID NO: 11272 - RNA, 19 nt, artificial
  Chemically synthesized
cgcacgcccuugcuaugga

SEQ ID NO: 11273 - RNA, 19 nt, artificial
  Chemically synthesized
gagccagcaugaagcgagc

SEQ ID NO: 11274 - RNA, 19 nt, artificial
  Chemically synthesized
ggaucaccugaaaaugcug

SEQ ID NO: 11275 - RNA, 19 nt, artificial
  Chemically synthesized
cccuugcuauggacuaucg

SEQ ID NO: 11276 - RNA, 19 nt, artificial
  Chemically synthesized
cccagugcuuuugagaagc

SEQ ID NO: 11277 - RNA, 19 nt, artificial
  Chemically synthesized
ugagaagcgccgacgagac

SEQ ID NO: 11278 - RNA, 19 nt, artificial
  Chemically synthesized
gcaucucaacaacuacgcu

SEQ ID NO: 11279 - RNA, 19 nt, artificial
  Chemically synthesized
ugagaagcagggaucugcu

SEQ ID NO: 11280 - RNA, 19 nt, artificial
  Chemically synthesized
cgagcuggacgagaccauc

SEQ ID NO: 11281 - RNA, 19 nt, artificial
  Chemically synthesized
aucugagcaucauugaagg

SEQ ID NO: 11282 - RNA, 19 nt, artificial
  Chemically synthesized
uggacgagaccaucgaggu

SEQ ID NO: 11283 - RNA, 19 nt, artificial
  Chemically synthesized
gacagcgagcuggacgaga

SEQ ID NO: 11284 - RNA, 19 nt, artificial
  Chemically synthesized
cuuggcaagcccuauagac

SEQ ID NO: 11285 - RNA, 19 nt, artificial
  Chemically synthesized
gagcuggacgagaccaucg

SEQ ID NO: 11286 - RNA, 19 nt, artificial
  Chemically synthesized
caauaacaguuugucugag

SEQ ID NO: 11287 - RNA, 19 nt, artificial
  Chemically synthesized
uauggacuaucggaguuug

SEQ ID NO: 11288 - RNA, 19 nt, artificial
  Chemically synthesized
ggcaggagggaaagguuac

SEQ ID NO: 11289 - RNA, 19 nt, artificial
  Chemically synthesized
gaagcagggaucugcuaag

SEQ ID NO: 11290 - RNA, 19 nt, artificial
  Chemically synthesized
ugacccgcuucgaguucga

SEQ ID NO: 11291 - RNA, 19 nt, artificial
  Chemically synthesized
gcucuagguuccauguccc

SEQ ID NO: 11292 - RNA, 19 nt, artificial
  Chemically synthesized
aaaccuuggcaagcccuau

SEQ ID NO: 11293 - RNA, 19 nt, artificial
  Chemically synthesized
ggccucggacacauucccu

SEQ ID NO: 11294 - RNA, 19 nt, artificial
  Chemically synthesized
gguacccagugcuuuugag

SEQ ID NO: 11295 - RNA, 19 nt, artificial
  Chemically synthesized
cuuugacgcgcacgcccuu

SEQ ID NO: 11296 - RNA, 19 nt, artificial
  Chemically synthesized
gaaggcugguacccagugc

SEQ ID NO: 11297 - RNA, 19 nt, artificial
  Chemically synthesized
cguggaucaccugaaaaug

SEQ ID NO: 11298 - RNA, 19 nt, artificial
  Chemically synthesized
agaaggcugguacccagug

SEQ ID NO: 11299 - RNA, 19 nt, artificial
  Chemically synthesized
acagcuccucggacagcga

SEQ ID NO: 11300 - RNA, 19 nt, artificial
  Chemically synthesized
aaggcugguacccagugcu

SEQ ID NO: 11301 - RNA, 19 nt, artificial
  Chemically synthesized
gaccaucgagguggagaag

SEQ ID NO: 11302 - RNA, 19 nt, artificial
  Chemically synthesized
cguuaucugagcaucauug

SEQ ID NO: 11303 - RNA, 19 nt, artificial
  Chemically synthesized
acgagaauggaaacuugag

SEQ ID NO: 11304 - RNA, 19 nt, artificial
  Chemically synthesized
auaacaguuugucugagcu

SEQ ID NO: 11305 - RNA, 19 nt, artificial
  Chemically synthesized
gcaaaccuuggcaagcccu

SEQ ID NO: 11306 - RNA, 19 nt, artificial
  Chemically synthesized
gcuccucggacagcgagcu

SEQ ID NO: 11307 - RNA, 19 nt, artificial
  Chemically synthesized
cugagcugagaaggcuggu

SEQ ID NO: 11308 - RNA, 19 nt, artificial
  Chemically synthesized
cgcgcacgcccuugcuaug

SEQ ID NO: 11309 - RNA, 19 nt, artificial
  Chemically synthesized
gccucggacacauucccug

SEQ ID NO: 11310 - RNA, 19 nt, artificial
  Chemically synthesized
uggaucaccugaaaaugcu

SEQ ID NO: 11311 - RNA, 19 nt, artificial
  Chemically synthesized
aucaauaacaguuugucug

SEQ ID NO: 11312 - RNA, 19 nt, artificial
  Chemically synthesized
gcccuugcuauggacuauc

SEQ ID NO: 11313 - RNA, 19 nt, artificial
  Chemically synthesized
uccugcagaugaccgugga

SEQ ID NO: 11314 - RNA, 19 nt, artificial
  Chemically synthesized
cagugcuuuugagaagcag

SEQ ID NO: 11315 - RNA, 19 nt, artificial
  Chemically synthesized
acaguuugucugagcugag

SEQ ID NO: 11316 - RNA, 19 nt, artificial
  Chemically synthesized
agugcuuuugagaagcagg

SEQ ID NO: 11317 - RNA, 19 nt, artificial
  Chemically synthesized
caagcccuauagaccuugg

SEQ ID NO: 11318 - RNA, 19 nt, artificial
  Chemically synthesized
caucgagguggagaaggag

SEQ ID NO: 11319 - RNA, 19 nt, artificial
  Chemically synthesized
agaauggaaacuugaguuc

SEQ ID NO: 11320 - RNA, 19 nt, artificial
  Chemically synthesized
ucugagcaucauugaagga

SEQ ID NO: 11321 - RNA, 19 nt, artificial
  Chemically synthesized
gaauggaaacuugaguucg

SEQ ID NO: 11322 - RNA, 19 nt, artificial
  Chemically synthesized
ccaacaucaccuuaaaguc

SEQ ID NO: 11323 - RNA, 19 nt, artificial
  Chemically synthesized
gcugagaaggcugguaccc

SEQ ID NO: 11324 - RNA, 19 nt, artificial
  Chemically synthesized
cuuuugagaagcagggauc

SEQ ID NO: 11325 - RNA, 19 nt, artificial
  Chemically synthesized
ugcuuuugagaagcaggga

SEQ ID NO: 11326 - RNA, 19 nt, artificial
  Chemically synthesized
gcacgcccuugcuauggac

SEQ ID NO: 11327 - RNA, 19 nt, artificial
  Chemically synthesized
agccagcaugaagcgagcu

SEQ ID NO: 11328 - RNA, 19 nt, artificial
  Chemically synthesized
gcaagcccuauagaccuug

SEQ ID NO: 11329 - RNA, 19 nt, artificial
  Chemically synthesized
cacgcccuugcuauggacu

SEQ ID NO: 11330 - RNA, 19 nt, artificial
  Chemically synthesized
gcuaagcuagaaaaagccg

SEQ ID NO: 11331 - RNA, 19 nt, artificial
  Chemically synthesized
ccucggacacauucccugg

SEQ ID NO: 11332 - RNA, 19 nt, artificial
  Chemically synthesized
cagcgagcuggacgagacc

SEQ ID NO: 11333 - RNA, 19 nt, artificial
  Chemically synthesized
ucgagguggagaaggagag

SEQ ID NO: 11334 - RNA, 19 nt, artificial
  Chemically synthesized
ugguacccagugcuuuuga

SEQ ID NO: 11335 - RNA, 19 nt, artificial
  Chemically synthesized
augaccguggaucaccuga

SEQ ID NO: 11336 - RNA, 19 nt, artificial
  Chemically synthesized
ugcuaagcuagaaaaagcc

SEQ ID NO: 11337 - RNA, 19 nt, artificial
  Chemically synthesized
gacgagaccaucgaggugg

SEQ ID NO: 11338 - RNA, 19 nt, artificial
  Chemically synthesized
aggaugguugaguuuuaac

SEQ ID NO: 11339 - RNA, 19 nt, artificial
  Chemically synthesized
gagaagcgccgacgagacc

SEQ ID NO: 11340 - RNA, 19 nt, artificial
  Chemically synthesized
ucugcuaagcuagaaaaag

SEQ ID NO: 11341 - RNA, 19 nt, artificial
  Chemically synthesized
gggccucggacacauuccc

SEQ ID NO: 11342 - RNA, 19 nt, artificial
  Chemically synthesized
accuuggcaagcccuauag

SEQ ID NO: 11343 - RNA, 19 nt, artificial
  Chemically synthesized
guggaucaccugaaaaugc

SEQ ID NO: 11344 - RNA, 19 nt, artificial
  Chemically synthesized
gaagcgccgacgagaccgg

SEQ ID NO: 11345 - RNA, 19 nt, artificial
  Chemically synthesized
cugguacccagugcuuuug

SEQ ID NO: 11346 - RNA, 19 nt, artificial
  Chemically synthesized
agaagcgccgacgagaccg

SEQ ID NO: 11347 - RNA, 19 nt, artificial
  Chemically synthesized
gcagaugaccguggaucac

SEQ ID NO: 11348 - RNA, 19 nt, artificial
  Chemically synthesized
cgggccucggacacauucc

SEQ ID NO: 11349 - RNA, 19 nt, artificial
  Chemically synthesized
ggacagcgagcuggacgag

SEQ ID NO: 11350 - RNA, 19 nt, artificial
  Chemically synthesized
cuggacgagaccaucgagg

SEQ ID NO: 11351 - RNA, 19 nt, artificial
  Chemically synthesized
uggaaacuugaguucggcu

SEQ ID NO: 11352 - RNA, 19 nt, artificial
  Chemically synthesized
ccuccaaacugucgccgcc

SEQ ID NO: 11353 - RNA, 19 nt, artificial
  Chemically synthesized
aauggaaacuugaguucgg

SEQ ID NO: 11354 - RNA, 19 nt, artificial
  Chemically synthesized
gugcuuuugagaagcaggg

SEQ ID NO: 11355 - RNA, 19 nt, artificial
  Chemically synthesized
uaagcuagaaaaagccgag

SEQ ID NO: 11356 - RNA, 19 nt, artificial
  Chemically synthesized
auggacuaucggaguuugg

SEQ ID NO: 11357 - RNA, 19 nt, artificial
  Chemically synthesized
gauccugcagaugaccgug

SEQ ID NO: 11358 - RNA, 19 nt, artificial
  Chemically synthesized
agcagggaucugcuaagcu

SEQ ID NO: 11359 - RNA, 19 nt, artificial
  Chemically synthesized
uugucugagcugagaaggc

SEQ ID NO: 11360 - RNA, 19 nt, artificial
  Chemically synthesized
cuccaaacugucgccgccu

SEQ ID NO: 11361 - RNA, 19 nt, artificial
  Chemically synthesized
uuggcaagcccuauagacc

SEQ ID NO: 11362 - RNA, 19 nt, artificial
  Chemically synthesized
cugcagaugaccguggauc

SEQ ID NO: 11363 - RNA, 19 nt, artificial
  Chemically synthesized
ucugagcugagaaggcugg

SEQ ID NO: 11364 - RNA, 19 nt, artificial
  Chemically synthesized
ccucggaccggugcucccu

SEQ ID NO: 11365 - RNA, 19 nt, artificial
  Chemically synthesized
gaugaccguggaucaccug

SEQ ID NO: 11366 - RNA, 19 nt, artificial
  Chemically synthesized
aucaccugaaaaugcugca

SEQ ID NO: 11367 - RNA, 19 nt, artificial
  Chemically synthesized
agcuccucggacagcgagc

SEQ ID NO: 11368 - RNA, 19 nt, artificial
  Chemically synthesized
caacaucaccuuaaagucg

SEQ ID NO: 11369 - RNA, 19 nt, artificial
  Chemically synthesized
accaucgagguggagaagg

SEQ ID NO: 11370 - RNA, 19 nt, artificial
  Chemically synthesized
ugcaaaccuuggcaagccc

SEQ ID NO: 11371 - RNA, 19 nt, artificial
  Chemically synthesized
uggacuaucggaguuuggg

SEQ ID NO: 11372 - RNA, 19 nt, artificial
  Chemically synthesized
aauaacaguuugucugagc

SEQ ID NO: 11373 - RNA, 19 nt, artificial
  Chemically synthesized
uuuugagaagcagggaucu

SEQ ID NO: 11374 - RNA, 19 nt, artificial
  Chemically synthesized
cagcuccucggacagcgag

SEQ ID NO: 11375 - RNA, 19 nt, artificial
  Chemically synthesized
gccuccaaacugucgccgc

SEQ ID NO: 11376 - RNA, 19 nt, artificial
  Chemically synthesized
cucggacagcgagcuggac

SEQ ID NO: 11377 - RNA, 19 nt, artificial
  Chemically synthesized
uaacaguuugucugagcug

SEQ ID NO: 11378 - RNA, 19 nt, artificial
  Chemically synthesized
cagaugaccguggaucacc

SEQ ID NO: 11379 - RNA, 19 nt, artificial
  Chemically synthesized
cucggacacauucccuggg

SEQ ID NO: 11380 - RNA, 19 nt, artificial
  Chemically synthesized
cgagaccaucgagguggag

SEQ ID NO: 11381 - RNA, 19 nt, artificial
  Chemically synthesized
ucaccugaaaaugcugcau

SEQ ID NO: 11382 - RNA, 19 nt, artificial
  Chemically synthesized
cuccucggacagcgagcug

SEQ ID NO: 11383 - RNA, 19 nt, artificial
  Chemically synthesized
uuugucugagcugagaagg

SEQ ID NO: 11384 - RNA, 19 nt, artificial
  Chemically synthesized
ccuugcuauggacuaucgg

SEQ ID NO: 11385 - RNA, 19 nt, artificial
  Chemically synthesized
cugagcaucauugaaggac

SEQ ID NO: 11386 - RNA, 19 nt, artificial
  Chemically synthesized
uugagaagcagggaucugc

SEQ ID NO: 11387 - RNA, 19 nt, artificial
  Chemically synthesized
uugcuauggacuaucggag

SEQ ID NO: 11388 - RNA, 19 nt, artificial
  Chemically synthesized
ugccaacaucaccuuaaag

SEQ ID NO: 11389 - RNA, 19 nt, artificial
  Chemically synthesized
gcgcacgcccuugcuaugg

SEQ ID NO: 11390 - RNA, 19 nt, artificial
  Chemically synthesized
auuucgggaaugccuggca

SEQ ID NO: 11391 - RNA, 19 nt, artificial
  Chemically synthesized
ucccagcgggaagccgcga

SEQ ID NO: 11392 - RNA, 19 nt, artificial
  Chemically synthesized
auggaaacuugaguucggc

SEQ ID NO: 11393 - RNA, 19 nt, artificial
  Chemically synthesized
guacagcuccucggacagc

SEQ ID NO: 11394 - RNA, 19 nt, artificial
  Chemically synthesized
agccucggaccggugcucc

SEQ ID NO: 11395 - RNA, 19 nt, artificial
  Chemically synthesized
uuugagaagcagggaucug

SEQ ID NO: 11396 - RNA, 19 nt, artificial
  Chemically synthesized
gaucaccugaaaaugcugc

SEQ ID NO: 11397 - RNA, 19 nt, artificial
  Chemically synthesized
uacagcuccucggacagcg

SEQ ID NO: 11398 - RNA, 19 nt, artificial
  Chemically synthesized
accgcaccaccagggcagg

SEQ ID NO: 11399 - RNA, 19 nt, artificial
  Chemically synthesized
uccucggacagcgagcugg

SEQ ID NO: 11400 - RNA, 19 nt, artificial
  Chemically synthesized
ucggacagcgagcuggacg

SEQ ID NO: 11401 - RNA, 19 nt, artificial
  Chemically synthesized
aagcagggaucugcuaagc

SEQ ID NO: 11402 - RNA, 19 nt, artificial
  Chemically synthesized
aagcccuauagaccuuggg

SEQ ID NO: 11403 - RNA, 19 nt, artificial
  Chemically synthesized
auccugcagaugaccgugg

SEQ ID NO: 11404 - RNA, 19 nt, artificial
  Chemically synthesized
uucccagcgggaagccgcg

SEQ ID NO: 11405 - RNA, 19 nt, artificial
  Chemically synthesized
aguuaacuccucccugccc

SEQ ID NO: 11406 - RNA, 19 nt, artificial
  Chemically synthesized
cgccuccaaacugucgccg

SEQ ID NO: 11407 - RNA, 19 nt, artificial
  Chemically synthesized
uaguuaacuccucccugcc

SEQ ID NO: 11408 - RNA, 19 nt, artificial
  Chemically synthesized
caccucgauggucucgucc

SEQ ID NO: 11409 - RNA, 19 nt, artificial
  Chemically synthesized
uucaaugaugcucagauaa

SEQ ID NO: 11410 - RNA, 19 nt, artificial
  Chemically synthesized
auccacggucaucugcagg

SEQ ID NO: 11411 - RNA, 19 nt, artificial
  Chemically synthesized
gucucguccagcucgcugu

SEQ ID NO: 11412 - RNA, 19 nt, artificial
  Chemically synthesized
guuuccauucucguccgca

SEQ ID NO: 11413 - RNA, 19 nt, artificial
  Chemically synthesized
uccauagcaagggcgugcg

SEQ ID NO: 11414 - RNA, 19 nt, artificial
  Chemically synthesized
gcucgcuucaugcuggcuc

SEQ ID NO: 11415 - RNA, 19 nt, artificial
  Chemically synthesized
cagcauuuucaggugaucc

SEQ ID NO: 11416 - RNA, 19 nt, artificial
  Chemically synthesized
cgauaguccauagcaaggg

SEQ ID NO: 11417 - RNA, 19 nt, artificial
  Chemically synthesized
gcuucucaaaagcacuggg

SEQ ID NO: 11418 - RNA, 19 nt, artificial
  Chemically synthesized
gucucgucggcgcuucuca

SEQ ID NO: 11419 - RNA, 19 nt, artificial
  Chemically synthesized
agcguaguuguugagaugc

SEQ ID NO: 11420 - RNA, 19 nt, artificial
  Chemically synthesized
agcagaucccugcuucuca

SEQ ID NO: 11421 - RNA, 19 nt, artificial
  Chemically synthesized
gauggucucguccagcucg

SEQ ID NO: 11422 - RNA, 19 nt, artificial
  Chemically synthesized
ccuucaaugaugcucagau

SEQ ID NO: 11423 - RNA, 19 nt, artificial
  Chemically synthesized
accucgauggucucgucca

SEQ ID NO: 11424 - RNA, 19 nt, artificial
  Chemically synthesized
ucucguccagcucgcuguc

SEQ ID NO: 11425 - RNA, 19 nt, artificial
  Chemically synthesized
gucuauagggcuugccaag

SEQ ID NO: 11426 - RNA, 19 nt, artificial
  Chemically synthesized
cgauggucucguccagcuc

SEQ ID NO: 11427 - RNA, 19 nt, artificial
  Chemically synthesized
cucagacaaacuguuauug

SEQ ID NO: 11428 - RNA, 19 nt, artificial
  Chemically synthesized
caaacuccgauaguccaua

SEQ ID NO: 11429 - RNA, 19 nt, artificial
  Chemically synthesized
guaaccuuucccuccugcc

SEQ ID NO: 11430 - RNA, 19 nt, artificial
  Chemically synthesized
cuuagcagaucccugcuuc

SEQ ID NO: 11431 - RNA, 19 nt, artificial
  Chemically synthesized
ucgaacucgaagcggguca

SEQ ID NO: 11432 - RNA, 19 nt, artificial
  Chemically synthesized
gggacauggaaccuagagc

SEQ ID NO: 11433 - RNA, 19 nt, artificial
  Chemically synthesized
auagggcuugccaagguuu

SEQ ID NO: 11434 - RNA, 19 nt, artificial
  Chemically synthesized
agggaauguguccgaggcc

SEQ ID NO: 11435 - RNA, 19 nt, artificial
  Chemically synthesized
cucaaaagcacuggguacc

SEQ ID NO: 11436 - RNA, 19 nt, artificial
  Chemically synthesized
aagggcgugcgcgucaaag

SEQ ID NO: 11437 - RNA, 19 nt, artificial
  Chemically synthesized
gcacuggguaccagccuuc

SEQ ID NO: 11438 - RNA, 19 nt, artificial
  Chemically synthesized
cauuuucaggugauccacg

SEQ ID NO: 11439 - RNA, 19 nt, artificial
  Chemically synthesized
cacuggguaccagccuucu

SEQ ID NO: 11440 - RNA, 19 nt, artificial
  Chemically synthesized
ucgcuguccgaggagcugu

SEQ ID NO: 11441 - RNA, 19 nt, artificial
  Chemically synthesized
agcacuggguaccagccuu

SEQ ID NO: 11442 - RNA, 19 nt, artificial
  Chemically synthesized
cuucuccaccucgaugguc

SEQ ID NO: 11443 - RNA, 19 nt, artificial
  Chemically synthesized
caaugaugcucagauaacg

SEQ ID NO: 11444 - RNA, 19 nt, artificial
  Chemically synthesized
cucaaguuuccauucucgu

SEQ ID NO: 11445 - RNA, 19 nt, artificial
  Chemically synthesized
agcucagacaaacuguuau

SEQ ID NO: 11446 - RNA, 19 nt, artificial
  Chemically synthesized
agggcuugccaagguuugc

SEQ ID NO: 11447 - RNA, 19 nt, artificial
  Chemically synthesized
agcucgcuguccgaggagc

SEQ ID NO: 11448 - RNA, 19 nt, artificial
  Chemically synthesized
accagccuucucagcucag

SEQ ID NO: 11449 - RNA, 19 nt, artificial
  Chemically synthesized
cauagcaagggcgugcgcg

SEQ ID NO: 11450 - RNA, 19 nt, artificial
  Chemically synthesized
cagggaauguguccgaggc

SEQ ID NO: 11451 - RNA, 19 nt, artificial
  Chemically synthesized
agcauuuucaggugaucca

SEQ ID NO: 11452 - RNA, 19 nt, artificial
  Chemically synthesized
cagacaaacuguuauugau

SEQ ID NO: 11453 - RNA, 19 nt, artificial
  Chemically synthesized
gauaguccauagcaagggc

SEQ ID NO: 11454 - RNA, 19 nt, artificial
  Chemically synthesized
uccacggucaucugcagga

SEQ ID NO: 11455 - RNA, 19 nt, artificial
  Chemically synthesized
cugcuucucaaaagcacug

SEQ ID NO: 11456 - RNA, 19 nt, artificial
  Chemically synthesized
cucagcucagacaaacugu

SEQ ID NO: 11457 - RNA, 19 nt, artificial
  Chemically synthesized
ccugcuucucaaaagcacu

SEQ ID NO: 11458 - RNA, 19 nt, artificial
  Chemically synthesized
ccaaggucuauagggcuug

SEQ ID NO: 11459 - RNA, 19 nt, artificial
  Chemically synthesized
cuccuucuccaccucgaug

SEQ ID NO: 11460 - RNA, 19 nt, artificial
  Chemically synthesized
gaacucaaguuuccauucu

SEQ ID NO: 11461 - RNA, 19 nt, artificial
  Chemically synthesized
uccuucaaugaugcucaga

SEQ ID NO: 11462 - RNA, 19 nt, artificial
  Chemically synthesized
cgaacucaaguuuccauuc

SEQ ID NO: 11463 - RNA, 19 nt, artificial
  Chemically synthesized
gacuuuaaggugauguugg

SEQ ID NO: 11464 - RNA, 19 nt, artificial
  Chemically synthesized
ggguaccagccuucucagc

SEQ ID NO: 11465 - RNA, 19 nt, artificial
  Chemically synthesized
gaucccugcuucucaaaag

SEQ ID NO: 11466 - RNA, 19 nt, artificial
  Chemically synthesized
ucccugcuucucaaaagca

SEQ ID NO: 11467 - RNA, 19 nt, artificial
  Chemically synthesized
guccauagcaagggcgugc

SEQ ID NO: 11468 - RNA, 19 nt, artificial
  Chemically synthesized
agcucgcuucaugcuggcu

SEQ ID NO: 11469 - RNA, 19 nt, artificial
  Chemically synthesized
caaggucuauagggcuugc

SEQ ID NO: 11470 - RNA, 19 nt, artificial
  Chemically synthesized
aguccauagcaagggcgug

SEQ ID NO: 11471 - RNA, 19 nt, artificial
  Chemically synthesized
cggcuuuuucuagcuuagc

SEQ ID NO: 11472 - RNA, 19 nt, artificial
  Chemically synthesized
ccagggaauguguccgagg

SEQ ID NO: 11473 - RNA, 19 nt, artificial
  Chemically synthesized
ggucucguccagcucgcug

SEQ ID NO: 11474 - RNA, 19 nt, artificial
  Chemically synthesized
cucuccuucuccaccucga

SEQ ID NO: 11475 - RNA, 19 nt, artificial
  Chemically synthesized
ucaaaagcacuggguacca

SEQ ID NO: 11476 - RNA, 19 nt, artificial
  Chemically synthesized
ucaggugauccacggucau

SEQ ID NO: 11477 - RNA, 19 nt, artificial
  Chemically synthesized
ggcuuuuucuagcuuagca

SEQ ID NO: 11478 - RNA, 19 nt, artificial
  Chemically synthesized
ccaccucgauggucucguc

SEQ ID NO: 11479 - RNA, 19 nt, artificial
  Chemically synthesized
guuaaaacucaaccauccu

SEQ ID NO: 11480 - RNA, 19 nt, artificial
  Chemically synthesized
ggucucgucggcgcuucuc

SEQ ID NO: 11481 - RNA, 19 nt, artificial
  Chemically synthesized
cuuuuucuagcuuagcaga

SEQ ID NO: 11482 - RNA, 19 nt, artificial
  Chemically synthesized
gggaauguguccgaggccc

SEQ ID NO: 11483 - RNA, 19 nt, artificial
  Chemically synthesized
cuauagggcuugccaaggu

SEQ ID NO: 11484 - RNA, 19 nt, artificial
  Chemically synthesized
gcauuuucaggugauccac

SEQ ID NO: 11485 - RNA, 19 nt, artificial
  Chemically synthesized
ccggucucgucggcgcuuc

SEQ ID NO: 11486 - RNA, 19 nt, artificial
  Chemically synthesized
caaaagcacuggguaccag

SEQ ID NO: 11487 - RNA, 19 nt, artificial
  Chemically synthesized
cggucucgucggcgcuucu

SEQ ID NO: 11488 - RNA, 19 nt, artificial
  Chemically synthesized
gugauccacggucaucugc

SEQ ID NO: 11489 - RNA, 19 nt, artificial
  Chemically synthesized
ggaauguguccgaggcccg

SEQ ID NO: 11490 - RNA, 19 nt, artificial
  Chemically synthesized
cucguccagcucgcugucc

SEQ ID NO: 11491 - RNA, 19 nt, artificial
  Chemically synthesized
ccucgauggucucguccag

SEQ ID NO: 11492 - RNA, 19 nt, artificial
  Chemically synthesized
agccgaacucaaguuucca

SEQ ID NO: 11493 - RNA, 19 nt, artificial
  Chemically synthesized
ggcggcgacaguuuggagg

SEQ ID NO: 11494 - RNA, 19 nt, artificial
  Chemically synthesized
ccgaacucaaguuuccauu

SEQ ID NO: 11495 - RNA, 19 nt, artificial
  Chemically synthesized
cccugcuucucaaaagcac

SEQ ID NO: 11496 - RNA, 19 nt, artificial
  Chemically synthesized
cucggcuuuuucuagcuua

SEQ ID NO: 11497 - RNA, 19 nt, artificial
  Chemically synthesized
ccaaacuccgauaguccau

SEQ ID NO: 11498 - RNA, 19 nt, artificial
  Chemically synthesized
cacggucaucugcaggauc

SEQ ID NO: 11499 - RNA, 19 nt, artificial
  Chemically synthesized
agcuuagcagaucccugcu

SEQ ID NO: 11500 - RNA, 19 nt, artificial
  Chemically synthesized
gccuucucagcucagacaa

SEQ ID NO: 11501 - RNA, 19 nt, artificial
  Chemically synthesized
aggcggcgacaguuuggag

SEQ ID NO: 11502 - RNA, 19 nt, artificial
  Chemically synthesized
ggucuauagggcuugccaa

SEQ ID NO: 11503 - RNA, 19 nt, artificial
  Chemically synthesized
gauccacggucaucugcag

SEQ ID NO: 11504 - RNA, 19 nt, artificial
  Chemically synthesized
ccagccuucucagcucaga

SEQ ID NO: 11505 - RNA, 19 nt, artificial
  Chemically synthesized
agggagcaccgguccgagg

SEQ ID NO: 11506 - RNA, 19 nt, artificial
  Chemically synthesized
caggugauccacggucauc

SEQ ID NO: 11507 - RNA, 19 nt, artificial
  Chemically synthesized
ugcagcauuuucaggugau

SEQ ID NO: 11508 - RNA, 19 nt, artificial
  Chemically synthesized
gcucgcuguccgaggagcu

SEQ ID NO: 11509 - RNA, 19 nt, artificial
  Chemically synthesized
cgacuuuaaggugauguug

SEQ ID NO: 11510 - RNA, 19 nt, artificial
  Chemically synthesized
ccuucuccaccucgauggu

SEQ ID NO: 11511 - RNA, 19 nt, artificial
  Chemically synthesized
gggcuugccaagguuugca

SEQ ID NO: 11512 - RNA, 19 nt, artificial
  Chemically synthesized
cccaaacuccgauagucca

SEQ ID NO: 11513 - RNA, 19 nt, artificial
  Chemically synthesized
gcucagacaaacuguuauu

SEQ ID NO: 11514 - RNA, 19 nt, artificial
  Chemically synthesized
agaucccugcuucucaaaa

SEQ ID NO: 11515 - RNA, 19 nt, artificial
  Chemically synthesized
cucgcuguccgaggagcug

SEQ ID NO: 11516 - RNA, 19 nt, artificial
  Chemically synthesized
gcggcgacaguuuggaggc

SEQ ID NO: 11517 - RNA, 19 nt, artificial
  Chemically synthesized
guccagcucgcuguccgag

SEQ ID NO: 11518 - RNA, 19 nt, artificial
  Chemically synthesized
cagcucagacaaacuguua

SEQ ID NO: 11519 - RNA, 19 nt, artificial
  Chemically synthesized
ggugauccacggucaucug

SEQ ID NO: 11520 - RNA, 19 nt, artificial
  Chemically synthesized
cccagggaauguguccgag

SEQ ID NO: 11521 - RNA, 19 nt, artificial
  Chemically synthesized
cuccaccucgauggucucg

SEQ ID NO: 11522 - RNA, 19 nt, artificial
  Chemically synthesized
augcagcauuuucagguga

SEQ ID NO: 11523 - RNA, 19 nt, artificial
  Chemically synthesized
cagcucgcuguccgaggag

SEQ ID NO: 11524 - RNA, 19 nt, artificial
  Chemically synthesized
ccuucucagcucagacaaa

SEQ ID NO: 11525 - RNA, 19 nt, artificial
  Chemically synthesized
ccgauaguccauagcaagg

SEQ ID NO: 11526 - RNA, 19 nt, artificial
  Chemically synthesized
guccuucaaugaugcucag

SEQ ID NO: 11527 - RNA, 19 nt, artificial
  Chemically synthesized
gcagaucccugcuucucaa

SEQ ID NO: 11528 - RNA, 19 nt, artificial
  Chemically synthesized
cuccgauaguccauagcaa

SEQ ID NO: 11529 - RNA, 19 nt, artificial
  Chemically synthesized
cuuuaaggugauguuggca

SEQ ID NO: 11530 - RNA, 19 nt, artificial
  Chemically synthesized
ccauagcaagggcgugcgc

SEQ ID NO: 11531 - RNA, 19 nt, artificial
  Chemically synthesized
ugccaggcauucccgaaau

SEQ ID NO: 11532 - RNA, 19 nt, artificial
  Chemically synthesized
ucgcggcuucccgcuggga

SEQ ID NO: 11533 - RNA, 19 nt, artificial
  Chemically synthesized
gccgaacucaaguuuccau

SEQ ID NO: 11534 - RNA, 19 nt, artificial
  Chemically synthesized
gcuguccgaggagcuguac

SEQ ID NO: 11535 - RNA, 19 nt, artificial
  Chemically synthesized
ggagcaccgguccgaggcu

SEQ ID NO: 11536 - RNA, 19 nt, artificial
  Chemically synthesized
cagaucccugcuucucaaa

SEQ ID NO: 11537 - RNA, 19 nt, artificial
  Chemically synthesized
gcagcauuuucaggugauc

SEQ ID NO: 11538 - RNA, 19 nt, artificial
  Chemically synthesized
cgcuguccgaggagcugua

SEQ ID NO: 11539 - RNA, 19 nt, artificial
  Chemically synthesized
ccugcccugguggugcggu

SEQ ID NO: 11540 - RNA, 19 nt, artificial
  Chemically synthesized
ccagcucgcuguccgagga

SEQ ID NO: 11541 - RNA, 19 nt, artificial
  Chemically synthesized
cguccagcucgcuguccga

SEQ ID NO: 11542 - RNA, 19 nt, artificial
  Chemically synthesized
gcuuagcagaucccugcuu

SEQ ID NO: 11543 - RNA, 19 nt, artificial
  Chemically synthesized
cccaaggucuauagggcuu

SEQ ID NO: 11544 - RNA, 19 nt, artificial
  Chemically synthesized
ccacggucaucugcaggau

SEQ ID NO: 11545 - RNA, 19 nt, artificial
  Chemically synthesized
cgcggcuucccgcugggaa

SEQ ID NO: 11546 - RNA, 19 nt, artificial
  Chemically synthesized
gggcagggaggaguuaacu

SEQ ID NO: 11547 - RNA, 19 nt, artificial
  Chemically synthesized
cggcgacaguuuggaggcg

SEQ ID NO: 11548 - RNA, 19 nt, artificial
  Chemically synthesized
ggcagggaggaguuaacua

SEQ ID NO: 11549 - RNA, 18 nt, artificial
  Chemically synthesized
ggagaaggagagugcgga

SEQ ID NO: 11550 - RNA, 18 nt, artificial
  Chemically synthesized
ggacgagaauggaaacuu

SEQ ID NO: 11551 - RNA, 18 nt, artificial
  Chemically synthesized
ggagagugcggacgagaa

SEQ ID NO: 11552 - RNA, 18 nt, artificial
  Chemically synthesized
ccggaucaauaacaguuu

SEQ ID NO: 11553 - RNA, 18 nt, artificial
  Chemically synthesized
gguugaguuuuaaccaga

SEQ ID NO: 11554 - RNA, 18 nt, artificial
  Chemically synthesized
gguuucgcaucucaacaa

SEQ ID NO: 11555 - RNA, 18 nt, artificial
  Chemically synthesized
ccgagauccugcagauga

SEQ ID NO: 11556 - RNA, 18 nt, artificial
  Chemically synthesized
ggaucagugugugcggaa

SEQ ID NO: 11557 - RNA, 18 nt, artificial
  Chemically synthesized
gagagugcggacgagaau

SEQ ID NO: 11558 - RNA, 18 nt, artificial
  Chemically synthesized
gggaaaggaugguugagu

SEQ ID NO: 11559 - RNA, 18 nt, artificial
  Chemically synthesized
gguuuguugguuuacuuu

SEQ ID NO: 11560 - RNA, 18 nt, artificial
  Chemically synthesized
gcuuuauccaagaaagaa

SEQ ID NO: 11561 - RNA, 18 nt, artificial
  Chemically synthesized
gguggaaaggaaacugaa

SEQ ID NO: 11562 - RNA, 18 nt, artificial
  Chemically synthesized
ccgacgagaccggaucaa

SEQ ID NO: 11563 - RNA, 18 nt, artificial
  Chemically synthesized
ggcucuagguuccauguc

SEQ ID NO: 11564 - RNA, 18 nt, artificial
  Chemically synthesized
gaaggagagugcggacga

SEQ ID NO: 11565 - RNA, 18 nt, artificial
  Chemically synthesized
gucauguauuagcaguuu

SEQ ID NO: 11566 - RNA, 18 nt, artificial
  Chemically synthesized
gccagaaaaagacggaga

SEQ ID NO: 11567 - RNA, 18 nt, artificial
  Chemically synthesized
ggugaauguacaaacugu

SEQ ID NO: 11568 - RNA, 18 nt, artificial
  Chemically synthesized
gagaccggaucaauaaca

SEQ ID NO: 11569 - RNA, 18 nt, artificial
  Chemically synthesized
gaguauaagccaacacuu

SEQ ID NO: 11570 - RNA, 18 nt, artificial
  Chemically synthesized
ggucaauugaguaguaca

SEQ ID NO: 11571 - RNA, 18 nt, artificial
  Chemically synthesized
ggaauaauugagaagcgc

SEQ ID NO: 11572 - RNA, 18 nt, artificial
  Chemically synthesized
ggaucucaaauucacaaa

SEQ ID NO: 11573 - RNA, 18 nt, artificial
  Chemically synthesized
gucugagcugagaaggcu

SEQ ID NO: 11574 - RNA, 18 nt, artificial
  Chemically synthesized
ugagaaggcugguaccca

SEQ ID NO: 11575 - RNA, 18 nt, artificial
  Chemically synthesized
ccagcaacacaaagaauu

SEQ ID NO: 11576 - RNA, 18 nt, artificial
  Chemically synthesized
agcagaaaggugaaugua

SEQ ID NO: 11577 - RNA, 18 nt, artificial
  Chemically synthesized
ggcagaaguugcgcguua

SEQ ID NO: 11578 - RNA, 18 nt, artificial
  Chemically synthesized
ggcaagcccuauagaccu

SEQ ID NO: 11579 - RNA, 18 nt, artificial
  Chemically synthesized
ggaucaauaacaguuugu

SEQ ID NO: 11580 - RNA, 18 nt, artificial
  Chemically synthesized
ggagagagccgcugauag

SEQ ID NO: 11581 - RNA, 18 nt, artificial
  Chemically synthesized
gcugguacccagugcuuu

SEQ ID NO: 11582 - RNA, 18 nt, artificial
  Chemically synthesized
ucagcuuuauccaagaaa

SEQ ID NO: 11583 - RNA, 18 nt, artificial
  Chemically synthesized
agcaaagcguugacaaau

SEQ ID NO: 11584 - RNA, 18 nt, artificial
  Chemically synthesized
agacggagaggaauaauu

SEQ ID NO: 11585 - RNA, 18 nt, artificial
  Chemically synthesized
ggacggagaucggagcuu

SEQ ID NO: 11586 - RNA, 18 nt, artificial
  Chemically synthesized
ggagccagcaugaagcga

SEQ ID NO: 11587 - RNA, 18 nt, artificial
  Chemically synthesized
gccuccuucucuuugauu

SEQ ID NO: 11588 - RNA, 18 nt, artificial
  Chemically synthesized
aggugaauguacaaacug

SEQ ID NO: 11589 - RNA, 18 nt, artificial
  Chemically synthesized
gcgccgacgagaccggau

SEQ ID NO: 11590 - RNA, 18 nt, artificial
  Chemically synthesized
gugugcgaguggucaauu

SEQ ID NO: 11591 - RNA, 18 nt, artificial
  Chemically synthesized
gaaaggugaauguacaaa

SEQ ID NO: 11592 - RNA, 18 nt, artificial
  Chemically synthesized
gcuagaaaaagccgagau

SEQ ID NO: 11593 - RNA, 18 nt, artificial
  Chemically synthesized
gguuugaccucuguugua

SEQ ID NO: 11594 - RNA, 18 nt, artificial
  Chemically synthesized
gagccagcaugaagcgag

SEQ ID NO: 11595 - RNA, 18 nt, artificial
  Chemically synthesized
gguuuauucuuuuagcag

SEQ ID NO: 11596 - RNA, 18 nt, artificial
  Chemically synthesized
cugcuaagcuagaaaaag

SEQ ID NO: 11597 - RNA, 18 nt, artificial
  Chemically synthesized
gggcuuuccugccuccuu

SEQ ID NO: 11598 - RNA, 18 nt, artificial
  Chemically synthesized
gaguucggcucuagguuc

SEQ ID NO: 11599 - RNA, 18 nt, artificial
  Chemically synthesized
ggcugguacccagugcuu

SEQ ID NO: 11600 - RNA, 18 nt, artificial
  Chemically synthesized
agcugagaaggcugguac

SEQ ID NO: 11601 - RNA, 18 nt, artificial
  Chemically synthesized
caucauugaaggacuaga

SEQ ID NO: 11602 - RNA, 18 nt, artificial
  Chemically synthesized
guuugucugagcugagaa

SEQ ID NO: 11603 - RNA, 18 nt, artificial
  Chemically synthesized
gaacugauguagaaugag

SEQ ID NO: 11604 - RNA, 18 nt, artificial
  Chemically synthesized
ggcugcaaaccuuggcaa

SEQ ID NO: 11605 - RNA, 18 nt, artificial
  Chemically synthesized
gagcugagaaggcuggua

SEQ ID NO: 11606 - RNA, 18 nt, artificial
  Chemically synthesized
ggagggaaagguuacuuu

SEQ ID NO: 11607 - RNA, 18 nt, artificial
  Chemically synthesized
ccagaaugauuccguuuu

SEQ ID NO: 11608 - RNA, 18 nt, artificial
  Chemically synthesized
gcuucgaguucgacuggu

SEQ ID NO: 11609 - RNA, 18 nt, artificial
  Chemically synthesized
gggaaugccuggcagaag

SEQ ID NO: 11610 - RNA, 18 nt, artificial
  Chemically synthesized
gagcaaagcguugacaaa

SEQ ID NO: 11611 - RNA, 18 nt, artificial
  Chemically synthesized
gcaguucugauuuaguua

SEQ ID NO: 11612 - RNA, 18 nt, artificial
  Chemically synthesized
ccguggaucaccugaaaa

SEQ ID NO: 11613 - RNA, 18 nt, artificial
  Chemically synthesized
gguggagaaggagagugc

SEQ ID NO: 11614 - RNA, 18 nt, artificial
  Chemically synthesized
gcuggacgagaccaucga

SEQ ID NO: 11615 - RNA, 18 nt, artificial
  Chemically synthesized
ggagcuuuuuaaagaacu

SEQ ID NO: 11616 - RNA, 18 nt, artificial
  Chemically synthesized
gguauuuaaaagggcuuu

SEQ ID NO: 11617 - RNA, 18 nt, artificial
  Chemically synthesized
ggacuggcaguucugauu

SEQ ID NO: 11618 - RNA, 18 nt, artificial
  Chemically synthesized
cagggaucugcuaagcua

SEQ ID NO: 11619 - RNA, 18 nt, artificial
  Chemically synthesized
gagaggaauaauugagaa

SEQ ID NO: 11620 - RNA, 18 nt, artificial
  Chemically synthesized
gaccggaucaauaacagu

SEQ ID NO: 11621 - RNA, 18 nt, artificial
  Chemically synthesized
gaaaaagacggagaggaa

SEQ ID NO: 11622 - RNA, 18 nt, artificial
  Chemically synthesized
agguggagaaggagagug

SEQ ID NO: 11623 - RNA, 18 nt, artificial
  Chemically synthesized
ggaugguugaguuuuaac

SEQ ID NO: 11624 - RNA, 18 nt, artificial
  Chemically synthesized
gacuaucggaguuuggga

SEQ ID NO: 11625 - RNA, 18 nt, artificial
  Chemically synthesized
ugcggacgagaauggaaa

SEQ ID NO: 11626 - RNA, 18 nt, artificial
  Chemically synthesized
cuccuucucuuugauuua

SEQ ID NO: 11627 - RNA, 18 nt, artificial
  Chemically synthesized
ggugcauggaacuguggu

SEQ ID NO: 11628 - RNA, 18 nt, artificial
  Chemically synthesized
cuuguauaguuauggucu

SEQ ID NO: 11629 - RNA, 18 nt, artificial
  Chemically synthesized
gaggaauaauugagaagc

SEQ ID NO: 11630 - RNA, 18 nt, artificial
  Chemically synthesized
cgcccuugcuauggacua

SEQ ID NO: 11631 - RNA, 18 nt, artificial
  Chemically synthesized
cuaucggaguuugggauu

SEQ ID NO: 11632 - RNA, 18 nt, artificial
  Chemically synthesized
ggucucauuuggaguguu

SEQ ID NO: 11633 - RNA, 18 nt, artificial
  Chemically synthesized
acuacaucuucccagauu

SEQ ID NO: 11634 - RNA, 18 nt, artificial
  Chemically synthesized
ggcccugaauccaucuga

SEQ ID NO: 11635 - RNA, 18 nt, artificial
  Chemically synthesized
aguauaagccaacacuuu

SEQ ID NO: 11636 - RNA, 18 nt, artificial
  Chemically synthesized
agaauacgccugcauuua

SEQ ID NO: 11637 - RNA, 18 nt, artificial
  Chemically synthesized
agccaacacuuugugaua

SEQ ID NO: 11638 - RNA, 18 nt, artificial
  Chemically synthesized
gugcgaguggucaauuga

SEQ ID NO: 11639 - RNA, 18 nt, artificial
  Chemically synthesized
gccaggacuggcaguucu

SEQ ID NO: 11640 - RNA, 18 nt, artificial
  Chemically synthesized
gggcuggacuguugccaa

SEQ ID NO: 11641 - RNA, 18 nt, artificial
  Chemically synthesized
ccucuguuguacugaugu

SEQ ID NO: 11642 - RNA, 18 nt, artificial
  Chemically synthesized
gagaauggaaacuugagu

SEQ ID NO: 11643 - RNA, 18 nt, artificial
  Chemically synthesized
gaucaauaacaguuuguc

SEQ ID NO: 11644 - RNA, 18 nt, artificial
  Chemically synthesized
caagcagccgagagcgga

SEQ ID NO: 11645 - RNA, 18 nt, artificial
  Chemically synthesized
acagcgagcuggacgaga

SEQ ID NO: 11646 - RNA, 18 nt, artificial
  Chemically synthesized
cuccuauagcagaaaggu

SEQ ID NO: 11647 - RNA, 18 nt, artificial
  Chemically synthesized
accugaaaaugcugcaua

SEQ ID NO: 11648 - RNA, 18 nt, artificial
  Chemically synthesized
ugaguaguacaguggaaa

SEQ ID NO: 11649 - RNA, 18 nt, artificial
  Chemically synthesized
agagugcggacgagaaug

SEQ ID NO: 11650 - RNA, 18 nt, artificial
  Chemically synthesized
gacggagaucggagcuuu

SEQ ID NO: 11651 - RNA, 18 nt, artificial
  Chemically synthesized
cccagcaacacaaagaau

SEQ ID NO: 11652 - RNA, 18 nt, artificial
  Chemically synthesized
aggagagagccgcugaua

SEQ ID NO: 11653 - RNA, 18 nt, artificial
  Chemically synthesized
gaacgcaagcagccgaga

SEQ ID NO: 11654 - RNA, 18 nt, artificial
  Chemically synthesized
gaaaggaugguugaguuu

SEQ ID NO: 11655 - RNA, 18 nt, artificial
  Chemically synthesized
cccagugcuuuugagaag

SEQ ID NO: 11656 - RNA, 18 nt, artificial
  Chemically synthesized
ccagaaaaagacggagag

SEQ ID NO: 11657 - RNA, 18 nt, artificial
  Chemically synthesized
gaacuggguuugaccucu

SEQ ID NO: 11658 - RNA, 18 nt, artificial
  Chemically synthesized
gggauuucgggaaugccu

SEQ ID NO: 11659 - RNA, 18 nt, artificial
  Chemically synthesized
gggaaucuuaacauuuag

SEQ ID NO: 11660 - RNA, 18 nt, artificial
  Chemically synthesized
agugugugcggaacgcaa

SEQ ID NO: 11661 - RNA, 18 nt, artificial
  Chemically synthesized
ggacgagaccaucgaggu

SEQ ID NO: 11662 - RNA, 18 nt, artificial
  Chemically synthesized
gcuccuuccacuuacugu

SEQ ID NO: 11663 - RNA, 18 nt, artificial
  Chemically synthesized
ggcaggagggaaagguua

SEQ ID NO: 11664 - RNA, 18 nt, artificial
  Chemically synthesized
cguugacaaaucagauga

SEQ ID NO: 11665 - RNA, 18 nt, artificial
  Chemically synthesized
cgagcuggacgagaccau

SEQ ID NO: 11666 - RNA, 18 nt, artificial
  Chemically synthesized
guauaguuauggucuguu

SEQ ID NO: 11667 - RNA, 18 nt, artificial
  Chemically synthesized
gcuauggacuaucggagu

SEQ ID NO: 11668 - RNA, 18 nt, artificial
  Chemically synthesized
caauaacaguuugucuga

SEQ ID NO: 11669 - RNA, 18 nt, artificial
  Chemically synthesized
ggaucaccugaaaaugcu

SEQ ID NO: 11670 - RNA, 18 nt, artificial
  Chemically synthesized
ugaguauaagccaacacu

SEQ ID NO: 11671 - RNA, 18 nt, artificial
  Chemically synthesized
acccagugcuuuugagaa

SEQ ID NO: 11672 - RNA, 18 nt, artificial
  Chemically synthesized
gcgagcuggacgagacca

SEQ ID NO: 11673 - RNA, 18 nt, artificial
  Chemically synthesized
ugauuuaguuaggagaga

SEQ ID NO: 11674 - RNA, 18 nt, artificial
  Chemically synthesized
cguuuuugccucaaaauu

SEQ ID NO: 11675 - RNA, 18 nt, artificial
  Chemically synthesized
cuuggcaagcccuauaga

SEQ ID NO: 11676 - RNA, 18 nt, artificial
  Chemically synthesized
cuguuguacugauguguu

SEQ ID NO: 11677 - RNA, 18 nt, artificial
  Chemically synthesized
gggaccgucuucggacau

SEQ ID NO: 11678 - RNA, 18 nt, artificial
  Chemically synthesized
ugagcaucauugaaggac

SEQ ID NO: 11679 - RNA, 18 nt, artificial
  Chemically synthesized
cacgcaggcugcaaaccu

SEQ ID NO: 11680 - RNA, 18 nt, artificial
  Chemically synthesized
acgagaccggaucaauaa

SEQ ID NO: 11681 - RNA, 18 nt, artificial
  Chemically synthesized
cuacaucuucccagauuu

SEQ ID NO: 11682 - RNA, 18 nt, artificial
  Chemically synthesized
cggaucaauaacaguuug

SEQ ID NO: 11683 - RNA, 18 nt, artificial
  Chemically synthesized
gugaguauaagccaacac

SEQ ID NO: 11684 - RNA, 18 nt, artificial
  Chemically synthesized
gaccucuguuguacugau

SEQ ID NO: 11685 - RNA, 18 nt, artificial
  Chemically synthesized
ccugaauccaucugacca

SEQ ID NO: 11686 - RNA, 18 nt, artificial
  Chemically synthesized
cuagaaaaagccgagauc

SEQ ID NO: 11687 - RNA, 18 nt, artificial
  Chemically synthesized
ccacuuacugucucccaa

SEQ ID NO: 11688 - RNA, 18 nt, artificial
  Chemically synthesized
gcucuagguuccaugucc

SEQ ID NO: 11689 - RNA, 18 nt, artificial
  Chemically synthesized
gugauagguuuguacugu

SEQ ID NO: 11690 - RNA, 18 nt, artificial
  Chemically synthesized
ggaaaggaugguugaguu

SEQ ID NO: 11691 - RNA, 18 nt, artificial
  Chemically synthesized
ggucuguuuuucuccuug

SEQ ID NO: 11692 - RNA, 18 nt, artificial
  Chemically synthesized
aagguuuguugguuuacu

SEQ ID NO: 11693 - RNA, 18 nt, artificial
  Chemically synthesized
gagguggagaaggagagu

SEQ ID NO: 11694 - RNA, 18 nt, artificial
  Chemically synthesized
acacggaucucaaauuca

SEQ ID NO: 11695 - RNA, 18 nt, artificial
  Chemically synthesized
ggacuguugccaacauca

SEQ ID NO: 11696 - RNA, 18 nt, artificial
  Chemically synthesized
gguacccagugcuuuuga

SEQ ID NO: 11697 - RNA, 18 nt, artificial
  Chemically synthesized
agguuuguugguuuacuu

SEQ ID NO: 11698 - RNA, 18 nt, artificial
  Chemically synthesized
ccgucuucggacaucacc

SEQ ID NO: 11699 - RNA, 18 nt, artificial
  Chemically synthesized
guguugguggaaaggaaa

SEQ ID NO: 11700 - RNA, 18 nt, artificial
  Chemically synthesized
acugguuucgcaucucaa

SEQ ID NO: 11701 - RNA, 18 nt, artificial
  Chemically synthesized
gaccgucuucggacauca

SEQ ID NO: 11702 - RNA, 18 nt, artificial
  Chemically synthesized
ugacaaaucagaugauca

SEQ ID NO: 11703 - RNA, 18 nt, artificial
  Chemically synthesized
gagaaggagagugcggac

SEQ ID NO: 11704 - RNA, 18 nt, artificial
  Chemically synthesized
auagaauacgccugcauu

SEQ ID NO: 11705 - RNA, 18 nt, artificial
  Chemically synthesized
agcuagaaaaagccgaga

SEQ ID NO: 11706 - RNA, 18 nt, artificial
  Chemically synthesized
gaucagugugugcggaac

SEQ ID NO: 11707 - RNA, 18 nt, artificial
  Chemically synthesized
gaauaauugagaagcgcc

SEQ ID NO: 11708 - RNA, 18 nt, artificial
  Chemically synthesized
agaaguugcgcguuaucu

SEQ ID NO: 11709 - RNA, 18 nt, artificial
  Chemically synthesized
cugugguugccaagguau

SEQ ID NO: 11710 - RNA, 18 nt, artificial
  Chemically synthesized
cgaguggucaauugagua

SEQ ID NO: 11711 - RNA, 18 nt, artificial
  Chemically synthesized
gagaaggcugguacccag

SEQ ID NO: 11712 - RNA, 18 nt, artificial
  Chemically synthesized
uauggacuaucggaguuu

SEQ ID NO: 11713 - RNA, 18 nt, artificial
  Chemically synthesized
aagccgagauccugcaga

SEQ ID NO: 11714 - RNA, 18 nt, artificial
  Chemically synthesized
ggaaugccuggcagaagu

SEQ ID NO: 11715 - RNA, 18 nt, artificial
  Chemically synthesized
ucaauugaguaguacagu

SEQ ID NO: 11716 - RNA, 18 nt, artificial
  Chemically synthesized
cuuugugauagguuugua

SEQ ID NO: 11717 - RNA, 18 nt, artificial
  Chemically synthesized
cacuuacugucucccaau

SEQ ID NO: 11718 - RNA, 18 nt, artificial
  Chemically synthesized
ggugugcgaguggucaau

SEQ ID NO: 11719 - RNA, 18 nt, artificial
  Chemically synthesized
cauugaaggacuagaugc

SEQ ID NO: 11720 - RNA, 18 nt, artificial
  Chemically synthesized
aucucaacaacuacgcuu

SEQ ID NO: 11721 - RNA, 18 nt, artificial
  Chemically synthesized
gccucugcucuccucagu

SEQ ID NO: 11722 - RNA, 18 nt, artificial
  Chemically synthesized
cgcugauagguuaggucu

SEQ ID NO: 11723 - RNA, 18 nt, artificial
  Chemically synthesized
gaaggcugguacccagug

SEQ ID NO: 11724 - RNA, 18 nt, artificial
  Chemically synthesized
ugcgaguggucaauugag

SEQ ID NO: 11725 - RNA, 18 nt, artificial
  Chemically synthesized
gguuaggucucauuugga

SEQ ID NO: 11726 - RNA, 18 nt, artificial
  Chemically synthesized
uggcaguucugauuuagu

SEQ ID NO: 11727 - RNA, 18 nt, artificial
  Chemically synthesized
gcguuaucugagcaucau

SEQ ID NO: 11728 - RNA, 18 nt, artificial
  Chemically synthesized
cccgcuucgaguucgacu

SEQ ID NO: 11729 - RNA, 18 nt, artificial
  Chemically synthesized
aacuugaguucggcucua

SEQ ID NO: 11730 - RNA, 18 nt, artificial
  Chemically synthesized
gggaaagguuacuuugac

SEQ ID NO: 11731 - RNA, 18 nt, artificial
  Chemically synthesized
cugaccagcugcugguau

SEQ ID NO: 11732 - RNA, 18 nt, artificial
  Chemically synthesized
ugagaagcgccgacgaga

SEQ ID NO: 11733 - RNA, 18 nt, artificial
  Chemically synthesized
guggagaaggagagugcg

SEQ ID NO: 11734 - RNA, 18 nt, artificial
  Chemically synthesized
cggaguuugggauuucgg

SEQ ID NO: 11735 - RNA, 18 nt, artificial
  Chemically synthesized
gaauacgccugcauuuac

SEQ ID NO: 11736 - RNA, 18 nt, artificial
  Chemically synthesized
aagacggagaggaauaau

SEQ ID NO: 11737 - RNA, 18 nt, artificial
  Chemically synthesized
agcguugacaaaucagau

SEQ ID NO: 11738 - RNA, 18 nt, artificial
  Chemically synthesized
agaaaaagccgagauccu

SEQ ID NO: 11739 - RNA, 18 nt, artificial
  Chemically synthesized
acacuuugugauagguuu

SEQ ID NO: 11740 - RNA, 18 nt, artificial
  Chemically synthesized
gcacugagcccuucagca

SEQ ID NO: 11741 - RNA, 18 nt, artificial
  Chemically synthesized
cccuugcuauggacuauc

SEQ ID NO: 11742 - RNA, 18 nt, artificial
  Chemically synthesized
ggcuuuccugccuccuuc

SEQ ID NO: 11743 - RNA, 18 nt, artificial
  Chemically synthesized
gacuaaagguuuguuggu

SEQ ID NO: 11744 - RNA, 18 nt, artificial
  Chemically synthesized
guuuuaaccagaggcaaa

SEQ ID NO: 11745 - RNA, 18 nt, artificial
  Chemically synthesized
guauaagccaacacuuug

SEQ ID NO: 11746 - RNA, 18 nt, artificial
  Chemically synthesized
gaauagaauacgccugca

SEQ ID NO: 11747 - RNA, 18 nt, artificial
  Chemically synthesized
aggucucauuuggagugu

SEQ ID NO: 11748 - RNA, 18 nt, artificial
  Chemically synthesized
cggaacgcaagcagccga

SEQ ID NO: 11749 - RNA, 18 nt, artificial
  Chemically synthesized
accagaaugauuccguuu

SEQ ID NO: 11750 - RNA, 18 nt, artificial
  Chemically synthesized
gcgugagcgggaucagug

SEQ ID NO: 11751 - RNA, 18 nt, artificial
  Chemically synthesized
gguuuguacugugccuaa

SEQ ID NO: 11752 - RNA, 18 nt, artificial
  Chemically synthesized
ugaccucuguuguacuga

SEQ ID NO: 11753 - RNA, 18 nt, artificial
  Chemically synthesized
acgagaauggaaacuuga

SEQ ID NO: 11754 - RNA, 18 nt, artificial
  Chemically synthesized
gauaagugaucauggugu

SEQ ID NO: 11755 - RNA, 18 nt, artificial
  Chemically synthesized
gggacugccauauuuucu

SEQ ID NO: 11756 - RNA, 18 nt, artificial
  Chemically synthesized
ugaucauggugugcgagu

SEQ ID NO: 11757 - RNA, 18 nt, artificial
  Chemically synthesized
guucgacugguuucgcau

SEQ ID NO: 11758 - RNA, 18 nt, artificial
  Chemically synthesized
agaggaauaauugagaag

SEQ ID NO: 11759 - RNA, 18 nt, artificial
  Chemically synthesized
caauugaguaguacagug

SEQ ID NO: 11760 - RNA, 18 nt, artificial
  Chemically synthesized
guaguacaguggaaacug

SEQ ID NO: 11761 - RNA, 18 nt, artificial
  Chemically synthesized
aggacuggcaguucugau

SEQ ID NO: 11762 - RNA, 18 nt, artificial
  Chemically synthesized
agugaguauaagccaaca

SEQ ID NO: 11763 - RNA, 18 nt, artificial
  Chemically synthesized
guuugggauuucgggaau

SEQ ID NO: 11764 - RNA, 18 nt, artificial
  Chemically synthesized
ggcaaagcgugagcggga

SEQ ID NO: 11765 - RNA, 18 nt, artificial
  Chemically synthesized
cggagaggcgccgcugua

SEQ ID NO: 11766 - RNA, 18 nt, artificial
  Chemically synthesized
cggacgagaauggaaacu

SEQ ID NO: 11767 - RNA, 18 nt, artificial
  Chemically synthesized
ggauaagugaucauggug

SEQ ID NO: 11768 - RNA, 18 nt, artificial
  Chemically synthesized
cguggaucaccugaaaau

SEQ ID NO: 11769 - RNA, 18 nt, artificial
  Chemically synthesized
agaaggcugguacccagu

SEQ ID NO: 11770 - RNA, 18 nt, artificial
  Chemically synthesized
ugaguucggcucuagguu

SEQ ID NO: 11771 - RNA, 18 nt, artificial
  Chemically synthesized
accggaucaauaacaguu

SEQ ID NO: 11772 - RNA, 18 nt, artificial
  Chemically synthesized
cuggguuugaccucuguu

SEQ ID NO: 11773 - RNA, 18 nt, artificial
  Chemically synthesized
ggugcucccuguggucac

SEQ ID NO: 11774 - RNA, 18 nt, artificial
  Chemically synthesized
cagcaugaagcgagcuca

SEQ ID NO: 11775 - RNA, 18 nt, artificial
  Chemically synthesized
ggacugccauauuuucuu

SEQ ID NO: 11776 - RNA, 18 nt, artificial
  Chemically synthesized
ccugggacugccauauuu

SEQ ID NO: 11777 - RNA, 18 nt, artificial
  Chemically synthesized
gagcuggacgagaccauc

SEQ ID NO: 11778 - RNA, 18 nt, artificial
  Chemically synthesized
agcgccgacgagaccgga

SEQ ID NO: 11779 - RNA, 18 nt, artificial
  Chemically synthesized
gccaacacuuugugauag

SEQ ID NO: 11780 - RNA, 18 nt, artificial
  Chemically synthesized
ggacuagaugccucugac

SEQ ID NO: 11781 - RNA, 18 nt, artificial
  Chemically synthesized
aaaggugaauguacaaac

SEQ ID NO: 11782 - RNA, 18 nt, artificial
  Chemically synthesized
cagcaacacaaagaauuu

SEQ ID NO: 11783 - RNA, 18 nt, artificial
  Chemically synthesized
guggucaauugaguagua

SEQ ID NO: 11784 - RNA, 18 nt, artificial
  Chemically synthesized
acuggcaguucugauuua

SEQ ID NO: 11785 - RNA, 18 nt, artificial
  Chemically synthesized
ccguuuuugccucaaaau

SEQ ID NO: 11786 - RNA, 18 nt, artificial
  Chemically synthesized
ccucugcucuccucagug

SEQ ID NO: 11787 - RNA, 18 nt, artificial
  Chemically synthesized
gcuggacuguugccaaca

SEQ ID NO: 11788 - RNA, 18 nt, artificial
  Chemically synthesized
guacugauguguugugac

SEQ ID NO: 11789 - RNA, 18 nt, artificial
  Chemically synthesized
agguauuuaaaagggcuu

SEQ ID NO: 11790 - RNA, 18 nt, artificial
  Chemically synthesized
guuucgcaucucaacaac

SEQ ID NO: 11791 - RNA, 18 nt, artificial
  Chemically synthesized
aucugagcaucauugaag

SEQ ID NO: 11792 - RNA, 18 nt, artificial
  Chemically synthesized
cagaaugauuccguuuuu

SEQ ID NO: 11793 - RNA, 18 nt, artificial
  Chemically synthesized
ugauguagaaugagggag

SEQ ID NO: 11794 - RNA, 18 nt, artificial
  Chemically synthesized
agauuuuggccagaaaaa

SEQ ID NO: 11795 - RNA, 18 nt, artificial
  Chemically synthesized
caaagcguugacaaauca

SEQ ID NO: 11796 - RNA, 18 nt, artificial
  Chemically synthesized
agggaaagguuacuuuga

SEQ ID NO: 11797 - RNA, 18 nt, artificial
  Chemically synthesized
cguuaucugagcaucauu

SEQ ID NO: 11798 - RNA, 18 nt, artificial
  Chemically synthesized
gcacgcccuugcuaugga

SEQ ID NO: 11799 - RNA, 18 nt, artificial
  Chemically synthesized
guugacaaaucagaugau

SEQ ID NO: 11800 - RNA, 18 nt, artificial
  Chemically synthesized
augucauguauuagcagu

SEQ ID NO: 11801 - RNA, 18 nt, artificial
  Chemically synthesized
cagugcuuuugagaagca

SEQ ID NO: 11802 - RNA, 18 nt, artificial
  Chemically synthesized
acaguuugucugagcuga

SEQ ID NO: 11803 - RNA, 18 nt, artificial
  Chemically synthesized
cacggaaccgcaccacca

SEQ ID NO: 11804 - RNA, 18 nt, artificial
  Chemically synthesized
guuguacugauguguugu

SEQ ID NO: 11805 - RNA, 18 nt, artificial
  Chemically synthesized
acggagaggaauaauuga

SEQ ID NO: 11806 - RNA, 18 nt, artificial
  Chemically synthesized
cuuuguaaaccagaauga

SEQ ID NO: 11807 - RNA, 18 nt, artificial
  Chemically synthesized
agcagccgagagcggaga

SEQ ID NO: 11808 - RNA, 18 nt, artificial
  Chemically synthesized
agaccggaucaauaacag

SEQ ID NO: 11809 - RNA, 18 nt, artificial
  Chemically synthesized
cacaaauguuaacaugga

SEQ ID NO: 11810 - RNA, 18 nt, artificial
  Chemically synthesized
cgcgcacgcccuugcuau

SEQ ID NO: 11811 - RNA, 18 nt, artificial
  Chemically synthesized
gcccuugcuauggacuau

SEQ ID NO: 11812 - RNA, 18 nt, artificial
  Chemically synthesized
caucgagguggagaagga

SEQ ID NO: 11813 - RNA, 18 nt, artificial
  Chemically synthesized
auagugaguauaagccaa

SEQ ID NO: 11814 - RNA, 18 nt, artificial
  Chemically synthesized
guuuguacugugccuaau

SEQ ID NO: 11815 - RNA, 18 nt, artificial
  Chemically synthesized
gccugcauuuaccagccc

SEQ ID NO: 11816 - RNA, 18 nt, artificial
  Chemically synthesized
auccaagaaagaagacua

SEQ ID NO: 11817 - RNA, 18 nt, artificial
  Chemically synthesized
aagcguugacaaaucaga

SEQ ID NO: 11818 - RNA, 18 nt, artificial
  Chemically synthesized
gcugagaaggcugguacc

SEQ ID NO: 11819 - RNA, 18 nt, artificial
  Chemically synthesized
cgcgggccucggacacau

SEQ ID NO: 11820 - RNA, 18 nt, artificial
  Chemically synthesized
agaugaccguggaucacc

SEQ ID NO: 11821 - RNA, 18 nt, artificial
  Chemically synthesized
gaguggucaauugaguag

SEQ ID NO: 11822 - RNA, 18 nt, artificial
  Chemically synthesized
augguugaguuuuaacca

SEQ ID NO: 11823 - RNA, 18 nt, artificial
  Chemically synthesized
cuggcaguucugauuuag

SEQ ID NO: 11824 - RNA, 18 nt, artificial
  Chemically synthesized
ggcuccuuccacuuacug

SEQ ID NO: 11825 - RNA, 18 nt, artificial
  Chemically synthesized
gccucggacacauucccu

SEQ ID NO: 11826 - RNA, 18 nt, artificial
  Chemically synthesized
agagccgcugauagguua

SEQ ID NO: 11827 - RNA, 18 nt, artificial
  Chemically synthesized
caguucugauuuaguuag

SEQ ID NO: 11828 - RNA, 18 nt, artificial
  Chemically synthesized
cggagcuuuuuaaagaac

SEQ ID NO: 11829 - RNA, 18 nt, artificial
  Chemically synthesized
gucaccuccgccuccaaa

SEQ ID NO: 11830 - RNA, 18 nt, artificial
  Chemically synthesized
agccgagauccugcagau

SEQ ID NO: 11831 - RNA, 18 nt, artificial
  Chemically synthesized
ccuuccacuuacugucuc

SEQ ID NO: 11832 - RNA, 18 nt, artificial
  Chemically synthesized
ccgcuguaguuaacuccu

SEQ ID NO: 11833 - RNA, 18 nt, artificial
  Chemically synthesized
ccagggagccagcaugaa

SEQ ID NO: 11834 - RNA, 18 nt, artificial
  Chemically synthesized
ggaaacuugaguucggcu

SEQ ID NO: 11835 - RNA, 18 nt, artificial
  Chemically synthesized
cacugaacuggguuugac

SEQ ID NO: 11836 - RNA, 18 nt, artificial
  Chemically synthesized
guugaguuuuaaccagag

SEQ ID NO: 11837 - RNA, 18 nt, artificial
  Chemically synthesized
ccaacaucaccuuaaagu

SEQ ID NO: 11838 - RNA, 18 nt, artificial
  Chemically synthesized
guuugaccucuguuguac

SEQ ID NO: 11839 - RNA, 18 nt, artificial
  Chemically synthesized
cuuuugagaagcagggau

SEQ ID NO: 11840 - RNA, 18 nt, artificial
  Chemically synthesized
gaccaucgagguggagaa

SEQ ID NO: 11841 - RNA, 18 nt, artificial
  Chemically synthesized
gugaauguacaaacuguu

SEQ ID NO: 11842 - RNA, 18 nt, artificial
  Chemically synthesized
agugcuuuugagaagcag

SEQ ID NO: 11843 - RNA, 18 nt, artificial
  Chemically synthesized
aucagaugaucagcuuua

SEQ ID NO: 11844 - RNA, 18 nt, artificial
  Chemically synthesized
gugaguuuuccuuuuggu

SEQ ID NO: 11845 - RNA, 18 nt, artificial
  Chemically synthesized
ggauuucgggaaugccug

SEQ ID NO: 11846 - RNA, 18 nt, artificial
  Chemically synthesized
gaauguacaaacuguugg

SEQ ID NO: 11847 - RNA, 18 nt, artificial
  Chemically synthesized
cgagaauggaaacuugag

SEQ ID NO: 11848 - RNA, 18 nt, artificial
  Chemically synthesized
cauggauaagugaucaug

SEQ ID NO: 11849 - RNA, 18 nt, artificial
  Chemically synthesized
caagcccuauagaccuug

SEQ ID NO: 11850 - RNA, 18 nt, artificial
  Chemically synthesized
gccuccuauagcagaaag

SEQ ID NO: 11851 - RNA, 18 nt, artificial
  Chemically synthesized
aggaauaauugagaagcg

SEQ ID NO: 11852 - RNA, 18 nt, artificial
  Chemically synthesized
caugucauguauuagcag

SEQ ID NO: 11853 - RNA, 18 nt, artificial
  Chemically synthesized
agacuaaagguuuguugg

SEQ ID NO: 11854 - RNA, 18 nt, artificial
  Chemically synthesized
caagguauuuaaaagggc

SEQ ID NO: 11855 - RNA, 18 nt, artificial
  Chemically synthesized
uuggaguguugguggaaa

SEQ ID NO: 11856 - RNA, 18 nt, artificial
  Chemically synthesized
agagagccgcugauaggu

SEQ ID NO: 11857 - RNA, 18 nt, artificial
  Chemically synthesized
gcgggaucagugugugcg

SEQ ID NO: 11858 - RNA, 18 nt, artificial
  Chemically synthesized
uaucggaguuugggauuu

SEQ ID NO: 11859 - RNA, 18 nt, artificial
  Chemically synthesized
ccacugaacuggguuuga

SEQ ID NO: 11860 - RNA, 18 nt, artificial
  Chemically synthesized
ccuccacugaacuggguu

SEQ ID NO: 11861 - RNA, 18 nt, artificial
  Chemically synthesized
aaaggaaacugaagguaa

SEQ ID NO: 11862 - RNA, 18 nt, artificial
  Chemically synthesized
uggcaagcccuauagacc

SEQ ID NO: 11863 - RNA, 18 nt, artificial
  Chemically synthesized
gcuuuugagaagcaggga

SEQ ID NO: 11864 - RNA, 18 nt, artificial
  Chemically synthesized
gcauaaccuaauuuuccu

SEQ ID NO: 11865 - RNA, 18 nt, artificial
  Chemically synthesized
cagcgagcuggacgagac

SEQ ID NO: 11866 - RNA, 18 nt, artificial
  Chemically synthesized
agcgugagcgggaucagu

SEQ ID NO: 11867 - RNA, 18 nt, artificial
  Chemically synthesized
ugucugagcugagaaggc

SEQ ID NO: 11868 - RNA, 18 nt, artificial
  Chemically synthesized
agaacugauguagaauga

SEQ ID NO: 11869 - RNA, 18 nt, artificial
  Chemically synthesized
cucugacccgcuucgagu

SEQ ID NO: 11870 - RNA, 18 nt, artificial
  Chemically synthesized
gaagcagggaucugcuaa

SEQ ID NO: 11871 - RNA, 18 nt, artificial
  Chemically synthesized
aacacuuugugauagguu

SEQ ID NO: 11872 - RNA, 18 nt, artificial
  Chemically synthesized
ccuucucuuucggcuccu

SEQ ID NO: 11873 - RNA, 18 nt, artificial
  Chemically synthesized
cgaguacagcuccucgga

SEQ ID NO: 11874 - RNA, 18 nt, artificial
  Chemically synthesized
aguuugggauuucgggaa

SEQ ID NO: 11875 - RNA, 18 nt, artificial
  Chemically synthesized
ccaaugcacugagcccuu

SEQ ID NO: 11876 - RNA, 18 nt, artificial
  Chemically synthesized
cccaaugcacugagcccu

SEQ ID NO: 11877 - RNA, 18 nt, artificial
  Chemically synthesized
ucgagguggagaaggaga

SEQ ID NO: 11878 - RNA, 18 nt, artificial
  Chemically synthesized
cuauagcagaaaggugaa

SEQ ID NO: 11879 - RNA, 18 nt, artificial
  Chemically synthesized
uguacugugccuaauuua

SEQ ID NO: 11880 - RNA, 18 nt, artificial
  Chemically synthesized
ggcucggcacauccggag

SEQ ID NO: 11881 - RNA, 18 nt, artificial
  Chemically synthesized
ggagaggcgccgcuguag

SEQ ID NO: 11882 - RNA, 18 nt, artificial
  Chemically synthesized
ccuucagcacccacgcag

SEQ ID NO: 11883 - RNA, 18 nt, artificial
  Chemically synthesized
gugugcggaacgcaagca

SEQ ID NO: 11884 - RNA, 18 nt, artificial
  Chemically synthesized
cacugagcccuucagcac

SEQ ID NO: 11885 - RNA, 18 nt, artificial
  Chemically synthesized
gaguaguacaguggaaac

SEQ ID NO: 11886 - RNA, 18 nt, artificial
  Chemically synthesized
gagaggcgccgcuguagu

SEQ ID NO: 11887 - RNA, 18 nt, artificial
  Chemically synthesized
gcagaaguugcgcguuau

SEQ ID NO: 11888 - RNA, 18 nt, artificial
  Chemically synthesized
uggugugcgaguggucaa

SEQ ID NO: 11889 - RNA, 18 nt, artificial
  Chemically synthesized
ugugguugccaagguauu

SEQ ID NO: 11890 - RNA, 18 nt, artificial
  Chemically synthesized
gcaagcccuauagaccuu

SEQ ID NO: 11891 - RNA, 18 nt, artificial
  Chemically synthesized
aguacagcuccucggaca

SEQ ID NO: 11892 - RNA, 18 nt, artificial
  Chemically synthesized
gcaugaagcgagcucacc

SEQ ID NO: 11893 - RNA, 18 nt, artificial
  Chemically synthesized
cagggagccagcaugaag

SEQ ID NO: 11894 - RNA, 18 nt, artificial
  Chemically synthesized
ccucggacacauucccug

SEQ ID NO: 11895 - RNA, 18 nt, artificial
  Chemically synthesized
gggcucggcacauccgga

SEQ ID NO: 11896 - RNA, 18 nt, artificial
  Chemically synthesized
gugugugcggaacgcaag

SEQ ID NO: 11897 - RNA, 18 nt, artificial
  Chemically synthesized
uccuuuuggugcauggaa

SEQ ID NO: 11898 - RNA, 18 nt, artificial
  Chemically synthesized
cggacaucacccgcacau

SEQ ID NO: 11899 - RNA, 18 nt, artificial
  Chemically synthesized
ccgagagcggagaggcgc

SEQ ID NO: 11900 - RNA, 18 nt, artificial
  Chemically synthesized
caaaucagaugaucagcu

SEQ ID NO: 11901 - RNA, 18 nt, artificial
  Chemically synthesized
cucuguuguacugaugug

SEQ ID NO: 11902 - RNA, 18 nt, artificial
  Chemically synthesized
gucucauuuggaguguug

SEQ ID NO: 11903 - RNA, 18 nt, artificial
  Chemically synthesized
accuaauuuuccugggac

SEQ ID NO: 11904 - RNA, 18 nt, artificial
  Chemically synthesized
ccgccucugcucuccuca

SEQ ID NO: 11905 - RNA, 18 nt, artificial
  Chemically synthesized
ucugauuuaguuaggaga

SEQ ID NO: 11906 - RNA, 18 nt, artificial
  Chemically synthesized
ccaagguauuuaaaaggg

SEQ ID NO: 11907 - RNA, 18 nt, artificial
  Chemically synthesized
ugcuauggacuaucggag

SEQ ID NO: 11908 - RNA, 18 nt, artificial
  Chemically synthesized
ccuuuuggugcauggaac

SEQ ID NO: 11909 - RNA, 18 nt, artificial
  Chemically synthesized
caaaccacuaugcuuaau

SEQ ID NO: 11910 - RNA, 18 nt, artificial
  Chemically synthesized
aauagaauacgccugcau

SEQ ID NO: 11911 - RNA, 18 nt, artificial
  Chemically synthesized
aggacuagaugccucuga

SEQ ID NO: 11912 - RNA, 18 nt, artificial
  Chemically synthesized
caacuacaucuucccaga

SEQ ID NO: 11913 - RNA, 18 nt, artificial
  Chemically synthesized
cgggaaugccuggcagaa

SEQ ID NO: 11914 - RNA, 18 nt, artificial
  Chemically synthesized
cuugaguucggcucuagg

SEQ ID NO: 11915 - RNA, 18 nt, artificial
  Chemically synthesized
uguacugauguguuguga

SEQ ID NO: 11916 - RNA, 18 nt, artificial
  Chemically synthesized
cgcuguaguuaacuccuc

SEQ ID NO: 11917 - RNA, 18 nt, artificial
  Chemically synthesized
gaaaaagccgagauccug

SEQ ID NO: 11918 - RNA, 18 nt, artificial
  Chemically synthesized
gacuguugccaacaucac

SEQ ID NO: 11919 - RNA, 18 nt, artificial
  Chemically synthesized
auugaauagaauacgccu

SEQ ID NO: 11920 - RNA, 18 nt, artificial
  Chemically synthesized
gagaagcgccgacgagac

SEQ ID NO: 11921 - RNA, 18 nt, artificial
  Chemically synthesized
acuaucggaguuugggau

SEQ ID NO: 11922 - RNA, 18 nt, artificial
  Chemically synthesized
cuggacuguugccaacau

SEQ ID NO: 11923 - RNA, 18 nt, artificial
  Chemically synthesized
caacaacuacgcuuccca

SEQ ID NO: 11924 - RNA, 18 nt, artificial
  Chemically synthesized
gaauccaucugaccagcu

SEQ ID NO: 11925 - RNA, 18 nt, artificial
  Chemically synthesized
guggaaaggaaacugaag

SEQ ID NO: 11926 - RNA, 18 nt, artificial
  Chemically synthesized
ucugcuaagcuagaaaaa

SEQ ID NO: 11927 - RNA, 18 nt, artificial
  Chemically synthesized
aucggaguuugggauuuc

SEQ ID NO: 11928 - RNA, 18 nt, artificial
  Chemically synthesized
aguuuaaaaucccagcug

SEQ ID NO: 11929 - RNA, 18 nt, artificial
  Chemically synthesized
cuauggacuaucggaguu

SEQ ID NO: 11930 - RNA, 18 nt, artificial
  Chemically synthesized
gcccugaauccaucugac

SEQ ID NO: 11931 - RNA, 18 nt, artificial
  Chemically synthesized
gggccucggacacauucc

SEQ ID NO: 11932 - RNA, 18 nt, artificial
  Chemically synthesized
aucacacggaucucaaau

SEQ ID NO: 11933 - RNA, 18 nt, artificial
  Chemically synthesized
aaaccagaaugauuccgu

SEQ ID NO: 11934 - RNA, 18 nt, artificial
  Chemically synthesized
cgagauccugcagaugac

SEQ ID NO: 11935 - RNA, 18 nt, artificial
  Chemically synthesized
guaguuaacuccucccug

SEQ ID NO: 11936 - RNA, 18 nt, artificial
  Chemically synthesized
gugggaaaggaugguuga

SEQ ID NO: 11937 - RNA, 18 nt, artificial
  Chemically synthesized
gcugguaucugccaggac

SEQ ID NO: 11938 - RNA, 18 nt, artificial
  Chemically synthesized
ccuccgccuccaaacugu

SEQ ID NO: 11939 - RNA, 18 nt, artificial
  Chemically synthesized
agaucggagcuuuuuaaa

SEQ ID NO: 11940 - RNA, 18 nt, artificial
  Chemically synthesized
accuuggcaagcccuaua

SEQ ID NO: 11941 - RNA, 18 nt, artificial
  Chemically synthesized
gcgggccucggacacauu

SEQ ID NO: 11942 - RNA, 18 nt, artificial
  Chemically synthesized
cgcguuaucugagcauca

SEQ ID NO: 11943 - RNA, 18 nt, artificial
  Chemically synthesized
caucaugucauguauuag

SEQ ID NO: 11944 - RNA, 18 nt, artificial
  Chemically synthesized
gaaacuugaguucggcuc

SEQ ID NO: 11945 - RNA, 18 nt, artificial
  Chemically synthesized
guucggcucuagguucca

SEQ ID NO: 11946 - RNA, 18 nt, artificial
  Chemically synthesized
uguacaaacuguuggugg

SEQ ID NO: 11947 - RNA, 18 nt, artificial
  Chemically synthesized
gcagaugaccguggauca

SEQ ID NO: 11948 - RNA, 18 nt, artificial
  Chemically synthesized
gaagacuaguaaauuguc

SEQ ID NO: 11949 - RNA, 18 nt, artificial
  Chemically synthesized
gacaaaucagaugaucag

SEQ ID NO: 11950 - RNA, 18 nt, artificial
  Chemically synthesized
gacgagaccaucgaggug

SEQ ID NO: 11951 - RNA, 18 nt, artificial
  Chemically synthesized
cgugagcgggaucagugu

SEQ ID NO: 11952 - RNA, 18 nt, artificial
  Chemically synthesized
cugggacugccauauuuu

SEQ ID NO: 11953 - RNA, 18 nt, artificial
  Chemically synthesized
ggacaucacccgcacauc

SEQ ID NO: 11954 - RNA, 18 nt, artificial
  Chemically synthesized
aguucgacugguuucgca

SEQ ID NO: 11955 - RNA, 18 nt, artificial
  Chemically synthesized
agccgagagcggagaggc

SEQ ID NO: 11956 - RNA, 18 nt, artificial
  Chemically synthesized
gcggacgagaauggaaac

SEQ ID NO: 11957 - RNA, 18 nt, artificial
  Chemically synthesized
cgagguggagaaggagag

SEQ ID NO: 11958 - RNA, 18 nt, artificial
  Chemically synthesized
acuugaguucggcucuag

SEQ ID NO: 11959 - RNA, 18 nt, artificial
  Chemically synthesized
guggaucaccugaaaaug

SEQ ID NO: 11960 - RNA, 18 nt, artificial
  Chemically synthesized
gauuuaguuaggagagag

SEQ ID NO: 11961 - RNA, 18 nt, artificial
  Chemically synthesized
gaauggaaacuugaguuc

SEQ ID NO: 11962 - RNA, 18 nt, artificial
  Chemically synthesized
agcccuucagcacccacg

SEQ ID NO: 11963 - RNA, 18 nt, artificial
  Chemically synthesized
gcgccgcuguaguuaacu

SEQ ID NO: 11964 - RNA, 18 nt, artificial
  Chemically synthesized
agcuccucggacagcgag

SEQ ID NO: 11965 - RNA, 18 nt, artificial
  Chemically synthesized
augaucagcuuuauccaa

SEQ ID NO: 11966 - RNA, 18 nt, artificial
  Chemically synthesized
ccugcagaugaccgugga

SEQ ID NO: 11967 - RNA, 18 nt, artificial
  Chemically synthesized
cuuucggcuccuuccacu

SEQ ID NO: 11968 - RNA, 18 nt, artificial
  Chemically synthesized
guauuuaaaagggcuuuc

SEQ ID NO: 11969 - RNA, 18 nt, artificial
  Chemically synthesized
aggcugguacccagugcu

SEQ ID NO: 11970 - RNA, 18 nt, artificial
  Chemically synthesized
cggcucuagguuccaugu

SEQ ID NO: 11971 - RNA, 18 nt, artificial
  Chemically synthesized
acuaaagguuuguugguu

SEQ ID NO: 11972 - RNA, 18 nt, artificial
  Chemically synthesized
ugucauguauuagcaguu

SEQ ID NO: 11973 - RNA, 18 nt, artificial
  Chemically synthesized
aaagguuuguugguuuac

SEQ ID NO: 11974 - RNA, 18 nt, artificial
  Chemically synthesized
gcugcaaaccuuggcaag

SEQ ID NO: 11975 - RNA, 18 nt, artificial
  Chemically synthesized
aguaguacaguggaaacu

SEQ ID NO: 11976 - RNA, 18 nt, artificial
  Chemically synthesized
ccuuguauaguuaugguc

SEQ ID NO: 11977 - RNA, 18 nt, artificial
  Chemically synthesized
ggaaaguuuaaaauccca

SEQ ID NO: 11978 - RNA, 18 nt, artificial
  Chemically synthesized
guucugauuuaguuagga

SEQ ID NO: 11979 - RNA, 18 nt, artificial
  Chemically synthesized
gccaagguauuuaaaagg

SEQ ID NO: 11980 - RNA, 18 nt, artificial
  Chemically synthesized
ugcauaaccuaauuuucc

SEQ ID NO: 11981 - RNA, 18 nt, artificial
  Chemically synthesized
aggaaacugaagguaauu

SEQ ID NO: 11982 - RNA, 18 nt, artificial
  Chemically synthesized
cugccuccuucucuuuga

SEQ ID NO: 11983 - RNA, 18 nt, artificial
  Chemically synthesized
ggcaggcugggcucggca

SEQ ID NO: 11984 - RNA, 18 nt, artificial
  Chemically synthesized
gcauggaacugugguugc

SEQ ID NO: 11985 - RNA, 18 nt, artificial
  Chemically synthesized
cgggccucggacacauuc

SEQ ID NO: 11986 - RNA, 18 nt, artificial
  Chemically synthesized
gcaccaccagggcaggcu

SEQ ID NO: 11987 - RNA, 18 nt, artificial
  Chemically synthesized
uucgcaucucaacaacua

SEQ ID NO: 11988 - RNA, 18 nt, artificial
  Chemically synthesized
gcuaagcuagaaaaagcc

SEQ ID NO: 11989 - RNA, 18 nt, artificial
  Chemically synthesized
ccuaauuuuccugggacu

SEQ ID NO: 11990 - RNA, 18 nt, artificial
  Chemically synthesized
uggguuugaccucuguug

SEQ ID NO: 11991 - RNA, 18 nt, artificial
  Chemically synthesized
caggacuggcaguucuga

SEQ ID NO: 11992 - RNA, 18 nt, artificial
  Chemically synthesized
gaagcgccgacgagaccg

SEQ ID NO: 11993 - RNA, 18 nt, artificial
  Chemically synthesized
agcggagaggcgccgcug

SEQ ID NO: 11994 - RNA, 18 nt, artificial
  Chemically synthesized
cgcaagcagccgagagcg

SEQ ID NO: 11995 - RNA, 18 nt, artificial
  Chemically synthesized
ucauugaaggacuagaug

SEQ ID NO: 11996 - RNA, 18 nt, artificial
  Chemically synthesized
ggacagcgagcuggacga

SEQ ID NO: 11997 - RNA, 18 nt, artificial
  Chemically synthesized
auagcagaaaggugaaug

SEQ ID NO: 11998 - RNA, 18 nt, artificial
  Chemically synthesized
cgccucugcucuccucag

SEQ ID NO: 11999 - RNA, 18 nt, artificial
  Chemically synthesized
gagagagccgcugauagg

SEQ ID NO: 12000 - RNA, 18 nt, artificial
  Chemically synthesized
ucacacggaucucaaauu

SEQ ID NO: 12001 - RNA, 18 nt, artificial
  Chemically synthesized
agcaucauugaaggacua

SEQ ID NO: 12002 - RNA, 18 nt, artificial
  Chemically synthesized
gaaggacuagaugccucu

SEQ ID NO: 12003 - RNA, 18 nt, artificial
  Chemically synthesized
cuccacugaacuggguuu

SEQ ID NO: 12004 - RNA, 18 nt, artificial
  Chemically synthesized
gagcccuucagcacccac

SEQ ID NO: 12005 - RNA, 18 nt, artificial
  Chemically synthesized
ccuccuauagcagaaagg

SEQ ID NO: 12006 - RNA, 18 nt, artificial
  Chemically synthesized
aagacuaaagguuuguug

SEQ ID NO: 12007 - RNA, 18 nt, artificial
  Chemically synthesized
gucaauugaguaguacag

SEQ ID NO: 12008 - RNA, 18 nt, artificial
  Chemically synthesized
cgccgccucugcucuccu

SEQ ID NO: 12009 - RNA, 18 nt, artificial
  Chemically synthesized
ccuccaaacugucgccgc

SEQ ID NO: 12010 - RNA, 18 nt, artificial
  Chemically synthesized
guuaacauggauaaguga

SEQ ID NO: 12011 - RNA, 18 nt, artificial
  Chemically synthesized
aauaacaguuugucugag

SEQ ID NO: 12012 - RNA, 18 nt, artificial
  Chemically synthesized
caucucaacaacuacgcu

SEQ ID NO: 12013 - RNA, 18 nt, artificial
  Chemically synthesized
acagauuaagguguugua

SEQ ID NO: 12014 - RNA, 18 nt, artificial
  Chemically synthesized
uggucuguuuuucuccuu

SEQ ID NO: 12015 - RNA, 18 nt, artificial
  Chemically synthesized
cccuucagcacccacgca

SEQ ID NO: 12016 - RNA, 18 nt, artificial
  Chemically synthesized
gccucugacccgcuucga

SEQ ID NO: 12017 - RNA, 18 nt, artificial
  Chemically synthesized
uaagcuagaaaaagccga

SEQ ID NO: 12018 - RNA, 18 nt, artificial
  Chemically synthesized
ucggcuccuuccacuuac

SEQ ID NO: 12019 - RNA, 18 nt, artificial
  Chemically synthesized
cugguacccagugcuuuu

SEQ ID NO: 12020 - RNA, 18 nt, artificial
  Chemically synthesized
auagguuaggucucauuu

SEQ ID NO: 12021 - RNA, 18 nt, artificial
  Chemically synthesized
ggcgccugcuuugcgagc

SEQ ID NO: 12022 - RNA, 18 nt, artificial
  Chemically synthesized
gaggcgccugcuuugcga

SEQ ID NO: 12023 - RNA, 18 nt, artificial
  Chemically synthesized
acccacgcaggcugcaaa

SEQ ID NO: 12024 - RNA, 18 nt, artificial
  Chemically synthesized
ccucaguggccucccugu

SEQ ID NO: 12025 - RNA, 18 nt, artificial
  Chemically synthesized
cugcaaaccuuggcaagc

SEQ ID NO: 12026 - RNA, 18 nt, artificial
  Chemically synthesized
cuagcggcagccucggac

SEQ ID NO: 12027 - RNA, 18 nt, artificial
  Chemically synthesized
uccggaggcgccugcuuu

SEQ ID NO: 12028 - RNA, 18 nt, artificial
  Chemically synthesized
auugagaagcgccgacga

SEQ ID NO: 12029 - RNA, 18 nt, artificial
  Chemically synthesized
gcagccgagagcggagag

SEQ ID NO: 12030 - RNA, 18 nt, artificial
  Chemically synthesized
guugguggaaaggaaacu

SEQ ID NO: 12031 - RNA, 18 nt, artificial
  Chemically synthesized
gucucccaaugcacugag

SEQ ID NO: 12032 - RNA, 18 nt, artificial
  Chemically synthesized
ugcuaagcuagaaaaagc

SEQ ID NO: 12033 - RNA, 18 nt, artificial
  Chemically synthesized
guuuauucuuuuagcagg

SEQ ID NO: 12034 - RNA, 18 nt, artificial
  Chemically synthesized
cagcugggcuggacuguu

SEQ ID NO: 12035 - RNA, 18 nt, artificial
  Chemically synthesized
cuucgaguucgacugguu

SEQ ID NO: 12036 - RNA, 18 nt, artificial
  Chemically synthesized
accuccgccuccaaacug

SEQ ID NO: 12037 - RNA, 18 nt, artificial
  Chemically synthesized
cucccaaugcacugagcc

SEQ ID NO: 12038 - RNA, 18 nt, artificial
  Chemically synthesized
uucgaguucgacugguuu

SEQ ID NO: 12039 - RNA, 18 nt, artificial
  Chemically synthesized
gcaucucaacaacuacgc

SEQ ID NO: 12040 - RNA, 18 nt, artificial
  Chemically synthesized
cugauguagaaugaggga

SEQ ID NO: 12041 - RNA, 18 nt, artificial
  Chemically synthesized
cugugccuaauuuacuuu

SEQ ID NO: 12042 - RNA, 18 nt, artificial
  Chemically synthesized
ugagaagcagggaucugc

SEQ ID NO: 12043 - RNA, 18 nt, artificial
  Chemically synthesized
gcgccugcuuugcgagcg

SEQ ID NO: 12044 - RNA, 18 nt, artificial
  Chemically synthesized
gggaacgcgggcaccacg

SEQ ID NO: 12045 - RNA, 18 nt, artificial
  Chemically synthesized
gaaauagugaguauaagc

SEQ ID NO: 12046 - RNA, 18 nt, artificial
  Chemically synthesized
cagaugaucagcuuuauc

SEQ ID NO: 12047 - RNA, 18 nt, artificial
  Chemically synthesized
cucuuucggcuccuucca

SEQ ID NO: 12048 - RNA, 18 nt, artificial
  Chemically synthesized
cuggacgagaccaucgag

SEQ ID NO: 12049 - RNA, 18 nt, artificial
  Chemically synthesized
cggugcucccugugguca

SEQ ID NO: 12050 - RNA, 18 nt, artificial
  Chemically synthesized
uuuggugcauggaacugu

SEQ ID NO: 12051 - RNA, 18 nt, artificial
  Chemically synthesized
ccaaaccacuaugcuuaa

SEQ ID NO: 12052 - RNA, 18 nt, artificial
  Chemically synthesized
cuucggacaucacccgca

SEQ ID NO: 12053 - RNA, 18 nt, artificial
  Chemically synthesized
ugguggcccugaauccau

SEQ ID NO: 12054 - RNA, 18 nt, artificial
  Chemically synthesized
uagaaaaagccgagaucc

SEQ ID NO: 12055 - RNA, 18 nt, artificial
  Chemically synthesized
aaggugaauguacaaacu

SEQ ID NO: 12056 - RNA, 18 nt, artificial
  Chemically synthesized
uggauaagugaucauggu

SEQ ID NO: 12057 - RNA, 18 nt, artificial
  Chemically synthesized
uuggcaagcccuauagac

SEQ ID NO: 12058 - RNA, 18 nt, artificial
  Chemically synthesized
ccugaaaaugcugcauac

SEQ ID NO: 12059 - RNA, 18 nt, artificial
  Chemically synthesized
cccaacuacaucuuccca

SEQ ID NO: 12060 - RNA, 18 nt, artificial
  Chemically synthesized
aauggaaacuugaguucg

SEQ ID NO: 12061 - RNA, 18 nt, artificial
  Chemically synthesized
agaauggaaacuugaguu

SEQ ID NO: 12062 - RNA, 18 nt, artificial
  Chemically synthesized
gcgugggaaaggaugguu

SEQ ID NO: 12063 - RNA, 18 nt, artificial
  Chemically synthesized
cccagcgggaagccgcga

SEQ ID NO: 12064 - RNA, 18 nt, artificial
  Chemically synthesized
auaauugagaagcgccga

SEQ ID NO: 12065 - RNA, 18 nt, artificial
  Chemically synthesized
cugaaaaugcugcauacg

SEQ ID NO: 12066 - RNA, 18 nt, artificial
  Chemically synthesized
gcucagcgugggaaagga

SEQ ID NO: 12067 - RNA, 18 nt, artificial
  Chemically synthesized
acugugguugccaaggua

SEQ ID NO: 12068 - RNA, 18 nt, artificial
  Chemically synthesized
ugaaaaugcugcauacgg

SEQ ID NO: 12069 - RNA, 18 nt, artificial
  Chemically synthesized
aguugcgcguuaucugag

SEQ ID NO: 12070 - RNA, 18 nt, artificial
  Chemically synthesized
caguggaaacuguuaaau

SEQ ID NO: 12071 - RNA, 18 nt, artificial
  Chemically synthesized
ccaucugaccagcugcug

SEQ ID NO: 12072 - RNA, 18 nt, artificial
  Chemically synthesized
uccugggacugccauauu

SEQ ID NO: 12073 - RNA, 18 nt, artificial
  Chemically synthesized
gugcggaacgcaagcagc

SEQ ID NO: 12074 - RNA, 18 nt, artificial
  Chemically synthesized
cgccugcauuuaccagcc

SEQ ID NO: 12075 - RNA, 18 nt, artificial
  Chemically synthesized
gagcggagaggcgccgcu

SEQ ID NO: 12076 - RNA, 18 nt, artificial
  Chemically synthesized
ggcugggcucggcacauc

SEQ ID NO: 12077 - RNA, 18 nt, artificial
  Chemically synthesized
aaaucagaugaucagcuu

SEQ ID NO: 12078 - RNA, 18 nt, artificial
  Chemically synthesized
auggacuaucggaguuug

SEQ ID NO: 12079 - RNA, 18 nt, artificial
  Chemically synthesized
gaggcaaagcgugagcgg

SEQ ID NO: 12080 - RNA, 18 nt, artificial
  Chemically synthesized
cugguaucugccaggacu

SEQ ID NO: 12081 - RNA, 18 nt, artificial
  Chemically synthesized
cgucuucggacaucaccc

SEQ ID NO: 12082 - RNA, 18 nt, artificial
  Chemically synthesized
cucagcgugggaaaggau

SEQ ID NO: 12083 - RNA, 18 nt, artificial
  Chemically synthesized
gggacggagaucggagcu

SEQ ID NO: 12084 - RNA, 18 nt, artificial
  Chemically synthesized
cuaguaaauugucugccu

SEQ ID NO: 12085 - RNA, 18 nt, artificial
  Chemically synthesized
ucgacugguuucgcaucu

SEQ ID NO: 12086 - RNA, 18 nt, artificial
  Chemically synthesized
uguaaaccagaaugauuc

SEQ ID NO: 12087 - RNA, 18 nt, artificial
  Chemically synthesized
acgcaggcugcaaaccuu

SEQ ID NO: 12088 - RNA, 18 nt, artificial
  Chemically synthesized
aauugaauagaauacgcc

SEQ ID NO: 12089 - RNA, 18 nt, artificial
  Chemically synthesized
caaacugucgccgccucu

SEQ ID NO: 12090 - RNA, 18 nt, artificial
  Chemically synthesized
aguggaaacuguuaaaug

SEQ ID NO: 12091 - RNA, 18 nt, artificial
  Chemically synthesized
ugugccuaauuuacuuug

SEQ ID NO: 12092 - RNA, 18 nt, artificial
  Chemically synthesized
gccuggcagaaguugcgc

SEQ ID NO: 12093 - RNA, 18 nt, artificial
  Chemically synthesized
cucauuuggaguguuggu

SEQ ID NO: 12094 - RNA, 18 nt, artificial
  Chemically synthesized
acauggauaagugaucau

SEQ ID NO: 12095 - RNA, 18 nt, artificial
  Chemically synthesized
ccgcuucgaguucgacug

SEQ ID NO: 12096 - RNA, 18 nt, artificial
  Chemically synthesized
gcaaagcgugagcgggau

SEQ ID NO: 12097 - RNA, 18 nt, artificial
  Chemically synthesized
aaaccuuggcaagcccua

SEQ ID NO: 12098 - RNA, 18 nt, artificial
  Chemically synthesized
cgcaggcugcaaaccuug

SEQ ID NO: 12099 - RNA, 18 nt, artificial
  Chemically synthesized
auuuaaaagggcuuuccu

SEQ ID NO: 12100 - RNA, 18 nt, artificial
  Chemically synthesized
cgcaucucaacaacuacg

SEQ ID NO: 12101 - RNA, 18 nt, artificial
  Chemically synthesized
cugcagaugaccguggau

SEQ ID NO: 12102 - RNA, 18 nt, artificial
  Chemically synthesized
ggaacugugguugccaag

SEQ ID NO: 12103 - RNA, 18 nt, artificial
  Chemically synthesized
gauccugcagaugaccgu

SEQ ID NO: 12104 - RNA, 18 nt, artificial
  Chemically synthesized
ccuagcggcagccucgga

SEQ ID NO: 12105 - RNA, 18 nt, artificial
  Chemically synthesized
ugccuccuauagcagaaa

SEQ ID NO: 12106 - RNA, 18 nt, artificial
  Chemically synthesized
gccgagagcggagaggcg

SEQ ID NO: 12107 - RNA, 18 nt, artificial
  Chemically synthesized
agcccuauagaccuuggg

SEQ ID NO: 12108 - RNA, 18 nt, artificial
  Chemically synthesized
ugaguuuuccuuuuggug

SEQ ID NO: 12109 - RNA, 18 nt, artificial
  Chemically synthesized
gaaugauuccguuuuugc

SEQ ID NO: 12110 - RNA, 18 nt, artificial
  Chemically synthesized
gaccagcugcugguaucu

SEQ ID NO: 12111 - RNA, 18 nt, artificial
  Chemically synthesized
ugcucuccucaguggccu

SEQ ID NO: 12112 - RNA, 18 nt, artificial
  Chemically synthesized
aaaccacuaugcuuaaug

SEQ ID NO: 12113 - RNA, 18 nt, artificial
  Chemically synthesized
auggauaagugaucaugg

SEQ ID NO: 12114 - RNA, 18 nt, artificial
  Chemically synthesized
gcagguguaguuaaacga

SEQ ID NO: 12115 - RNA, 18 nt, artificial
  Chemically synthesized
guacugugccuaauuuac

SEQ ID NO: 12116 - RNA, 18 nt, artificial
  Chemically synthesized
agguguaguuaaacgacc

SEQ ID NO: 12117 - RNA, 18 nt, artificial
  Chemically synthesized
gugaucauggugugcgag

SEQ ID NO: 12118 - RNA, 18 nt, artificial
  Chemically synthesized
gcuuuccugccuccuucu

SEQ ID NO: 12119 - RNA, 18 nt, artificial
  Chemically synthesized
aucagugugugcggaacg

SEQ ID NO: 12120 - RNA, 18 nt, artificial
  Chemically synthesized
ccucugacccgcuucgag

SEQ ID NO: 12121 - RNA, 18 nt, artificial
  Chemically synthesized
uguuguacugauguguug

SEQ ID NO: 12122 - RNA, 18 nt, artificial
  Chemically synthesized
ggcacauccggaggcgcc

SEQ ID NO: 12123 - RNA, 18 nt, artificial
  Chemically synthesized
cuccuuccacuuacuguc

SEQ ID NO: 12124 - RNA, 18 nt, artificial
  Chemically synthesized
gugagcgggaucagugug

SEQ ID NO: 12125 - RNA, 18 nt, artificial
  Chemically synthesized
acaucuucccagauuuug

SEQ ID NO: 12126 - RNA, 18 nt, artificial
  Chemically synthesized
ucugagcugagaaggcug

SEQ ID NO: 12127 - RNA, 18 nt, artificial
  Chemically synthesized
agaaugauuccguuuuug

SEQ ID NO: 12128 - RNA, 18 nt, artificial
  Chemically synthesized
aacgcaagcagccgagag

SEQ ID NO: 12129 - RNA, 18 nt, artificial
  Chemically synthesized
ucuguuguacugaugugu

SEQ ID NO: 12130 - RNA, 18 nt, artificial
  Chemically synthesized
gaucauggugugcgagug

SEQ ID NO: 12131 - RNA, 18 nt, artificial
  Chemically synthesized
uaucugagcaucauugaa

SEQ ID NO: 12132 - RNA, 18 nt, artificial
  Chemically synthesized
gauagguuaggucucauu

SEQ ID NO: 12133 - RNA, 18 nt, artificial
  Chemically synthesized
cgggaacgcgggcaccac

SEQ ID NO: 12134 - RNA, 18 nt, artificial
  Chemically synthesized
gauguagaaugagggagg

SEQ ID NO: 12135 - RNA, 18 nt, artificial
  Chemically synthesized
cagccgagagcggagagg

SEQ ID NO: 12136 - RNA, 18 nt, artificial
  Chemically synthesized
caacacuuugugauaggu

SEQ ID NO: 12137 - RNA, 18 nt, artificial
  Chemically synthesized
uucggcuccuuccacuua

SEQ ID NO: 12138 - RNA, 18 nt, artificial
  Chemically synthesized
ccaacacuuugugauagg

SEQ ID NO: 12139 - RNA, 18 nt, artificial
  Chemically synthesized
ugcaaaccuuggcaagcc

SEQ ID NO: 12140 - RNA, 18 nt, artificial
  Chemically synthesized
uacugugccuaauuuacu

SEQ ID NO: 12141 - RNA, 18 nt, artificial
  Chemically synthesized
cugaauccaucugaccag

SEQ ID NO: 12142 - RNA, 18 nt, artificial
  Chemically synthesized
agaagcgccgacgagacc

SEQ ID NO: 12143 - RNA, 18 nt, artificial
  Chemically synthesized
uugaguucggcucuaggu

SEQ ID NO: 12144 - RNA, 18 nt, artificial
  Chemically synthesized
cugaacuggguuugaccu

SEQ ID NO: 12145 - RNA, 18 nt, artificial
  Chemically synthesized
aggaugguugaguuuuaa

SEQ ID NO: 12146 - RNA, 18 nt, artificial
  Chemically synthesized
uuuccaaaccacuaugcu

SEQ ID NO: 12147 - RNA, 18 nt, artificial
  Chemically synthesized
aguuuuccuuuuggugca

SEQ ID NO: 12148 - RNA, 18 nt, artificial
  Chemically synthesized
cuguugguggcccugaau

SEQ ID NO: 12149 - RNA, 18 nt, artificial
  Chemically synthesized
gagcgggaucagugugug

SEQ ID NO: 12150 - RNA, 18 nt, artificial
  Chemically synthesized
aacuacaucuucccagau

SEQ ID NO: 12151 - RNA, 18 nt, artificial
  Chemically synthesized
caugaagcgagcucaccc

SEQ ID NO: 12152 - RNA, 18 nt, artificial
  Chemically synthesized
acgccugcauuuaccagc

SEQ ID NO: 12153 - RNA, 18 nt, artificial
  Chemically synthesized
agacuaguaaauugucug

SEQ ID NO: 12154 - RNA, 18 nt, artificial
  Chemically synthesized
cgaccuccacugaacugg

SEQ ID NO: 12155 - RNA, 18 nt, artificial
  Chemically synthesized
ggccucggacacauuccc

SEQ ID NO: 12156 - RNA, 18 nt, artificial
  Chemically synthesized
gccagcaugaagcgagcu

SEQ ID NO: 12157 - RNA, 18 nt, artificial
  Chemically synthesized
uccguuuuugccucaaaa

SEQ ID NO: 12158 - RNA, 18 nt, artificial
  Chemically synthesized
augugaguuuuccuuuug

SEQ ID NO: 12159 - RNA, 18 nt, artificial
  Chemically synthesized
agcugcugguaucugcca

SEQ ID NO: 12160 - RNA, 18 nt, artificial
  Chemically synthesized
cgcuucgaguucgacugg

SEQ ID NO: 12161 - RNA, 18 nt, artificial
  Chemically synthesized
ugugcggaacgcaagcag

SEQ ID NO: 12162 - RNA, 18 nt, artificial
  Chemically synthesized
accagcugcugguaucug

SEQ ID NO: 12163 - RNA, 18 nt, artificial
  Chemically synthesized
gccgcugauagguuaggu

SEQ ID NO: 12164 - RNA, 18 nt, artificial
  Chemically synthesized
aucauugaaggacuagau

SEQ ID NO: 12165 - RNA, 18 nt, artificial
  Chemically synthesized
cuucucuuucggcuccuu

SEQ ID NO: 12166 - RNA, 18 nt, artificial
  Chemically synthesized
ugcgcguuaucugagcau

SEQ ID NO: 12167 - RNA, 18 nt, artificial
  Chemically synthesized
guuaggucucauuuggag

SEQ ID NO: 12168 - RNA, 18 nt, artificial
  Chemically synthesized
gcugcauacggcaggagg

SEQ ID NO: 12169 - RNA, 18 nt, artificial
  Chemically synthesized
cacuuugugauagguuug

SEQ ID NO: 12170 - RNA, 18 nt, artificial
  Chemically synthesized
ugccaagguauuuaaaag

SEQ ID NO: 12171 - RNA, 18 nt, artificial
  Chemically synthesized
uugucugagcugagaagg

SEQ ID NO: 12172 - RNA, 18 nt, artificial
  Chemically synthesized
gcugcugguaucugccag

SEQ ID NO: 12173 - RNA, 18 nt, artificial
  Chemically synthesized
uaaccagaggcaaagcgu

SEQ ID NO: 12174 - RNA, 18 nt, artificial
  Chemically synthesized
cuccuuguauaguuaugg

SEQ ID NO: 12175 - RNA, 18 nt, artificial
  Chemically synthesized
gaugaccguggaucaccu

SEQ ID NO: 12176 - RNA, 18 nt, artificial
  Chemically synthesized
caacuacgcuucccagcg

SEQ ID NO: 12177 - RNA, 18 nt, artificial
  Chemically synthesized
cucugcucuccucagugg

SEQ ID NO: 12178 - RNA, 18 nt, artificial
  Chemically synthesized
gccgcuguaguuaacucc

SEQ ID NO: 12179 - RNA, 18 nt, artificial
  Chemically synthesized
ugugaguuuuccuuuugg

SEQ ID NO: 12180 - RNA, 18 nt, artificial
  Chemically synthesized
ugaacuggguuugaccuc

SEQ ID NO: 12181 - RNA, 18 nt, artificial
  Chemically synthesized
gugcuuuugagaagcagg

SEQ ID NO: 12182 - RNA, 18 nt, artificial
  Chemically synthesized
gccucacccacggaaccg

SEQ ID NO: 12183 - RNA, 18 nt, artificial
  Chemically synthesized
ucgcaucucaacaacuac

SEQ ID NO: 12184 - RNA, 18 nt, artificial
  Chemically synthesized
auuucugagcaaagcguu

SEQ ID NO: 12185 - RNA, 18 nt, artificial
  Chemically synthesized
ccagcgggaagccgcgag

SEQ ID NO: 12186 - RNA, 18 nt, artificial
  Chemically synthesized
cagcuccucggacagcga

SEQ ID NO: 12187 - RNA, 18 nt, artificial
  Chemically synthesized
ccacgcgggccucggaca

SEQ ID NO: 12188 - RNA, 18 nt, artificial
  Chemically synthesized
ggaaagguuacuuugacg

SEQ ID NO: 12189 - RNA, 18 nt, artificial
  Chemically synthesized
cucggacagcgagcugga

SEQ ID NO: 12190 - RNA, 18 nt, artificial
  Chemically synthesized
uauuucugagcaaagcgu

SEQ ID NO: 12191 - RNA, 18 nt, artificial
  Chemically synthesized
ccagaacggccacgggaa

SEQ ID NO: 12192 - RNA, 18 nt, artificial
  Chemically synthesized
uggacgagaccaucgagg

SEQ ID NO: 12193 - RNA, 18 nt, artificial
  Chemically synthesized
uggacuaucggaguuugg

SEQ ID NO: 12194 - RNA, 18 nt, artificial
  Chemically synthesized
gagauccugcagaugacc

SEQ ID NO: 12195 - RNA, 18 nt, artificial
  Chemically synthesized
ugauagguuuguacugug

SEQ ID NO: 12196 - RNA, 18 nt, artificial
  Chemically synthesized
cucuagguuccauguccc

SEQ ID NO: 12197 - RNA, 18 nt, artificial
  Chemically synthesized
ccgccuccaaacugucgc

SEQ ID NO: 12198 - RNA, 18 nt, artificial
  Chemically synthesized
ugugauagguuuguacug

SEQ ID NO: 12199 - RNA, 18 nt, artificial
  Chemically synthesized
ucggagcuuuuuaaagaa

SEQ ID NO: 12200 - RNA, 18 nt, artificial
  Chemically synthesized
ucaugucauguauuagca

SEQ ID NO: 12201 - RNA, 18 nt, artificial
  Chemically synthesized
aauugucugccuccuaua

SEQ ID NO: 12202 - RNA, 18 nt, artificial
  Chemically synthesized
aaccuaauuuuccuggga

SEQ ID NO: 12203 - RNA, 18 nt, artificial
  Chemically synthesized
ugccaggacuggcaguuc

SEQ ID NO: 12204 - RNA, 18 nt, artificial
  Chemically synthesized
cggcagccucggaccggu

SEQ ID NO: 12205 - RNA, 18 nt, artificial
  Chemically synthesized
aaggcugguacccagugc

SEQ ID NO: 12206 - RNA, 18 nt, artificial
  Chemically synthesized
cuguggucaccuccgccu

SEQ ID NO: 12207 - RNA, 18 nt, artificial
  Chemically synthesized
guuuuccuuuuggugcau

SEQ ID NO: 12208 - RNA, 18 nt, artificial
  Chemically synthesized
agugaucauggugugcga

SEQ ID NO: 12209 - RNA, 18 nt, artificial
  Chemically synthesized
aaggaaacugaagguaau

SEQ ID NO: 12210 - RNA, 18 nt, artificial
  Chemically synthesized
aggagggaaagguuacuu

SEQ ID NO: 12211 - RNA, 18 nt, artificial
  Chemically synthesized
cccgaguacagcuccucg

SEQ ID NO: 12212 - RNA, 18 nt, artificial
  Chemically synthesized
gaacugugguugccaagg

SEQ ID NO: 12213 - RNA, 18 nt, artificial
  Chemically synthesized
ccagcugcugguaucugc

SEQ ID NO: 12214 - RNA, 18 nt, artificial
  Chemically synthesized
ucggcucuagguuccaug

SEQ ID NO: 12215 - RNA, 18 nt, artificial
  Chemically synthesized
gccaacaucaccuuaaag

SEQ ID NO: 12216 - RNA, 18 nt, artificial
  Chemically synthesized
gcacauccggaggcgccu

SEQ ID NO: 12217 - RNA, 18 nt, artificial
  Chemically synthesized
caguggccucccugucgg

SEQ ID NO: 12218 - RNA, 18 nt, artificial
  Chemically synthesized
agguuacuuugacgcgca

SEQ ID NO: 12219 - RNA, 18 nt, artificial
  Chemically synthesized
uuuccugccuccuucucu

SEQ ID NO: 12220 - RNA, 18 nt, artificial
  Chemically synthesized
gguggcccugaauccauc

SEQ ID NO: 12221 - RNA, 18 nt, artificial
  Chemically synthesized
acgcgcacgcccuugcua

SEQ ID NO: 12222 - RNA, 18 nt, artificial
  Chemically synthesized
ucauuuggaguguuggug

SEQ ID NO: 12223 - RNA, 18 nt, artificial
  Chemically synthesized
gccuccaaacugucgccg

SEQ ID NO: 12224 - RNA, 18 nt, artificial
  Chemically synthesized
ugagcgggaucagugugu

SEQ ID NO: 12225 - RNA, 18 nt, artificial
  Chemically synthesized
aggcugggcucggcacau

SEQ ID NO: 12226 - RNA, 18 nt, artificial
  Chemically synthesized
uccgcacucuccuucucc

SEQ ID NO: 12227 - RNA, 18 nt, artificial
  Chemically synthesized
aaguuuccauucucgucc

SEQ ID NO: 12228 - RNA, 18 nt, artificial
  Chemically synthesized
uucucguccgcacucucc

SEQ ID NO: 12229 - RNA, 18 nt, artificial
  Chemically synthesized
aaacuguuauugauccgg

SEQ ID NO: 12230 - RNA, 18 nt, artificial
  Chemically synthesized
ucugguuaaaacucaacc

SEQ ID NO: 12231 - RNA, 18 nt, artificial
  Chemically synthesized
uuguugagaugcgaaacc

SEQ ID NO: 12232 - RNA, 18 nt, artificial
  Chemically synthesized
ucaucugcaggaucucgg

SEQ ID NO: 12233 - RNA, 18 nt, artificial
  Chemically synthesized
uuccgcacacacugaucc

SEQ ID NO: 12234 - RNA, 18 nt, artificial
  Chemically synthesized
auucucguccgcacucuc

SEQ ID NO: 12235 - RNA, 18 nt, artificial
  Chemically synthesized
acucaaccauccuuuccc

SEQ ID NO: 12236 - RNA, 18 nt, artificial
  Chemically synthesized
aaaguaaaccaacaaacc

SEQ ID NO: 12237 - RNA, 18 nt, artificial
  Chemically synthesized
uucuuucuuggauaaagc

SEQ ID NO: 12238 - RNA, 18 nt, artificial
  Chemically synthesized
uucaguuuccuuuccacc

SEQ ID NO: 12239 - RNA, 18 nt, artificial
  Chemically synthesized
uugauccggucucgucgg

SEQ ID NO: 12240 - RNA, 18 nt, artificial
  Chemically synthesized
gacauggaaccuagagcc

SEQ ID NO: 12241 - RNA, 18 nt, artificial
  Chemically synthesized
ucguccgcacucuccuuc

SEQ ID NO: 12242 - RNA, 18 nt, artificial
  Chemically synthesized
aaacugcuaauacaugac

SEQ ID NO: 12243 - RNA, 18 nt, artificial
  Chemically synthesized
ucuccgucuuuuucuggc

SEQ ID NO: 12244 - RNA, 18 nt, artificial
  Chemically synthesized
acaguuuguacauucacc

SEQ ID NO: 12245 - RNA, 18 nt, artificial
  Chemically synthesized
uguuauugauccggucuc

SEQ ID NO: 12246 - RNA, 18 nt, artificial
  Chemically synthesized
aaguguuggcuuauacuc

SEQ ID NO: 12247 - RNA, 18 nt, artificial
  Chemically synthesized
uguacuacucaauugacc

SEQ ID NO: 12248 - RNA, 18 nt, artificial
  Chemically synthesized
gcgcuucucaauuauucc

SEQ ID NO: 12249 - RNA, 18 nt, artificial
  Chemically synthesized
uuugugaauuugagaucc

SEQ ID NO: 12250 - RNA, 18 nt, artificial
  Chemically synthesized
agccuucucagcucagac

SEQ ID NO: 12251 - RNA, 18 nt, artificial
  Chemically synthesized
uggguaccagccuucuca

SEQ ID NO: 12252 - RNA, 18 nt, artificial
  Chemically synthesized
aauucuuuguguugcugg

SEQ ID NO: 12253 - RNA, 18 nt, artificial
  Chemically synthesized
uacauucaccuuucugcu

SEQ ID NO: 12254 - RNA, 18 nt, artificial
  Chemically synthesized
uaacgcgcaacuucugcc

SEQ ID NO: 12255 - RNA, 18 nt, artificial
  Chemically synthesized
aggucuauagggcuugcc

SEQ ID NO: 12256 - RNA, 18 nt, artificial
  Chemically synthesized
acaaacuguuauugaucc

SEQ ID NO: 12257 - RNA, 18 nt, artificial
  Chemically synthesized
cuaucagcggcucucucc

SEQ ID NO: 12258 - RNA, 18 nt, artificial
  Chemically synthesized
aaagcacuggguaccagc

SEQ ID NO: 12259 - RNA, 18 nt, artificial
  Chemically synthesized
uuucuuggauaaagcuga

SEQ ID NO: 12260 - RNA, 18 nt, artificial
  Chemically synthesized
auuugucaacgcuuugcu

SEQ ID NO: 12261 - RNA, 18 nt, artificial
  Chemically synthesized
aauuauuccucuccgucu

SEQ ID NO: 12262 - RNA, 18 nt, artificial
  Chemically synthesized
aagcuccgaucuccgucc

SEQ ID NO: 12263 - RNA, 18 nt, artificial
  Chemically synthesized
ucgcuucaugcuggcucc

SEQ ID NO: 12264 - RNA, 18 nt, artificial
  Chemically synthesized
aaucaaagagaaggaggc

SEQ ID NO: 12265 - RNA, 18 nt, artificial
  Chemically synthesized
caguuuguacauucaccu

SEQ ID NO: 12266 - RNA, 18 nt, artificial
  Chemically synthesized
auccggucucgucggcgc

SEQ ID NO: 12267 - RNA, 18 nt, artificial
  Chemically synthesized
aauugaccacucgcacac

SEQ ID NO: 12268 - RNA, 18 nt, artificial
  Chemically synthesized
uuuguacauucaccuuuc

SEQ ID NO: 12269 - RNA, 18 nt, artificial
  Chemically synthesized
aucucggcuuuuucuagc

SEQ ID NO: 12270 - RNA, 18 nt, artificial
  Chemically synthesized
uacaacagaggucaaacc

SEQ ID NO: 12271 - RNA, 18 nt, artificial
  Chemically synthesized
cucgcuucaugcuggcuc

SEQ ID NO: 12272 - RNA, 18 nt, artificial
  Chemically synthesized
cugcuaaaagaauaaacc

SEQ ID NO: 12273 - RNA, 18 nt, artificial
  Chemically synthesized
cuuuuucuagcuuagcag

SEQ ID NO: 12274 - RNA, 18 nt, artificial
  Chemically synthesized
aaggaggcaggaaagccc

SEQ ID NO: 12275 - RNA, 18 nt, artificial
  Chemically synthesized
gaaccuagagccgaacuc

SEQ ID NO: 12276 - RNA, 18 nt, artificial
  Chemically synthesized
aagcacuggguaccagcc

SEQ ID NO: 12277 - RNA, 18 nt, artificial
  Chemically synthesized
guaccagccuucucagcu

SEQ ID NO: 12278 - RNA, 18 nt, artificial
  Chemically synthesized
ucuaguccuucaaugaug

SEQ ID NO: 12279 - RNA, 18 nt, artificial
  Chemically synthesized
uucucagcucagacaaac

SEQ ID NO: 12280 - RNA, 18 nt, artificial
  Chemically synthesized
cucauucuacaucaguuc

SEQ ID NO: 12281 - RNA, 18 nt, artificial
  Chemically synthesized
uugccaagguuugcagcc

SEQ ID NO: 12282 - RNA, 18 nt, artificial
  Chemically synthesized
uaccagccuucucagcuc

SEQ ID NO: 12283 - RNA, 18 nt, artificial
  Chemically synthesized
aaaguaaccuuucccucc

SEQ ID NO: 12284 - RNA, 18 nt, artificial
  Chemically synthesized
aaaacggaaucauucugg

SEQ ID NO: 12285 - RNA, 18 nt, artificial
  Chemically synthesized
accagucgaacucgaagc

SEQ ID NO: 12286 - RNA, 18 nt, artificial
  Chemically synthesized
cuucugccaggcauuccc

SEQ ID NO: 12287 - RNA, 18 nt, artificial
  Chemically synthesized
uuugucaacgcuuugcuc

SEQ ID NO: 12288 - RNA, 18 nt, artificial
  Chemically synthesized
uaacuaaaucagaacugc

SEQ ID NO: 12289 - RNA, 18 nt, artificial
  Chemically synthesized
uuuucaggugauccacgg

SEQ ID NO: 12290 - RNA, 18 nt, artificial
  Chemically synthesized
gcacucuccuucuccacc

SEQ ID NO: 12291 - RNA, 18 nt, artificial
  Chemically synthesized
ucgauggucucguccagc

SEQ ID NO: 12292 - RNA, 18 nt, artificial
  Chemically synthesized
aguucuuuaaaaagcucc

SEQ ID NO: 12293 - RNA, 18 nt, artificial
  Chemically synthesized
aaagcccuuuuaaauacc

SEQ ID NO: 12294 - RNA, 18 nt, artificial
  Chemically synthesized
aaucagaacugccagucc

SEQ ID NO: 12295 - RNA, 18 nt, artificial
  Chemically synthesized
uagcuuagcagaucccug

SEQ ID NO: 12296 - RNA, 18 nt, artificial
  Chemically synthesized
uucucaauuauuccucuc

SEQ ID NO: 12297 - RNA, 18 nt, artificial
  Chemically synthesized
acuguuauugauccgguc

SEQ ID NO: 12298 - RNA, 18 nt, artificial
  Chemically synthesized
uuccucuccgucuuuuuc

SEQ ID NO: 12299 - RNA, 18 nt, artificial
  Chemically synthesized
cacucuccuucuccaccu

SEQ ID NO: 12300 - RNA, 18 nt, artificial
  Chemically synthesized
guuaaaacucaaccaucc

SEQ ID NO: 12301 - RNA, 18 nt, artificial
  Chemically synthesized
ucccaaacuccgauaguc

SEQ ID NO: 12302 - RNA, 18 nt, artificial
  Chemically synthesized
uuuccauucucguccgca

SEQ ID NO: 12303 - RNA, 18 nt, artificial
  Chemically synthesized
uaaaucaaagagaaggag

SEQ ID NO: 12304 - RNA, 18 nt, artificial
  Chemically synthesized
accacaguuccaugcacc

SEQ ID NO: 12305 - RNA, 18 nt, artificial
  Chemically synthesized
agaccauaacuauacaag

SEQ ID NO: 12306 - RNA, 18 nt, artificial
  Chemically synthesized
gcuucucaauuauuccuc

SEQ ID NO: 12307 - RNA, 18 nt, artificial
  Chemically synthesized
uaguccauagcaagggcg

SEQ ID NO: 12308 - RNA, 18 nt, artificial
  Chemically synthesized
aaucccaaacuccgauag

SEQ ID NO: 12309 - RNA, 18 nt, artificial
  Chemically synthesized
aacacuccaaaugagacc

SEQ ID NO: 12310 - RNA, 18 nt, artificial
  Chemically synthesized
aaucugggaagauguagu

SEQ ID NO: 12311 - RNA, 18 nt, artificial
  Chemically synthesized
ucagauggauucagggcc

SEQ ID NO: 12312 - RNA, 18 nt, artificial
  Chemically synthesized
aaaguguuggcuuauacu

SEQ ID NO: 12313 - RNA, 18 nt, artificial
  Chemically synthesized
uaaaugcaggcguauucu

SEQ ID NO: 12314 - RNA, 18 nt, artificial
  Chemically synthesized
uaucacaaaguguuggcu

SEQ ID NO: 12315 - RNA, 18 nt, artificial
  Chemically synthesized
ucaauugaccacucgcac

SEQ ID NO: 12316 - RNA, 18 nt, artificial
  Chemically synthesized
agaacugccaguccuggc

SEQ ID NO: 12317 - RNA, 18 nt, artificial
  Chemically synthesized
uuggcaacaguccagccc

SEQ ID NO: 12318 - RNA, 18 nt, artificial
  Chemically synthesized
acaucaguacaacagagg

SEQ ID NO: 12319 - RNA, 18 nt, artificial
  Chemically synthesized
acucaaguuuccauucuc

SEQ ID NO: 12320 - RNA, 18 nt, artificial
  Chemically synthesized
gacaaacuguuauugauc

SEQ ID NO: 12321 - RNA, 18 nt, artificial
  Chemically synthesized
uccgcucucggcugcuug

SEQ ID NO: 12322 - RNA, 18 nt, artificial
  Chemically synthesized
ucucguccagcucgcugu

SEQ ID NO: 12323 - RNA, 18 nt, artificial
  Chemically synthesized
accuuucugcuauaggag

SEQ ID NO: 12324 - RNA, 18 nt, artificial
  Chemically synthesized
uaugcagcauuuucaggu

SEQ ID NO: 12325 - RNA, 18 nt, artificial
  Chemically synthesized
uuuccacuguacuacuca

SEQ ID NO: 12326 - RNA, 18 nt, artificial
  Chemically synthesized
cauucucguccgcacucu

SEQ ID NO: 12327 - RNA, 18 nt, artificial
  Chemically synthesized
aaagcuccgaucuccguc

SEQ ID NO: 12328 - RNA, 18 nt, artificial
  Chemically synthesized
auucuuuguguugcuggg

SEQ ID NO: 12329 - RNA, 18 nt, artificial
  Chemically synthesized
uaucagcggcucucuccu

SEQ ID NO: 12330 - RNA, 18 nt, artificial
  Chemically synthesized
ucucggcugcuugcguuc

SEQ ID NO: 12331 - RNA, 18 nt, artificial
  Chemically synthesized
aaacucaaccauccuuuc

SEQ ID NO: 12332 - RNA, 18 nt, artificial
  Chemically synthesized
cuucucaaaagcacuggg

SEQ ID NO: 12333 - RNA, 18 nt, artificial
  Chemically synthesized
cucuccgucuuuuucugg

SEQ ID NO: 12334 - RNA, 18 nt, artificial
  Chemically synthesized
agaggucaaacccaguuc

SEQ ID NO: 12335 - RNA, 18 nt, artificial
  Chemically synthesized
aggcauucccgaaauccc

SEQ ID NO: 12336 - RNA, 18 nt, artificial
  Chemically synthesized
cuaaauguuaagauuccc

SEQ ID NO: 12337 - RNA, 18 nt, artificial
  Chemically synthesized
uugcguuccgcacacacu

SEQ ID NO: 12338 - RNA, 18 nt, artificial
  Chemically synthesized
accucgauggucucgucc

SEQ ID NO: 12339 - RNA, 18 nt, artificial
  Chemically synthesized
acaguaaguggaaggagc

SEQ ID NO: 12340 - RNA, 18 nt, artificial
  Chemically synthesized
uaaccuuucccuccugcc

SEQ ID NO: 12341 - RNA, 18 nt, artificial
  Chemically synthesized
ucaucugauuugucaacg

SEQ ID NO: 12342 - RNA, 18 nt, artificial
  Chemically synthesized
auggucucguccagcucg

SEQ ID NO: 12343 - RNA, 18 nt, artificial
  Chemically synthesized
aacagaccauaacuauac

SEQ ID NO: 12344 - RNA, 18 nt, artificial
  Chemically synthesized
acuccgauaguccauagc

SEQ ID NO: 12345 - RNA, 18 nt, artificial
  Chemically synthesized
ucagacaaacuguuauug

SEQ ID NO: 12346 - RNA, 18 nt, artificial
  Chemically synthesized
agcauuuucaggugaucc

SEQ ID NO: 12347 - RNA, 18 nt, artificial
  Chemically synthesized
aguguuggcuuauacuca

SEQ ID NO: 12348 - RNA, 18 nt, artificial
  Chemically synthesized
uucucaaaagcacugggu

SEQ ID NO: 12349 - RNA, 18 nt, artificial
  Chemically synthesized
uggucucguccagcucgc

SEQ ID NO: 12350 - RNA, 18 nt, artificial
  Chemically synthesized
ucucuccuaacuaaauca

SEQ ID NO: 12351 - RNA, 18 nt, artificial
  Chemically synthesized
aauuuugaggcaaaaacg

SEQ ID NO: 12352 - RNA, 18 nt, artificial
  Chemically synthesized
ucuauagggcuugccaag

SEQ ID NO: 12353 - RNA, 18 nt, artificial
  Chemically synthesized
aacacaucaguacaacag

SEQ ID NO: 12354 - RNA, 18 nt, artificial
  Chemically synthesized
auguccgaagacgguccc

SEQ ID NO: 12355 - RNA, 18 nt, artificial
  Chemically synthesized
guccuucaaugaugcuca

SEQ ID NO: 12356 - RNA, 18 nt, artificial
  Chemically synthesized
agguuugcagccugcgug

SEQ ID NO: 12357 - RNA, 18 nt, artificial
  Chemically synthesized
uuauugauccggucucgu

SEQ ID NO: 12358 - RNA, 18 nt, artificial
  Chemically synthesized
aaaucugggaagauguag

SEQ ID NO: 12359 - RNA, 18 nt, artificial
  Chemically synthesized
caaacuguuauugauccg

SEQ ID NO: 12360 - RNA, 18 nt, artificial
  Chemically synthesized
guguuggcuuauacucac

SEQ ID NO: 12361 - RNA, 18 nt, artificial
  Chemically synthesized
aucaguacaacagagguc

SEQ ID NO: 12362 - RNA, 18 nt, artificial
  Chemically synthesized
uggucagauggauucagg

SEQ ID NO: 12363 - RNA, 18 nt, artificial
  Chemically synthesized
gaucucggcuuuuucuag

SEQ ID NO: 12364 - RNA, 18 nt, artificial
  Chemically synthesized
uugggagacaguaagugg

SEQ ID NO: 12365 - RNA, 18 nt, artificial
  Chemically synthesized
ggacauggaaccuagagc

SEQ ID NO: 12366 - RNA, 18 nt, artificial
  Chemically synthesized
acaguacaaaccuaucac

SEQ ID NO: 12367 - RNA, 18 nt, artificial
  Chemically synthesized
aacucaaccauccuuucc

SEQ ID NO: 12368 - RNA, 18 nt, artificial
  Chemically synthesized
caaggagaaaaacagacc

SEQ ID NO: 12369 - RNA, 18 nt, artificial
  Chemically synthesized
aguaaaccaacaaaccuu

SEQ ID NO: 12370 - RNA, 18 nt, artificial
  Chemically synthesized
acucuccuucuccaccuc

SEQ ID NO: 12371 - RNA, 18 nt, artificial
  Chemically synthesized
ugaauuugagauccgugu

SEQ ID NO: 12372 - RNA, 18 nt, artificial
  Chemically synthesized
ugauguuggcaacagucc

SEQ ID NO: 12373 - RNA, 18 nt, artificial
  Chemically synthesized
ucaaaagcacuggguacc

SEQ ID NO: 12374 - RNA, 18 nt, artificial
  Chemically synthesized
aaguaaaccaacaaaccu

SEQ ID NO: 12375 - RNA, 18 nt, artificial
  Chemically synthesized
ggugauguccgaagacgg

SEQ ID NO: 12376 - RNA, 18 nt, artificial
  Chemically synthesized
uuuccuuuccaccaacac

SEQ ID NO: 12377 - RNA, 18 nt, artificial
  Chemically synthesized
uugagaugcgaaaccagu

SEQ ID NO: 12378 - RNA, 18 nt, artificial
  Chemically synthesized
ugauguccgaagacgguc

SEQ ID NO: 12379 - RNA, 18 nt, artificial
  Chemically synthesized
ugaucaucugauuuguca

SEQ ID NO: 12380 - RNA, 18 nt, artificial
  Chemically synthesized
guccgcacucuccuucuc

SEQ ID NO: 12381 - RNA, 18 nt, artificial
  Chemically synthesized
aaugcaggcguauucuau

SEQ ID NO: 12382 - RNA, 18 nt, artificial
  Chemically synthesized
ucucggcuuuuucuagcu

SEQ ID NO: 12383 - RNA, 18 nt, artificial
  Chemically synthesized
guuccgcacacacugauc

SEQ ID NO: 12384 - RNA, 18 nt, artificial
  Chemically synthesized
ggcgcuucucaauuauuc

SEQ ID NO: 12385 - RNA, 18 nt, artificial
  Chemically synthesized
agauaacgcgcaacuucu

SEQ ID NO: 12386 - RNA, 18 nt, artificial
  Chemically synthesized
auaccuuggcaaccacag

SEQ ID NO: 12387 - RNA, 18 nt, artificial
  Chemically synthesized
uacucaauugaccacucg

SEQ ID NO: 12388 - RNA, 18 nt, artificial
  Chemically synthesized
cuggguaccagccuucuc

SEQ ID NO: 12389 - RNA, 18 nt, artificial
  Chemically synthesized
aaacuccgauaguccaua

SEQ ID NO: 12390 - RNA, 18 nt, artificial
  Chemically synthesized
ucugcaggaucucggcuu

SEQ ID NO: 12391 - RNA, 18 nt, artificial
  Chemically synthesized
acuucugccaggcauucc

SEQ ID NO: 12392 - RNA, 18 nt, artificial
  Chemically synthesized
acuguacuacucaauuga

SEQ ID NO: 12393 - RNA, 18 nt, artificial
  Chemically synthesized
uacaaaccuaucacaaag

SEQ ID NO: 12394 - RNA, 18 nt, artificial
  Chemically synthesized
auugggagacaguaagug

SEQ ID NO: 12395 - RNA, 18 nt, artificial
  Chemically synthesized
auugaccacucgcacacc

SEQ ID NO: 12396 - RNA, 18 nt, artificial
  Chemically synthesized
gcaucuaguccuucaaug

SEQ ID NO: 12397 - RNA, 18 nt, artificial
  Chemically synthesized
aagcguaguuguugagau

SEQ ID NO: 12398 - RNA, 18 nt, artificial
  Chemically synthesized
acugaggagagcagaggc

SEQ ID NO: 12399 - RNA, 18 nt, artificial
  Chemically synthesized
agaccuaaccuaucagcg

SEQ ID NO: 12400 - RNA, 18 nt, artificial
  Chemically synthesized
cacuggguaccagccuuc

SEQ ID NO: 12401 - RNA, 18 nt, artificial
  Chemically synthesized
cucaauugaccacucgca

SEQ ID NO: 12402 - RNA, 18 nt, artificial
  Chemically synthesized
uccaaaugagaccuaacc

SEQ ID NO: 12403 - RNA, 18 nt, artificial
  Chemically synthesized
acuaaaucagaacugcca

SEQ ID NO: 12404 - RNA, 18 nt, artificial
  Chemically synthesized
augaugcucagauaacgc

SEQ ID NO: 12405 - RNA, 18 nt, artificial
  Chemically synthesized
agucgaacucgaagcggg

SEQ ID NO: 12406 - RNA, 18 nt, artificial
  Chemically synthesized
uagagccgaacucaaguu

SEQ ID NO: 12407 - RNA, 18 nt, artificial
  Chemically synthesized
gucaaaguaaccuuuccc

SEQ ID NO: 12408 - RNA, 18 nt, artificial
  Chemically synthesized
auaccagcagcuggucag

SEQ ID NO: 12409 - RNA, 18 nt, artificial
  Chemically synthesized
ucucgucggcgcuucuca

SEQ ID NO: 12410 - RNA, 18 nt, artificial
  Chemically synthesized
cgcacucuccuucuccac

SEQ ID NO: 12411 - RNA, 18 nt, artificial
  Chemically synthesized
ccgaaaucccaaacuccg

SEQ ID NO: 12412 - RNA, 18 nt, artificial
  Chemically synthesized
guaaaugcaggcguauuc

SEQ ID NO: 12413 - RNA, 18 nt, artificial
  Chemically synthesized
auuauuccucuccgucuu

SEQ ID NO: 12414 - RNA, 18 nt, artificial
  Chemically synthesized
aucugauuugucaacgcu

SEQ ID NO: 12415 - RNA, 18 nt, artificial
  Chemically synthesized
aggaucucggcuuuuucu

SEQ ID NO: 12416 - RNA, 18 nt, artificial
  Chemically synthesized
aaaccuaucacaaagugu

SEQ ID NO: 12417 - RNA, 18 nt, artificial
  Chemically synthesized
ugcugaagggcucagugc

SEQ ID NO: 12418 - RNA, 18 nt, artificial
  Chemically synthesized
gauaguccauagcaaggg

SEQ ID NO: 12419 - RNA, 18 nt, artificial
  Chemically synthesized
gaaggaggcaggaaagcc

SEQ ID NO: 12420 - RNA, 18 nt, artificial
  Chemically synthesized
accaacaaaccuuuaguc

SEQ ID NO: 12421 - RNA, 18 nt, artificial
  Chemically synthesized
uuugccucugguuaaaac

SEQ ID NO: 12422 - RNA, 18 nt, artificial
  Chemically synthesized
caaaguguuggcuuauac

SEQ ID NO: 12423 - RNA, 18 nt, artificial
  Chemically synthesized
ugcaggcguauucuauuc

SEQ ID NO: 12424 - RNA, 18 nt, artificial
  Chemically synthesized
acacuccaaaugagaccu

SEQ ID NO: 12425 - RNA, 18 nt, artificial
  Chemically synthesized
ucggcugcuugcguuccg

SEQ ID NO: 12426 - RNA, 18 nt, artificial
  Chemically synthesized
aaacggaaucauucuggu

SEQ ID NO: 12427 - RNA, 18 nt, artificial
  Chemically synthesized
cacugaucccgcucacgc

SEQ ID NO: 12428 - RNA, 18 nt, artificial
  Chemically synthesized
uuaggcacaguacaaacc

SEQ ID NO: 12429 - RNA, 18 nt, artificial
  Chemically synthesized
ucaguacaacagagguca

SEQ ID NO: 12430 - RNA, 18 nt, artificial
  Chemically synthesized
ucaaguuuccauucucgu

SEQ ID NO: 12431 - RNA, 18 nt, artificial
  Chemically synthesized
acaccaugaucacuuauc

SEQ ID NO: 12432 - RNA, 18 nt, artificial
  Chemically synthesized
agaaaauauggcaguccc

SEQ ID NO: 12433 - RNA, 18 nt, artificial
  Chemically synthesized
acucgcacaccaugauca

SEQ ID NO: 12434 - RNA, 18 nt, artificial
  Chemically synthesized
augcgaaaccagucgaac

SEQ ID NO: 12435 - RNA, 18 nt, artificial
  Chemically synthesized
cuucucaauuauuccucu

SEQ ID NO: 12436 - RNA, 18 nt, artificial
  Chemically synthesized
cacuguacuacucaauug

SEQ ID NO: 12437 - RNA, 18 nt, artificial
  Chemically synthesized
caguuuccacuguacuac

SEQ ID NO: 12438 - RNA, 18 nt, artificial
  Chemically synthesized
aucagaacugccaguccu

SEQ ID NO: 12439 - RNA, 18 nt, artificial
  Chemically synthesized
uguuggcuuauacucacu

SEQ ID NO: 12440 - RNA, 18 nt, artificial
  Chemically synthesized
auucccgaaaucccaaac

SEQ ID NO: 12441 - RNA, 18 nt, artificial
  Chemically synthesized
ucccgcucacgcuuugcc

SEQ ID NO: 12442 - RNA, 18 nt, artificial
  Chemically synthesized
uacagcggcgccucuccg

SEQ ID NO: 12443 - RNA, 18 nt, artificial
  Chemically synthesized
aguuuccauucucguccg

SEQ ID NO: 12444 - RNA, 18 nt, artificial
  Chemically synthesized
caccaugaucacuuaucc

SEQ ID NO: 12445 - RNA, 18 nt, artificial
  Chemically synthesized
auuuucaggugauccacg

SEQ ID NO: 12446 - RNA, 18 nt, artificial
  Chemically synthesized
acuggguaccagccuucu

SEQ ID NO: 12447 - RNA, 18 nt, artificial
  Chemically synthesized
aaccuagagccgaacuca

SEQ ID NO: 12448 - RNA, 18 nt, artificial
  Chemically synthesized
aacuguuauugauccggu

SEQ ID NO: 12449 - RNA, 18 nt, artificial
  Chemically synthesized
aacagaggucaaacccag

SEQ ID NO: 12450 - RNA, 18 nt, artificial
  Chemically synthesized
gugaccacagggagcacc

SEQ ID NO: 12451 - RNA, 18 nt, artificial
  Chemically synthesized
ugagcucgcuucaugcug

SEQ ID NO: 12452 - RNA, 18 nt, artificial
  Chemically synthesized
aagaaaauauggcagucc

SEQ ID NO: 12453 - RNA, 18 nt, artificial
  Chemically synthesized
aaauauggcagucccagg

SEQ ID NO: 12454 - RNA, 18 nt, artificial
  Chemically synthesized
gauggucucguccagcuc

SEQ ID NO: 12455 - RNA, 18 nt, artificial
  Chemically synthesized
uccggucucgucggcgcu

SEQ ID NO: 12456 - RNA, 18 nt, artificial
  Chemically synthesized
cuaucacaaaguguuggc

SEQ ID NO: 12457 - RNA, 18 nt, artificial
  Chemically synthesized
gucagaggcaucuagucc

SEQ ID NO: 12458 - RNA, 18 nt, artificial
  Chemically synthesized
guuuguacauucaccuuu

SEQ ID NO: 12459 - RNA, 18 nt, artificial
  Chemically synthesized
aaauucuuuguguugcug

SEQ ID NO: 12460 - RNA, 18 nt, artificial
  Chemically synthesized
uacuacucaauugaccac

SEQ ID NO: 12461 - RNA, 18 nt, artificial
  Chemically synthesized
uaaaucagaacugccagu

SEQ ID NO: 12462 - RNA, 18 nt, artificial
  Chemically synthesized
auuuugaggcaaaaacgg

SEQ ID NO: 12463 - RNA, 18 nt, artificial
  Chemically synthesized
cacugaggagagcagagg

SEQ ID NO: 12464 - RNA, 18 nt, artificial
  Chemically synthesized
uguuggcaacaguccagc

SEQ ID NO: 12465 - RNA, 18 nt, artificial
  Chemically synthesized
gucacaacacaucaguac

SEQ ID NO: 12466 - RNA, 18 nt, artificial
  Chemically synthesized
aagcccuuuuaaauaccu

SEQ ID NO: 12467 - RNA, 18 nt, artificial
  Chemically synthesized
guuguugagaugcgaaac

SEQ ID NO: 12468 - RNA, 18 nt, artificial
  Chemically synthesized
cuucaaugaugcucagau

SEQ ID NO: 12469 - RNA, 18 nt, artificial
  Chemically synthesized
aaaaacggaaucauucug

SEQ ID NO: 12470 - RNA, 18 nt, artificial
  Chemically synthesized
cucccucauucuacauca

SEQ ID NO: 12471 - RNA, 18 nt, artificial
  Chemically synthesized
uuuuucuggccaaaaucu

SEQ ID NO: 12472 - RNA, 18 nt, artificial
  Chemically synthesized
ugauuugucaacgcuuug

SEQ ID NO: 12473 - RNA, 18 nt, artificial
  Chemically synthesized
ucaaaguaaccuuucccu

SEQ ID NO: 12474 - RNA, 18 nt, artificial
  Chemically synthesized
aaugaugcucagauaacg

SEQ ID NO: 12475 - RNA, 18 nt, artificial
  Chemically synthesized
uccauagcaagggcgugc

SEQ ID NO: 12476 - RNA, 18 nt, artificial
  Chemically synthesized
aucaucugauuugucaac

SEQ ID NO: 12477 - RNA, 18 nt, artificial
  Chemically synthesized
acugcuaauacaugacau

SEQ ID NO: 12478 - RNA, 18 nt, artificial
  Chemically synthesized
ugcuucucaaaagcacug

SEQ ID NO: 12479 - RNA, 18 nt, artificial
  Chemically synthesized
ucagcucagacaaacugu

SEQ ID NO: 12480 - RNA, 18 nt, artificial
  Chemically synthesized
ugguggugcgguuccgug

SEQ ID NO: 12481 - RNA, 18 nt, artificial
  Chemically synthesized
acaacacaucaguacaac

SEQ ID NO: 12482 - RNA, 18 nt, artificial
  Chemically synthesized
ucaauuauuccucuccgu

SEQ ID NO: 12483 - RNA, 18 nt, artificial
  Chemically synthesized
ucauucugguuuacaaag

SEQ ID NO: 12484 - RNA, 18 nt, artificial
  Chemically synthesized
ucuccgcucucggcugcu

SEQ ID NO: 12485 - RNA, 18 nt, artificial
  Chemically synthesized
cuguuauugauccggucu

SEQ ID NO: 12486 - RNA, 18 nt, artificial
  Chemically synthesized
uccauguuaacauuugug

SEQ ID NO: 12487 - RNA, 18 nt, artificial
  Chemically synthesized
auagcaagggcgugcgcg

SEQ ID NO: 12488 - RNA, 18 nt, artificial
  Chemically synthesized
auaguccauagcaagggc

SEQ ID NO: 12489 - RNA, 18 nt, artificial
  Chemically synthesized
uccuucuccaccucgaug

SEQ ID NO: 12490 - RNA, 18 nt, artificial
  Chemically synthesized
uuggcuuauacucacuau

SEQ ID NO: 12491 - RNA, 18 nt, artificial
  Chemically synthesized
auuaggcacaguacaaac

SEQ ID NO: 12492 - RNA, 18 nt, artificial
  Chemically synthesized
gggcugguaaaugcaggc

SEQ ID NO: 12493 - RNA, 18 nt, artificial
  Chemically synthesized
uagucuucuuucuuggau

SEQ ID NO: 12494 - RNA, 18 nt, artificial
  Chemically synthesized
ucugauuugucaacgcuu

SEQ ID NO: 12495 - RNA, 18 nt, artificial
  Chemically synthesized
gguaccagccuucucagc

SEQ ID NO: 12496 - RNA, 18 nt, artificial
  Chemically synthesized
auguguccgaggcccgcg

SEQ ID NO: 12497 - RNA, 18 nt, artificial
  Chemically synthesized
ggugauccacggucaucu

SEQ ID NO: 12498 - RNA, 18 nt, artificial
  Chemically synthesized
cuacucaauugaccacuc

SEQ ID NO: 12499 - RNA, 18 nt, artificial
  Chemically synthesized
ugguuaaaacucaaccau

SEQ ID NO: 12500 - RNA, 18 nt, artificial
  Chemically synthesized
cuaaaucagaacugccag

SEQ ID NO: 12501 - RNA, 18 nt, artificial
  Chemically synthesized
caguaaguggaaggagcc

SEQ ID NO: 12502 - RNA, 18 nt, artificial
  Chemically synthesized
agggaauguguccgaggc

SEQ ID NO: 12503 - RNA, 18 nt, artificial
  Chemically synthesized
uaaccuaucagcggcucu

SEQ ID NO: 12504 - RNA, 18 nt, artificial
  Chemically synthesized
cuaacuaaaucagaacug

SEQ ID NO: 12505 - RNA, 18 nt, artificial
  Chemically synthesized
guucuuuaaaaagcuccg

SEQ ID NO: 12506 - RNA, 18 nt, artificial
  Chemically synthesized
uuuggaggcggaggugac

SEQ ID NO: 12507 - RNA, 18 nt, artificial
  Chemically synthesized
aucugcaggaucucggcu

SEQ ID NO: 12508 - RNA, 18 nt, artificial
  Chemically synthesized
gagacaguaaguggaagg

SEQ ID NO: 12509 - RNA, 18 nt, artificial
  Chemically synthesized
aggaguuaacuacagcgg

SEQ ID NO: 12510 - RNA, 18 nt, artificial
  Chemically synthesized
uucaugcuggcucccugg

SEQ ID NO: 12511 - RNA, 18 nt, artificial
  Chemically synthesized
agccgaacucaaguuucc

SEQ ID NO: 12512 - RNA, 18 nt, artificial
  Chemically synthesized
gucaaacccaguucagug

SEQ ID NO: 12513 - RNA, 18 nt, artificial
  Chemically synthesized
cucugguuaaaacucaac

SEQ ID NO: 12514 - RNA, 18 nt, artificial
  Chemically synthesized
acuuuaaggugauguugg

SEQ ID NO: 12515 - RNA, 18 nt, artificial
  Chemically synthesized
guacaacagaggucaaac

SEQ ID NO: 12516 - RNA, 18 nt, artificial
  Chemically synthesized
aucccugcuucucaaaag

SEQ ID NO: 12517 - RNA, 18 nt, artificial
  Chemically synthesized
uucuccaccucgaugguc

SEQ ID NO: 12518 - RNA, 18 nt, artificial
  Chemically synthesized
aacaguuuguacauucac

SEQ ID NO: 12519 - RNA, 18 nt, artificial
  Chemically synthesized
cugcuucucaaaagcacu

SEQ ID NO: 12520 - RNA, 18 nt, artificial
  Chemically synthesized
uaaagcugaucaucugau

SEQ ID NO: 12521 - RNA, 18 nt, artificial
  Chemically synthesized
accaaaaggaaaacucac

SEQ ID NO: 12522 - RNA, 18 nt, artificial
  Chemically synthesized
caggcauucccgaaaucc

SEQ ID NO: 12523 - RNA, 18 nt, artificial
  Chemically synthesized
ccaacaguuuguacauuc

SEQ ID NO: 12524 - RNA, 18 nt, artificial
  Chemically synthesized
cucaaguuuccauucucg

SEQ ID NO: 12525 - RNA, 18 nt, artificial
  Chemically synthesized
caugaucacuuauccaug

SEQ ID NO: 12526 - RNA, 18 nt, artificial
  Chemically synthesized
caaggucuauagggcuug

SEQ ID NO: 12527 - RNA, 18 nt, artificial
  Chemically synthesized
cuuucugcuauaggaggc

SEQ ID NO: 12528 - RNA, 18 nt, artificial
  Chemically synthesized
cgcuucucaauuauuccu

SEQ ID NO: 12529 - RNA, 18 nt, artificial
  Chemically synthesized
cugcuaauacaugacaug

SEQ ID NO: 12530 - RNA, 18 nt, artificial
  Chemically synthesized
ccaacaaaccuuuagucu

SEQ ID NO: 12531 - RNA, 18 nt, artificial
  Chemically synthesized
gcccuuuuaaauaccuug

SEQ ID NO: 12532 - RNA, 18 nt, artificial
  Chemically synthesized
uuuccaccaacacuccaa

SEQ ID NO: 12533 - RNA, 18 nt, artificial
  Chemically synthesized
accuaucagcggcucucu

SEQ ID NO: 12534 - RNA, 18 nt, artificial
  Chemically synthesized
cgcacacacugaucccgc

SEQ ID NO: 12535 - RNA, 18 nt, artificial
  Chemically synthesized
aaaucccaaacuccgaua

SEQ ID NO: 12536 - RNA, 18 nt, artificial
  Chemically synthesized
ucaaacccaguucagugg

SEQ ID NO: 12537 - RNA, 18 nt, artificial
  Chemically synthesized
aacccaguucaguggagg

SEQ ID NO: 12538 - RNA, 18 nt, artificial
  Chemically synthesized
uuaccuucaguuuccuuu

SEQ ID NO: 12539 - RNA, 18 nt, artificial
  Chemically synthesized
ggucuauagggcuugcca

SEQ ID NO: 12540 - RNA, 18 nt, artificial
  Chemically synthesized
ucccugcuucucaaaagc

SEQ ID NO: 12541 - RNA, 18 nt, artificial
  Chemically synthesized
aggaaaauuagguuaugc

SEQ ID NO: 12542 - RNA, 18 nt, artificial
  Chemically synthesized
gucucguccagcucgcug

SEQ ID NO: 12543 - RNA, 18 nt, artificial
  Chemically synthesized
acugaucccgcucacgcu

SEQ ID NO: 12544 - RNA, 18 nt, artificial
  Chemically synthesized
gccuucucagcucagaca

SEQ ID NO: 12545 - RNA, 18 nt, artificial
  Chemically synthesized
ucauucuacaucaguucu

SEQ ID NO: 12546 - RNA, 18 nt, artificial
  Chemically synthesized
acucgaagcgggucagag

SEQ ID NO: 12547 - RNA, 18 nt, artificial
  Chemically synthesized
uuagcagaucccugcuuc

SEQ ID NO: 12548 - RNA, 18 nt, artificial
  Chemically synthesized
aaccuaucacaaaguguu

SEQ ID NO: 12549 - RNA, 18 nt, artificial
  Chemically synthesized
aggagccgaaagagaagg

SEQ ID NO: 12550 - RNA, 18 nt, artificial
  Chemically synthesized
uccgaggagcuguacucg

SEQ ID NO: 12551 - RNA, 18 nt, artificial
  Chemically synthesized
uucccgaaaucccaaacu

SEQ ID NO: 12552 - RNA, 18 nt, artificial
  Chemically synthesized
aagggcucagugcauugg

SEQ ID NO: 12553 - RNA, 18 nt, artificial
  Chemically synthesized
agggcucagugcauuggg

SEQ ID NO: 12554 - RNA, 18 nt, artificial
  Chemically synthesized
ucuccuucuccaccucga

SEQ ID NO: 12555 - RNA, 18 nt, artificial
  Chemically synthesized
uucaccuuucugcuauag

SEQ ID NO: 12556 - RNA, 18 nt, artificial
  Chemically synthesized
uaaauuaggcacaguaca

SEQ ID NO: 12557 - RNA, 18 nt, artificial
  Chemically synthesized
cuccggaugugccgagcc

SEQ ID NO: 12558 - RNA, 18 nt, artificial
  Chemically synthesized
cuacagcggcgccucucc

SEQ ID NO: 12559 - RNA, 18 nt, artificial
  Chemically synthesized
cugcgugggugcugaagg

SEQ ID NO: 12560 - RNA, 18 nt, artificial
  Chemically synthesized
ugcuugcguuccgcacac

SEQ ID NO: 12561 - RNA, 18 nt, artificial
  Chemically synthesized
gugcugaagggcucagug

SEQ ID NO: 12562 - RNA, 18 nt, artificial
  Chemically synthesized
guuuccacuguacuacuc

SEQ ID NO: 12563 - RNA, 18 nt, artificial
  Chemically synthesized
acuacagcggcgccucuc

SEQ ID NO: 12564 - RNA, 18 nt, artificial
  Chemically synthesized
auaacgcgcaacuucugc

SEQ ID NO: 12565 - RNA, 18 nt, artificial
  Chemically synthesized
uugaccacucgcacacca

SEQ ID NO: 12566 - RNA, 18 nt, artificial
  Chemically synthesized
aauaccuuggcaaccaca

SEQ ID NO: 12567 - RNA, 18 nt, artificial
  Chemically synthesized
aaggucuauagggcuugc

SEQ ID NO: 12568 - RNA, 18 nt, artificial
  Chemically synthesized
uguccgaggagcuguacu

SEQ ID NO: 12569 - RNA, 18 nt, artificial
  Chemically synthesized
ggugagcucgcuucaugc

SEQ ID NO: 12570 - RNA, 18 nt, artificial
  Chemically synthesized
cuucaugcuggcucccug

SEQ ID NO: 12571 - RNA, 18 nt, artificial
  Chemically synthesized
cagggaauguguccgagg

SEQ ID NO: 12572 - RNA, 18 nt, artificial
  Chemically synthesized
uccggaugugccgagccc

SEQ ID NO: 12573 - RNA, 18 nt, artificial
  Chemically synthesized
cuugcguuccgcacacac

SEQ ID NO: 12574 - RNA, 18 nt, artificial
  Chemically synthesized
uuccaugcaccaaaagga

SEQ ID NO: 12575 - RNA, 18 nt, artificial
  Chemically synthesized
augugcgggugauguccg

SEQ ID NO: 12576 - RNA, 18 nt, artificial
  Chemically synthesized
gcgccucuccgcucucgg

SEQ ID NO: 12577 - RNA, 18 nt, artificial
  Chemically synthesized
agcugaucaucugauuug

SEQ ID NO: 12578 - RNA, 18 nt, artificial
  Chemically synthesized
cacaucaguacaacagag

SEQ ID NO: 12579 - RNA, 18 nt, artificial
  Chemically synthesized
caacacuccaaaugagac

SEQ ID NO: 12580 - RNA, 18 nt, artificial
  Chemically synthesized
gucccaggaaaauuaggu

SEQ ID NO: 12581 - RNA, 18 nt, artificial
  Chemically synthesized
ugaggagagcagaggcgg

SEQ ID NO: 12582 - RNA, 18 nt, artificial
  Chemically synthesized
ucuccuaacuaaaucaga

SEQ ID NO: 12583 - RNA, 18 nt, artificial
  Chemically synthesized
cccuuuuaaauaccuugg

SEQ ID NO: 12584 - RNA, 18 nt, artificial
  Chemically synthesized
cuccgauaguccauagca

SEQ ID NO: 12585 - RNA, 18 nt, artificial
  Chemically synthesized
guuccaugcaccaaaagg

SEQ ID NO: 12586 - RNA, 18 nt, artificial
  Chemically synthesized
auuaagcauagugguuug

SEQ ID NO: 12587 - RNA, 18 nt, artificial
  Chemically synthesized
augcaggcguauucuauu

SEQ ID NO: 12588 - RNA, 18 nt, artificial
  Chemically synthesized
ucagaggcaucuaguccu

SEQ ID NO: 12589 - RNA, 18 nt, artificial
  Chemically synthesized
ucugggaagauguaguug

SEQ ID NO: 12590 - RNA, 18 nt, artificial
  Chemically synthesized
uucugccaggcauucccg

SEQ ID NO: 12591 - RNA, 18 nt, artificial
  Chemically synthesized
ccuagagccgaacucaag

SEQ ID NO: 12592 - RNA, 18 nt, artificial
  Chemically synthesized
ucacaacacaucaguaca

SEQ ID NO: 12593 - RNA, 18 nt, artificial
  Chemically synthesized
gaggaguuaacuacagcg

SEQ ID NO: 12594 - RNA, 18 nt, artificial
  Chemically synthesized
caggaucucggcuuuuuc

SEQ ID NO: 12595 - RNA, 18 nt, artificial
  Chemically synthesized
gugauguuggcaacaguc

SEQ ID NO: 12596 - RNA, 18 nt, artificial
  Chemically synthesized
aggcguauucuauucaau

SEQ ID NO: 12597 - RNA, 18 nt, artificial
  Chemically synthesized
gucucgucggcgcuucuc

SEQ ID NO: 12598 - RNA, 18 nt, artificial
  Chemically synthesized
aucccaaacuccgauagu

SEQ ID NO: 12599 - RNA, 18 nt, artificial
  Chemically synthesized
auguuggcaacaguccag

SEQ ID NO: 12600 - RNA, 18 nt, artificial
  Chemically synthesized
ugggaagcguaguuguug

SEQ ID NO: 12601 - RNA, 18 nt, artificial
  Chemically synthesized
agcuggucagauggauuc

SEQ ID NO: 12602 - RNA, 18 nt, artificial
  Chemically synthesized
cuucaguuuccuuuccac

SEQ ID NO: 12603 - RNA, 18 nt, artificial
  Chemically synthesized
uuuuucuagcuuagcaga

SEQ ID NO: 12604 - RNA, 18 nt, artificial
  Chemically synthesized
gaaaucccaaacuccgau

SEQ ID NO: 12605 - RNA, 18 nt, artificial
  Chemically synthesized
cagcugggauuuuaaacu

SEQ ID NO: 12606 - RNA, 18 nt, artificial
  Chemically synthesized
aacuccgauaguccauag

SEQ ID NO: 12607 - RNA, 18 nt, artificial
  Chemically synthesized
gucagauggauucagggc

SEQ ID NO: 12608 - RNA, 18 nt, artificial
  Chemically synthesized
ggaauguguccgaggccc

SEQ ID NO: 12609 - RNA, 18 nt, artificial
  Chemically synthesized
auuugagauccgugugau

SEQ ID NO: 12610 - RNA, 18 nt, artificial
  Chemically synthesized
acggaaucauucugguuu

SEQ ID NO: 12611 - RNA, 18 nt, artificial
  Chemically synthesized
gucaucugcaggaucucg

SEQ ID NO: 12612 - RNA, 18 nt, artificial
  Chemically synthesized
cagggaggaguuaacuac

SEQ ID NO: 12613 - RNA, 18 nt, artificial
  Chemically synthesized
ucaaccauccuuucccac

SEQ ID NO: 12614 - RNA, 18 nt, artificial
  Chemically synthesized
guccuggcagauaccagc

SEQ ID NO: 12615 - RNA, 18 nt, artificial
  Chemically synthesized
acaguuuggaggcggagg

SEQ ID NO: 12616 - RNA, 18 nt, artificial
  Chemically synthesized
uuuaaaaagcuccgaucu

SEQ ID NO: 12617 - RNA, 18 nt, artificial
  Chemically synthesized
uauagggcuugccaaggu

SEQ ID NO: 12618 - RNA, 18 nt, artificial
  Chemically synthesized
aauguguccgaggcccgc

SEQ ID NO: 12619 - RNA, 18 nt, artificial
  Chemically synthesized
ugaugcucagauaacgcg

SEQ ID NO: 12620 - RNA, 18 nt, artificial
  Chemically synthesized
cuaauacaugacaugaug

SEQ ID NO: 12621 - RNA, 18 nt, artificial
  Chemically synthesized
gagccgaacucaaguuuc

SEQ ID NO: 12622 - RNA, 18 nt, artificial
  Chemically synthesized
uggaaccuagagccgaac

SEQ ID NO: 12623 - RNA, 18 nt, artificial
  Chemically synthesized
ccaccaacaguuuguaca

SEQ ID NO: 12624 - RNA, 18 nt, artificial
  Chemically synthesized
ugauccacggucaucugc

SEQ ID NO: 12625 - RNA, 18 nt, artificial
  Chemically synthesized
gacaauuuacuagucuuc

SEQ ID NO: 12626 - RNA, 18 nt, artificial
  Chemically synthesized
cugaucaucugauuuguc

SEQ ID NO: 12627 - RNA, 18 nt, artificial
  Chemically synthesized
caccucgauggucucguc

SEQ ID NO: 12628 - RNA, 18 nt, artificial
  Chemically synthesized
acacugaucccgcucacg

SEQ ID NO: 12629 - RNA, 18 nt, artificial
  Chemically synthesized
aaaauauggcagucccag

SEQ ID NO: 12630 - RNA, 18 nt, artificial
  Chemically synthesized
gaugugcgggugaugucc

SEQ ID NO: 12631 - RNA, 18 nt, artificial
  Chemically synthesized
ugcgaaaccagucgaacu

SEQ ID NO: 12632 - RNA, 18 nt, artificial
  Chemically synthesized
gccucuccgcucucggcu

SEQ ID NO: 12633 - RNA, 18 nt, artificial
  Chemically synthesized
guuuccauucucguccgc

SEQ ID NO: 12634 - RNA, 18 nt, artificial
  Chemically synthesized
cucuccuucuccaccucg

SEQ ID NO: 12635 - RNA, 18 nt, artificial
  Chemically synthesized
cuagagccgaacucaagu

SEQ ID NO: 12636 - RNA, 18 nt, artificial
  Chemically synthesized
cauuuucaggugauccac

SEQ ID NO: 12637 - RNA, 18 nt, artificial
  Chemically synthesized
cucucuccuaacuaaauc

SEQ ID NO: 12638 - RNA, 18 nt, artificial
  Chemically synthesized
gaacucaaguuuccauuc

SEQ ID NO: 12639 - RNA, 18 nt, artificial
  Chemically synthesized
cgugggugcugaagggcu

SEQ ID NO: 12640 - RNA, 18 nt, artificial
  Chemically synthesized
aguuaacuacagcggcgc

SEQ ID NO: 12641 - RNA, 18 nt, artificial
  Chemically synthesized
cucgcuguccgaggagcu

SEQ ID NO: 12642 - RNA, 18 nt, artificial
  Chemically synthesized
uuggauaaagcugaucau

SEQ ID NO: 12643 - RNA, 18 nt, artificial
  Chemically synthesized
uccacggucaucugcagg

SEQ ID NO: 12644 - RNA, 18 nt, artificial
  Chemically synthesized
aguggaaggagccgaaag

SEQ ID NO: 12645 - RNA, 18 nt, artificial
  Chemically synthesized
gaaagcccuuuuaaauac

SEQ ID NO: 12646 - RNA, 18 nt, artificial
  Chemically synthesized
agcacuggguaccagccu

SEQ ID NO: 12647 - RNA, 18 nt, artificial
  Chemically synthesized
acauggaaccuagagccg

SEQ ID NO: 12648 - RNA, 18 nt, artificial
  Chemically synthesized
aaccaacaaaccuuuagu

SEQ ID NO: 12649 - RNA, 18 nt, artificial
  Chemically synthesized
aacugcuaauacaugaca

SEQ ID NO: 12650 - RNA, 18 nt, artificial
  Chemically synthesized
guaaaccaacaaaccuuu

SEQ ID NO: 12651 - RNA, 18 nt, artificial
  Chemically synthesized
cuugccaagguuugcagc

SEQ ID NO: 12652 - RNA, 18 nt, artificial
  Chemically synthesized
aguuuccacuguacuacu

SEQ ID NO: 12653 - RNA, 18 nt, artificial
  Chemically synthesized
gaccauaacuauacaagg

SEQ ID NO: 12654 - RNA, 18 nt, artificial
  Chemically synthesized
ugggauuuuaaacuuucc

SEQ ID NO: 12655 - RNA, 18 nt, artificial
  Chemically synthesized
uccuaacuaaaucagaac

SEQ ID NO: 12656 - RNA, 18 nt, artificial
  Chemically synthesized
ccuuuuaaauaccuuggc

SEQ ID NO: 12657 - RNA, 18 nt, artificial
  Chemically synthesized
ggaaaauuagguuaugca

SEQ ID NO: 12658 - RNA, 18 nt, artificial
  Chemically synthesized
aauuaccuucaguuuccu

SEQ ID NO: 12659 - RNA, 18 nt, artificial
  Chemically synthesized
ucaaagagaaggaggcag

SEQ ID NO: 12660 - RNA, 18 nt, artificial
  Chemically synthesized
ugccgagcccagccugcc

SEQ ID NO: 12661 - RNA, 18 nt, artificial
  Chemically synthesized
gcaaccacaguuccaugc

SEQ ID NO: 12662 - RNA, 18 nt, artificial
  Chemically synthesized
gaauguguccgaggcccg

SEQ ID NO: 12663 - RNA, 18 nt, artificial
  Chemically synthesized
agccugcccugguggugc

SEQ ID NO: 12664 - RNA, 18 nt, artificial
  Chemically synthesized
uaguuguugagaugcgaa

SEQ ID NO: 12665 - RNA, 18 nt, artificial
  Chemically synthesized
ggcuuuuucuagcuuagc

SEQ ID NO: 12666 - RNA, 18 nt, artificial
  Chemically synthesized
agucccaggaaaauuagg

SEQ ID NO: 12667 - RNA, 18 nt, artificial
  Chemically synthesized
caacagaggucaaaccca

SEQ ID NO: 12668 - RNA, 18 nt, artificial
  Chemically synthesized
ucagaacugccaguccug

SEQ ID NO: 12669 - RNA, 18 nt, artificial
  Chemically synthesized
cggucucgucggcgcuuc

SEQ ID NO: 12670 - RNA, 18 nt, artificial
  Chemically synthesized
cagcggcgccucuccgcu

SEQ ID NO: 12671 - RNA, 18 nt, artificial
  Chemically synthesized
cgcucucggcugcuugcg

SEQ ID NO: 12672 - RNA, 18 nt, artificial
  Chemically synthesized
caucuaguccuucaauga

SEQ ID NO: 12673 - RNA, 18 nt, artificial
  Chemically synthesized
ucguccagcucgcugucc

SEQ ID NO: 12674 - RNA, 18 nt, artificial
  Chemically synthesized
cauucaccuuucugcuau

SEQ ID NO: 12675 - RNA, 18 nt, artificial
  Chemically synthesized
cugaggagagcagaggcg

SEQ ID NO: 12676 - RNA, 18 nt, artificial
  Chemically synthesized
ccuaucagcggcucucuc

SEQ ID NO: 12677 - RNA, 18 nt, artificial
  Chemically synthesized
aauuugagauccguguga

SEQ ID NO: 12678 - RNA, 18 nt, artificial
  Chemically synthesized
uaguccuucaaugaugcu

SEQ ID NO: 12679 - RNA, 18 nt, artificial
  Chemically synthesized
agaggcaucuaguccuuc

SEQ ID NO: 12680 - RNA, 18 nt, artificial
  Chemically synthesized
aaacccaguucaguggag

SEQ ID NO: 12681 - RNA, 18 nt, artificial
  Chemically synthesized
gugggugcugaagggcuc

SEQ ID NO: 12682 - RNA, 18 nt, artificial
  Chemically synthesized
ccuuucugcuauaggagg

SEQ ID NO: 12683 - RNA, 18 nt, artificial
  Chemically synthesized
caacaaaccuuuagucuu

SEQ ID NO: 12684 - RNA, 18 nt, artificial
  Chemically synthesized
cuguacuacucaauugac

SEQ ID NO: 12685 - RNA, 18 nt, artificial
  Chemically synthesized
aggagagcagaggcggcg

SEQ ID NO: 12686 - RNA, 18 nt, artificial
  Chemically synthesized
gcggcgacaguuuggagg

SEQ ID NO: 12687 - RNA, 18 nt, artificial
  Chemically synthesized
ucacuuauccauguuaac

SEQ ID NO: 12688 - RNA, 18 nt, artificial
  Chemically synthesized
cucagacaaacuguuauu

SEQ ID NO: 12689 - RNA, 18 nt, artificial
  Chemically synthesized
agcguaguuguugagaug

SEQ ID NO: 12690 - RNA, 18 nt, artificial
  Chemically synthesized
uacaacaccuuaaucugu

SEQ ID NO: 12691 - RNA, 18 nt, artificial
  Chemically synthesized
aaggagaaaaacagacca

SEQ ID NO: 12692 - RNA, 18 nt, artificial
  Chemically synthesized
ugcgugggugcugaaggg

SEQ ID NO: 12693 - RNA, 18 nt, artificial
  Chemically synthesized
ucgaagcgggucagaggc

SEQ ID NO: 12694 - RNA, 18 nt, artificial
  Chemically synthesized
ucggcuuuuucuagcuua

SEQ ID NO: 12695 - RNA, 18 nt, artificial
  Chemically synthesized
guaaguggaaggagccga

SEQ ID NO: 12696 - RNA, 18 nt, artificial
  Chemically synthesized
aaaagcacuggguaccag

SEQ ID NO: 12697 - RNA, 18 nt, artificial
  Chemically synthesized
aaaugagaccuaaccuau

SEQ ID NO: 12698 - RNA, 18 nt, artificial
  Chemically synthesized
gcucgcaaagcaggcgcc

SEQ ID NO: 12699 - RNA, 18 nt, artificial
  Chemically synthesized
ucgcaaagcaggcgccuc

SEQ ID NO: 12700 - RNA, 18 nt, artificial
  Chemically synthesized
uuugcagccugcgugggu

SEQ ID NO: 12701 - RNA, 18 nt, artificial
  Chemically synthesized
acagggaggccacugagg

SEQ ID NO: 12702 - RNA, 18 nt, artificial
  Chemically synthesized
gcuugccaagguuugcag

SEQ ID NO: 12703 - RNA, 18 nt, artificial
  Chemically synthesized
guccgaggcugccgcuag

SEQ ID NO: 12704 - RNA, 18 nt, artificial
  Chemically synthesized
aaagcaggcgccuccgga

SEQ ID NO: 12705 - RNA, 18 nt, artificial
  Chemically synthesized
ucgucggcgcuucucaau

SEQ ID NO: 12706 - RNA, 18 nt, artificial
  Chemically synthesized
cucuccgcucucggcugc

SEQ ID NO: 12707 - RNA, 18 nt, artificial
  Chemically synthesized
aguuuccuuuccaccaac

SEQ ID NO: 12708 - RNA, 18 nt, artificial
  Chemically synthesized
cucagugcauugggagac

SEQ ID NO: 12709 - RNA, 18 nt, artificial
  Chemically synthesized
gcuuuuucuagcuuagca

SEQ ID NO: 12710 - RNA, 18 nt, artificial
  Chemically synthesized
ccugcuaaaagaauaaac

SEQ ID NO: 12711 - RNA, 18 nt, artificial
  Chemically synthesized
aacaguccagcccagcug

SEQ ID NO: 12712 - RNA, 18 nt, artificial
  Chemically synthesized
aaccagucgaacucgaag

SEQ ID NO: 12713 - RNA, 18 nt, artificial
  Chemically synthesized
caguuuggaggcggaggu

SEQ ID NO: 12714 - RNA, 18 nt, artificial
  Chemically synthesized
ggcucagugcauugggag

SEQ ID NO: 12715 - RNA, 18 nt, artificial
  Chemically synthesized
aaaccagucgaacucgaa

SEQ ID NO: 12716 - RNA, 18 nt, artificial
  Chemically synthesized
gcguaguuguugagaugc

SEQ ID NO: 12717 - RNA, 18 nt, artificial
  Chemically synthesized
ucccucauucuacaucag

SEQ ID NO: 12718 - RNA, 18 nt, artificial
  Chemically synthesized
aaaguaaauuaggcacag

SEQ ID NO: 12719 - RNA, 18 nt, artificial
  Chemically synthesized
gcagaucccugcuucuca

SEQ ID NO: 12720 - RNA, 18 nt, artificial
  Chemically synthesized
cgcucgcaaagcaggcgc

SEQ ID NO: 12721 - RNA, 18 nt, artificial
  Chemically synthesized
cguggugcccgcguuccc

SEQ ID NO: 12722 - RNA, 18 nt, artificial
  Chemically synthesized
gcuuauacucacuauuuc

SEQ ID NO: 12723 - RNA, 18 nt, artificial
  Chemically synthesized
gauaaagcugaucaucug

SEQ ID NO: 12724 - RNA, 18 nt, artificial
  Chemically synthesized
uggaaggagccgaaagag

SEQ ID NO: 12725 - RNA, 18 nt, artificial
  Chemically synthesized
cucgauggucucguccag

SEQ ID NO: 12726 - RNA, 18 nt, artificial
  Chemically synthesized
ugaccacagggagcaccg

SEQ ID NO: 12727 - RNA, 18 nt, artificial
  Chemically synthesized
acaguuccaugcaccaaa

SEQ ID NO: 12728 - RNA, 18 nt, artificial
  Chemically synthesized
uuaagcauagugguuugg

SEQ ID NO: 12729 - RNA, 18 nt, artificial
  Chemically synthesized
ugcgggugauguccgaag

SEQ ID NO: 12730 - RNA, 18 nt, artificial
  Chemically synthesized
auggauucagggccacca

SEQ ID NO: 12731 - RNA, 18 nt, artificial
  Chemically synthesized
ggaucucggcuuuuucua

SEQ ID NO: 12732 - RNA, 18 nt, artificial
  Chemically synthesized
aguuuguacauucaccuu

SEQ ID NO: 12733 - RNA, 18 nt, artificial
  Chemically synthesized
accaugaucacuuaucca

SEQ ID NO: 12734 - RNA, 18 nt, artificial
  Chemically synthesized
gucuauagggcuugccaa

SEQ ID NO: 12735 - RNA, 18 nt, artificial
  Chemically synthesized
guaugcagcauuuucagg

SEQ ID NO: 12736 - RNA, 18 nt, artificial
  Chemically synthesized
ugggaagauguaguuggg

SEQ ID NO: 12737 - RNA, 18 nt, artificial
  Chemically synthesized
cgaacucaaguuuccauu

SEQ ID NO: 12738 - RNA, 18 nt, artificial
  Chemically synthesized
aacucaaguuuccauucu

SEQ ID NO: 12739 - RNA, 18 nt, artificial
  Chemically synthesized
aaccauccuuucccacgc

SEQ ID NO: 12740 - RNA, 18 nt, artificial
  Chemically synthesized
ucgcggcuucccgcuggg

SEQ ID NO: 12741 - RNA, 18 nt, artificial
  Chemically synthesized
ucggcgcuucucaauuau

SEQ ID NO: 12742 - RNA, 18 nt, artificial
  Chemically synthesized
cguaugcagcauuuucag

SEQ ID NO: 12743 - RNA, 18 nt, artificial
  Chemically synthesized
uccuuucccacgcugagc

SEQ ID NO: 12744 - RNA, 18 nt, artificial
  Chemically synthesized
uaccuuggcaaccacagu

SEQ ID NO: 12745 - RNA, 18 nt, artificial
  Chemically synthesized
ccguaugcagcauuuuca

SEQ ID NO: 12746 - RNA, 18 nt, artificial
  Chemically synthesized
cucagauaacgcgcaacu

SEQ ID NO: 12747 - RNA, 18 nt, artificial
  Chemically synthesized
auuuaacaguuuccacug

SEQ ID NO: 12748 - RNA, 18 nt, artificial
  Chemically synthesized
cagcagcuggucagaugg

SEQ ID NO: 12749 - RNA, 18 nt, artificial
  Chemically synthesized
aauauggcagucccagga

SEQ ID NO: 12750 - RNA, 18 nt, artificial
  Chemically synthesized
gcugcuugcguuccgcac

SEQ ID NO: 12751 - RNA, 18 nt, artificial
  Chemically synthesized
ggcugguaaaugcaggcg

SEQ ID NO: 12752 - RNA, 18 nt, artificial
  Chemically synthesized
agcggcgccucuccgcuc

SEQ ID NO: 12753 - RNA, 18 nt, artificial
  Chemically synthesized
gaugugccgagcccagcc

SEQ ID NO: 12754 - RNA, 18 nt, artificial
  Chemically synthesized
aagcugaucaucugauuu

SEQ ID NO: 12755 - RNA, 18 nt, artificial
  Chemically synthesized
caaacuccgauaguccau

SEQ ID NO: 12756 - RNA, 18 nt, artificial
  Chemically synthesized
ccgcucacgcuuugccuc

SEQ ID NO: 12757 - RNA, 18 nt, artificial
  Chemically synthesized
aguccuggcagauaccag

SEQ ID NO: 12758 - RNA, 18 nt, artificial
  Chemically synthesized
gggugauguccgaagacg

SEQ ID NO: 12759 - RNA, 18 nt, artificial
  Chemically synthesized
auccuuucccacgcugag

SEQ ID NO: 12760 - RNA, 18 nt, artificial
  Chemically synthesized
agcuccgaucuccguccc

SEQ ID NO: 12761 - RNA, 18 nt, artificial
  Chemically synthesized
aggcagacaauuuacuag

SEQ ID NO: 12762 - RNA, 18 nt, artificial
  Chemically synthesized
agaugcgaaaccagucga

SEQ ID NO: 12763 - RNA, 18 nt, artificial
  Chemically synthesized
gaaucauucugguuuaca

SEQ ID NO: 12764 - RNA, 18 nt, artificial
  Chemically synthesized
aagguuugcagccugcgu

SEQ ID NO: 12765 - RNA, 18 nt, artificial
  Chemically synthesized
ggcguauucuauucaauu

SEQ ID NO: 12766 - RNA, 18 nt, artificial
  Chemically synthesized
agaggcggcgacaguuug

SEQ ID NO: 12767 - RNA, 18 nt, artificial
  Chemically synthesized
cauuuaacaguuuccacu

SEQ ID NO: 12768 - RNA, 18 nt, artificial
  Chemically synthesized
caaaguaaauuaggcaca

SEQ ID NO: 12769 - RNA, 18 nt, artificial
  Chemically synthesized
gcgcaacuucugccaggc

SEQ ID NO: 12770 - RNA, 18 nt, artificial
  Chemically synthesized
accaacacuccaaaugag

SEQ ID NO: 12771 - RNA, 18 nt, artificial
  Chemically synthesized
augaucacuuauccaugu

SEQ ID NO: 12772 - RNA, 18 nt, artificial
  Chemically synthesized
cagucgaacucgaagcgg

SEQ ID NO: 12773 - RNA, 18 nt, artificial
  Chemically synthesized
aucccgcucacgcuuugc

SEQ ID NO: 12774 - RNA, 18 nt, artificial
  Chemically synthesized
uagggcuugccaagguuu

SEQ ID NO: 12775 - RNA, 18 nt, artificial
  Chemically synthesized
caagguuugcagccugcg

SEQ ID NO: 12776 - RNA, 18 nt, artificial
  Chemically synthesized
aggaaagcccuuuuaaau

SEQ ID NO: 12777 - RNA, 18 nt, artificial
  Chemically synthesized
cguaguuguugagaugcg

SEQ ID NO: 12778 - RNA, 18 nt, artificial
  Chemically synthesized
auccacggucaucugcag

SEQ ID NO: 12779 - RNA, 18 nt, artificial
  Chemically synthesized
cuuggcaaccacaguucc

SEQ ID NO: 12780 - RNA, 18 nt, artificial
  Chemically synthesized
acggucaucugcaggauc

SEQ ID NO: 12781 - RNA, 18 nt, artificial
  Chemically synthesized
uccgaggcugccgcuagg

SEQ ID NO: 12782 - RNA, 18 nt, artificial
  Chemically synthesized
uuucugcuauaggaggca

SEQ ID NO: 12783 - RNA, 18 nt, artificial
  Chemically synthesized
cgccucuccgcucucggc

SEQ ID NO: 12784 - RNA, 18 nt, artificial
  Chemically synthesized
cccaaggucuauagggcu

SEQ ID NO: 12785 - RNA, 18 nt, artificial
  Chemically synthesized
caccaaaaggaaaacuca

SEQ ID NO: 12786 - RNA, 18 nt, artificial
  Chemically synthesized
gcaaaaacggaaucauuc

SEQ ID NO: 12787 - RNA, 18 nt, artificial
  Chemically synthesized
agauaccagcagcugguc

SEQ ID NO: 12788 - RNA, 18 nt, artificial
  Chemically synthesized
aggccacugaggagagca

SEQ ID NO: 12789 - RNA, 18 nt, artificial
  Chemically synthesized
cauuaagcauagugguuu

SEQ ID NO: 12790 - RNA, 18 nt, artificial
  Chemically synthesized
ccaugaucacuuauccau

SEQ ID NO: 12791 - RNA, 18 nt, artificial
  Chemically synthesized
ucguuuaacuacaccugc

SEQ ID NO: 12792 - RNA, 18 nt, artificial
  Chemically synthesized
guaaauuaggcacaguac

SEQ ID NO: 12793 - RNA, 18 nt, artificial
  Chemically synthesized
ggucguuuaacuacaccu

SEQ ID NO: 12794 - RNA, 18 nt, artificial
  Chemically synthesized
cucgcacaccaugaucac

SEQ ID NO: 12795 - RNA, 18 nt, artificial
  Chemically synthesized
agaaggaggcaggaaagc

SEQ ID NO: 12796 - RNA, 18 nt, artificial
  Chemically synthesized
cguuccgcacacacugau

SEQ ID NO: 12797 - RNA, 18 nt, artificial
  Chemically synthesized
cucgaagcgggucagagg

SEQ ID NO: 12798 - RNA, 18 nt, artificial
  Chemically synthesized
caacacaucaguacaaca

SEQ ID NO: 12799 - RNA, 18 nt, artificial
  Chemically synthesized
ggcgccuccggaugugcc

SEQ ID NO: 12800 - RNA, 18 nt, artificial
  Chemically synthesized
gacaguaaguggaaggag

SEQ ID NO: 12801 - RNA, 18 nt, artificial
  Chemically synthesized
cacacugaucccgcucac

SEQ ID NO: 12802 - RNA, 18 nt, artificial
  Chemically synthesized
caaaaucugggaagaugu

SEQ ID NO: 12803 - RNA, 18 nt, artificial
  Chemically synthesized
cagccuucucagcucaga

SEQ ID NO: 12804 - RNA, 18 nt, artificial
  Chemically synthesized
caaaaacggaaucauucu

SEQ ID NO: 12805 - RNA, 18 nt, artificial
  Chemically synthesized
cucucggcugcuugcguu

SEQ ID NO: 12806 - RNA, 18 nt, artificial
  Chemically synthesized
acacaucaguacaacaga

SEQ ID NO: 12807 - RNA, 18 nt, artificial
  Chemically synthesized
cacucgcacaccaugauc

SEQ ID NO: 12808 - RNA, 18 nt, artificial
  Chemically synthesized
uucaaugaugcucagaua

SEQ ID NO: 12809 - RNA, 18 nt, artificial
  Chemically synthesized
aaugagaccuaaccuauc

SEQ ID NO: 12810 - RNA, 18 nt, artificial
  Chemically synthesized
guggugcccgcguucccg

SEQ ID NO: 12811 - RNA, 18 nt, artificial
  Chemically synthesized
ccucccucauucuacauc

SEQ ID NO: 12812 - RNA, 18 nt, artificial
  Chemically synthesized
ccucuccgcucucggcug

SEQ ID NO: 12813 - RNA, 18 nt, artificial
  Chemically synthesized
accuaucacaaaguguug

SEQ ID NO: 12814 - RNA, 18 nt, artificial
  Chemically synthesized
uaaguggaaggagccgaa

SEQ ID NO: 12815 - RNA, 18 nt, artificial
  Chemically synthesized
ccuaucacaaaguguugg

SEQ ID NO: 12816 - RNA, 18 nt, artificial
  Chemically synthesized
ggcuugccaagguuugca

SEQ ID NO: 12817 - RNA, 18 nt, artificial
  Chemically synthesized
aguaaauuaggcacagua

SEQ ID NO: 12818 - RNA, 18 nt, artificial
  Chemically synthesized
cuggucagauggauucag

SEQ ID NO: 12819 - RNA, 18 nt, artificial
  Chemically synthesized
ggucucgucggcgcuucu

SEQ ID NO: 12820 - RNA, 18 nt, artificial
  Chemically synthesized
accuagagccgaacucaa

SEQ ID NO: 12821 - RNA, 18 nt, artificial
  Chemically synthesized
aggucaaacccaguucag

SEQ ID NO: 12822 - RNA, 18 nt, artificial
  Chemically synthesized
uuaaaacucaaccauccu

SEQ ID NO: 12823 - RNA, 18 nt, artificial
  Chemically synthesized
agcauagugguuuggaaa

SEQ ID NO: 12824 - RNA, 18 nt, artificial
  Chemically synthesized
ugcaccaaaaggaaaacu

SEQ ID NO: 12825 - RNA, 18 nt, artificial
  Chemically synthesized
auucagggccaccaacag

SEQ ID NO: 12826 - RNA, 18 nt, artificial
  Chemically synthesized
cacacacugaucccgcuc

SEQ ID NO: 12827 - RNA, 18 nt, artificial
  Chemically synthesized
aucugggaagauguaguu

SEQ ID NO: 12828 - RNA, 18 nt, artificial
  Chemically synthesized
gggugagcucgcuucaug

SEQ ID NO: 12829 - RNA, 18 nt, artificial
  Chemically synthesized
gcugguaaaugcaggcgu

SEQ ID NO: 12830 - RNA, 18 nt, artificial
  Chemically synthesized
cagacaauuuacuagucu

SEQ ID NO: 12831 - RNA, 18 nt, artificial
  Chemically synthesized
ccaguucaguggaggucg

SEQ ID NO: 12832 - RNA, 18 nt, artificial
  Chemically synthesized
gggaauguguccgaggcc

SEQ ID NO: 12833 - RNA, 18 nt, artificial
  Chemically synthesized
agcucgcuucaugcuggc

SEQ ID NO: 12834 - RNA, 18 nt, artificial
  Chemically synthesized
uuuugaggcaaaaacgga

SEQ ID NO: 12835 - RNA, 18 nt, artificial
  Chemically synthesized
caaaaggaaaacucacau

SEQ ID NO: 12836 - RNA, 18 nt, artificial
  Chemically synthesized
uggcagauaccagcagcu

SEQ ID NO: 12837 - RNA, 18 nt, artificial
  Chemically synthesized
ccagucgaacucgaagcg

SEQ ID NO: 12838 - RNA, 18 nt, artificial
  Chemically synthesized
cugcuugcguuccgcaca

SEQ ID NO: 12839 - RNA, 18 nt, artificial
  Chemically synthesized
cagauaccagcagcuggu

SEQ ID NO: 12840 - RNA, 18 nt, artificial
  Chemically synthesized
accuaaccuaucagcggc

SEQ ID NO: 12841 - RNA, 18 nt, artificial
  Chemically synthesized
aucuaguccuucaaugau

SEQ ID NO: 12842 - RNA, 18 nt, artificial
  Chemically synthesized
aaggagccgaaagagaag

SEQ ID NO: 12843 - RNA, 18 nt, artificial
  Chemically synthesized
augcucagauaacgcgca

SEQ ID NO: 12844 - RNA, 18 nt, artificial
  Chemically synthesized
cuccaaaugagaccuaac

SEQ ID NO: 12845 - RNA, 18 nt, artificial
  Chemically synthesized
ccuccugccguaugcagc

SEQ ID NO: 12846 - RNA, 18 nt, artificial
  Chemically synthesized
caaaccuaucacaaagug

SEQ ID NO: 12847 - RNA, 18 nt, artificial
  Chemically synthesized
cuuuuaaauaccuuggca

SEQ ID NO: 12848 - RNA, 18 nt, artificial
  Chemically synthesized
ccuucucagcucagacaa

SEQ ID NO: 12849 - RNA, 18 nt, artificial
  Chemically synthesized
cuggcagauaccagcagc

SEQ ID NO: 12850 - RNA, 18 nt, artificial
  Chemically synthesized
acgcuuugccucugguua

SEQ ID NO: 12851 - RNA, 18 nt, artificial
  Chemically synthesized
ccauaacuauacaaggag

SEQ ID NO: 12852 - RNA, 18 nt, artificial
  Chemically synthesized
aggugauccacggucauc

SEQ ID NO: 12853 - RNA, 18 nt, artificial
  Chemically synthesized
cgcugggaagcguaguug

SEQ ID NO: 12854 - RNA, 18 nt, artificial
  Chemically synthesized
ccacugaggagagcagag

SEQ ID NO: 12855 - RNA, 18 nt, artificial
  Chemically synthesized
ggaguuaacuacagcggc

SEQ ID NO: 12856 - RNA, 18 nt, artificial
  Chemically synthesized
ccaaaaggaaaacucaca

SEQ ID NO: 12857 - RNA, 18 nt, artificial
  Chemically synthesized
gaggucaaacccaguuca

SEQ ID NO: 12858 - RNA, 18 nt, artificial
  Chemically synthesized
ccugcuucucaaaagcac

SEQ ID NO: 12859 - RNA, 18 nt, artificial
  Chemically synthesized
cgguuccgugggugaggc

SEQ ID NO: 12860 - RNA, 18 nt, artificial
  Chemically synthesized
guaguuguugagaugcga

SEQ ID NO: 12861 - RNA, 18 nt, artificial
  Chemically synthesized
aacgcuuugcucagaaau

SEQ ID NO: 12862 - RNA, 18 nt, artificial
  Chemically synthesized
cucgcggcuucccgcugg

SEQ ID NO: 12863 - RNA, 18 nt, artificial
  Chemically synthesized
ucgcuguccgaggagcug

SEQ ID NO: 12864 - RNA, 18 nt, artificial
  Chemically synthesized
uguccgaggcccgcgugg

SEQ ID NO: 12865 - RNA, 18 nt, artificial
  Chemically synthesized
cgucaaaguaaccuuucc

SEQ ID NO: 12866 - RNA, 18 nt, artificial
  Chemically synthesized
uccagcucgcuguccgag

SEQ ID NO: 12867 - RNA, 18 nt, artificial
  Chemically synthesized
acgcuuugcucagaaaua

SEQ ID NO: 12868 - RNA, 18 nt, artificial
  Chemically synthesized
uucccguggccguucugg

SEQ ID NO: 12869 - RNA, 18 nt, artificial
  Chemically synthesized
ccucgauggucucgucca

SEQ ID NO: 12870 - RNA, 18 nt, artificial
  Chemically synthesized
ccaaacuccgauagucca

SEQ ID NO: 12871 - RNA, 18 nt, artificial
  Chemically synthesized
ggucaucugcaggaucuc

SEQ ID NO: 12872 - RNA, 18 nt, artificial
  Chemically synthesized
cacaguacaaaccuauca

SEQ ID NO: 12873 - RNA, 18 nt, artificial
  Chemically synthesized
gggacauggaaccuagag

SEQ ID NO: 12874 - RNA, 18 nt, artificial
  Chemically synthesized
gcgacaguuuggaggcgg

SEQ ID NO: 12875 - RNA, 18 nt, artificial
  Chemically synthesized
caguacaaaccuaucaca

SEQ ID NO: 12876 - RNA, 18 nt, artificial
  Chemically synthesized
uucuuuaaaaagcuccga

SEQ ID NO: 12877 - RNA, 18 nt, artificial
  Chemically synthesized
ugcuaauacaugacauga

SEQ ID NO: 12878 - RNA, 18 nt, artificial
  Chemically synthesized
uauaggaggcagacaauu

SEQ ID NO: 12879 - RNA, 18 nt, artificial
  Chemically synthesized
ucccaggaaaauuagguu

SEQ ID NO: 12880 - RNA, 18 nt, artificial
  Chemically synthesized
gaacugccaguccuggca

SEQ ID NO: 12881 - RNA, 18 nt, artificial
  Chemically synthesized
accgguccgaggcugccg

SEQ ID NO: 12882 - RNA, 18 nt, artificial
  Chemically synthesized
gcacuggguaccagccuu

SEQ ID NO: 12883 - RNA, 18 nt, artificial
  Chemically synthesized
aggcggaggugaccacag

SEQ ID NO: 12884 - RNA, 18 nt, artificial
  Chemically synthesized
augcaccaaaaggaaaac

SEQ ID NO: 12885 - RNA, 18 nt, artificial
  Chemically synthesized
ucgcacaccaugaucacu

SEQ ID NO: 12886 - RNA, 18 nt, artificial
  Chemically synthesized
auuaccuucaguuuccuu

SEQ ID NO: 12887 - RNA, 18 nt, artificial
  Chemically synthesized
aaguaaccuuucccuccu

SEQ ID NO: 12888 - RNA, 18 nt, artificial
  Chemically synthesized
cgaggagcuguacucggg

SEQ ID NO: 12889 - RNA, 18 nt, artificial
  Chemically synthesized
ccuuggcaaccacaguuc

SEQ ID NO: 12890 - RNA, 18 nt, artificial
  Chemically synthesized
gcagauaccagcagcugg

SEQ ID NO: 12891 - RNA, 18 nt, artificial
  Chemically synthesized
cauggaaccuagagccga

SEQ ID NO: 12892 - RNA, 18 nt, artificial
  Chemically synthesized
cuuuaaggugauguuggc

SEQ ID NO: 12893 - RNA, 18 nt, artificial
  Chemically synthesized
aggcgccuccggaugugc

SEQ ID NO: 12894 - RNA, 18 nt, artificial
  Chemically synthesized
ccgacagggaggccacug

SEQ ID NO: 12895 - RNA, 18 nt, artificial
  Chemically synthesized
ugcgcgucaaaguaaccu

SEQ ID NO: 12896 - RNA, 18 nt, artificial
  Chemically synthesized
agagaaggaggcaggaaa

SEQ ID NO: 12897 - RNA, 18 nt, artificial
  Chemically synthesized
gauggauucagggccacc

SEQ ID NO: 12898 - RNA, 18 nt, artificial
  Chemically synthesized
uagcaagggcgugcgcgu

SEQ ID NO: 12899 - RNA, 18 nt, artificial
  Chemically synthesized
caccaacacuccaaauga

SEQ ID NO: 12900 - RNA, 18 nt, artificial
  Chemically synthesized
cggcgacaguuuggaggc

SEQ ID NO: 12901 - RNA, 18 nt, artificial
  Chemically synthesized
acacacugaucccgcuca

SEQ ID NO: 12902 - RNA, 18 nt, artificial
  Chemically synthesized
augugccgagcccagccu

SEQ ID NO: 12903 - RNA, 18 nt, artificial
  Chemically synthesized
gccucggaccggugcucc

SEQ ID NO: 12904 - RNA, 18 nt, artificial
  Chemically synthesized
auaacaguuugucugagc

SEQ ID NO: 12905 - RNA, 18 nt, artificial
  Chemically synthesized
cagaugaccguggaucac

SEQ ID NO: 12906 - RNA, 18 nt, artificial
  Chemically synthesized
gcaaaccuuggcaagccc

SEQ ID NO: 12907 - RNA, 18 nt, artificial
  Chemically synthesized
cgagaccaucgaggugga

SEQ ID NO: 12908 - RNA, 18 nt, artificial
  Chemically synthesized
cuuugacgcgcacgcccu

SEQ ID NO: 12909 - RNA, 18 nt, artificial
  Chemically synthesized
gcuccucggacagcgagc

SEQ ID NO: 12910 - RNA, 18 nt, artificial
  Chemically synthesized
cugagcaucauugaagga

SEQ ID NO: 12911 - RNA, 18 nt, artificial
  Chemically synthesized
auggaaacuugaguucgg

SEQ ID NO: 12912 - RNA, 18 nt, artificial
  Chemically synthesized
cugagcugagaaggcugg

SEQ ID NO: 12913 - RNA, 18 nt, artificial
  Chemically synthesized
uggaucaccugaaaaugc

SEQ ID NO: 12914 - RNA, 18 nt, artificial
  Chemically synthesized
cucggacacauucccugg

SEQ ID NO: 12915 - RNA, 18 nt, artificial
  Chemically synthesized
uaacaguuugucugagcu

SEQ ID NO: 12916 - RNA, 18 nt, artificial
  Chemically synthesized
caacaucaccuuaaaguc

SEQ ID NO: 12917 - RNA, 18 nt, artificial
  Chemically synthesized
uugagaagcagggaucug

SEQ ID NO: 12918 - RNA, 18 nt, artificial
  Chemically synthesized
uuugagaagcagggaucu

SEQ ID NO: 12919 - RNA, 18 nt, artificial
  Chemically synthesized
uugcuauggacuaucgga

SEQ ID NO: 12920 - RNA, 18 nt, artificial
  Chemically synthesized
ccuugcuauggacuaucg

SEQ ID NO: 12921 - RNA, 18 nt, artificial
  Chemically synthesized
cuccucggacagcgagcu

SEQ ID NO: 12922 - RNA, 18 nt, artificial
  Chemically synthesized
ugccaacaucaccuuaaa

SEQ ID NO: 12923 - RNA, 18 nt, artificial
  Chemically synthesized
agccagcaugaagcgagc

SEQ ID NO: 12924 - RNA, 18 nt, artificial
  Chemically synthesized
cacgcccuugcuauggac

SEQ ID NO: 12925 - RNA, 18 nt, artificial
  Chemically synthesized
accaucgagguggagaag

SEQ ID NO: 12926 - RNA, 18 nt, artificial
  Chemically synthesized
gcgcacgcccuugcuaug

SEQ ID NO: 12927 - RNA, 18 nt, artificial
  Chemically synthesized
guacagcuccucggacag

SEQ ID NO: 12928 - RNA, 18 nt, artificial
  Chemically synthesized
agcgggaagccgcgagcg

SEQ ID NO: 12929 - RNA, 18 nt, artificial
  Chemically synthesized
agccucggaccggugcuc

SEQ ID NO: 12930 - RNA, 18 nt, artificial
  Chemically synthesized
gaucaccugaaaaugcug

SEQ ID NO: 12931 - RNA, 18 nt, artificial
  Chemically synthesized
uuugucugagcugagaag

SEQ ID NO: 12932 - RNA, 18 nt, artificial
  Chemically synthesized
cagcgggaagccgcgagc

SEQ ID NO: 12933 - RNA, 18 nt, artificial
  Chemically synthesized
uggaaacuugaguucggc

SEQ ID NO: 12934 - RNA, 18 nt, artificial
  Chemically synthesized
accgcaccaccagggcag

SEQ ID NO: 12935 - RNA, 18 nt, artificial
  Chemically synthesized
agcagggaucugcuaagc

SEQ ID NO: 12936 - RNA, 18 nt, artificial
  Chemically synthesized
cuccaaacugucgccgcc

SEQ ID NO: 12937 - RNA, 18 nt, artificial
  Chemically synthesized
uccucggacagcgagcug

SEQ ID NO: 12938 - RNA, 18 nt, artificial
  Chemically synthesized
aagcagggaucugcuaag

SEQ ID NO: 12939 - RNA, 18 nt, artificial
  Chemically synthesized
ccucggaccggugcuccc

SEQ ID NO: 12940 - RNA, 18 nt, artificial
  Chemically synthesized
cucccugucggccuuccc

SEQ ID NO: 12941 - RNA, 18 nt, artificial
  Chemically synthesized
aagcccuauagaccuugg

SEQ ID NO: 12942 - RNA, 18 nt, artificial
  Chemically synthesized
ucggacacauucccuggg

SEQ ID NO: 12943 - RNA, 18 nt, artificial
  Chemically synthesized
auccugcagaugaccgug

SEQ ID NO: 12944 - RNA, 18 nt, artificial
  Chemically synthesized
uacagcuccucggacagc

SEQ ID NO: 12945 - RNA, 18 nt, artificial
  Chemically synthesized
uuuugagaagcagggauc

SEQ ID NO: 12946 - RNA, 18 nt, artificial
  Chemically synthesized
aguuaacuccucccugcc

SEQ ID NO: 12947 - RNA, 18 nt, artificial
  Chemically synthesized
ucaccugaaaaugcugca

SEQ ID NO: 12948 - RNA, 18 nt, artificial
  Chemically synthesized
uaguuaacuccucccugc

SEQ ID NO: 12949 - RNA, 18 nt, artificial
  Chemically synthesized
ucggacagcgagcuggac

SEQ ID NO: 12950 - RNA, 18 nt, artificial
  Chemically synthesized
uucccagcgggaagccgc

SEQ ID NO: 12951 - RNA, 18 nt, artificial
  Chemically synthesized
ccgcaccaccagggcagg

SEQ ID NO: 12952 - RNA, 18 nt, artificial
  Chemically synthesized
cgccuccaaacugucgcc

SEQ ID NO: 12953 - RNA, 18 nt, artificial
  Chemically synthesized
ggagcaccgguccgaggc

SEQ ID NO: 12954 - RNA, 18 nt, artificial
  Chemically synthesized
gcucagacaaacuguuau

SEQ ID NO: 12955 - RNA, 18 nt, artificial
  Chemically synthesized
gugauccacggucaucug

SEQ ID NO: 12956 - RNA, 18 nt, artificial
  Chemically synthesized
gggcuugccaagguuugc

SEQ ID NO: 12957 - RNA, 18 nt, artificial
  Chemically synthesized
uccaccucgauggucucg

SEQ ID NO: 12958 - RNA, 18 nt, artificial
  Chemically synthesized
agggcgugcgcgucaaag

SEQ ID NO: 12959 - RNA, 18 nt, artificial
  Chemically synthesized
gcucgcuguccgaggagc

SEQ ID NO: 12960 - RNA, 18 nt, artificial
  Chemically synthesized
uccuucaaugaugcucag

SEQ ID NO: 12961 - RNA, 18 nt, artificial
  Chemically synthesized
ccgaacucaaguuuccau

SEQ ID NO: 12962 - RNA, 18 nt, artificial
  Chemically synthesized
ccagccuucucagcucag

SEQ ID NO: 12963 - RNA, 18 nt, artificial
  Chemically synthesized
gcauuuucaggugaucca

SEQ ID NO: 12964 - RNA, 18 nt, artificial
  Chemically synthesized
ccagggaauguguccgag

SEQ ID NO: 12965 - RNA, 18 nt, artificial
  Chemically synthesized
agcucagacaaacuguua

SEQ ID NO: 12966 - RNA, 18 nt, artificial
  Chemically synthesized
gacuuuaaggugauguug

SEQ ID NO: 12967 - RNA, 18 nt, artificial
  Chemically synthesized
cagaucccugcuucucaa

SEQ ID NO: 12968 - RNA, 18 nt, artificial
  Chemically synthesized
agaucccugcuucucaaa

SEQ ID NO: 12969 - RNA, 18 nt, artificial
  Chemically synthesized
uccgauaguccauagcaa

SEQ ID NO: 12970 - RNA, 18 nt, artificial
  Chemically synthesized
cgauaguccauagcaagg

SEQ ID NO: 12971 - RNA, 18 nt, artificial
  Chemically synthesized
agcucgcuguccgaggag

SEQ ID NO: 12972 - RNA, 18 nt, artificial
  Chemically synthesized
uuuaaggugauguuggca

SEQ ID NO: 12973 - RNA, 18 nt, artificial
  Chemically synthesized
gcucgcuucaugcuggcu

SEQ ID NO: 12974 - RNA, 18 nt, artificial
  Chemically synthesized
guccauagcaagggcgug

SEQ ID NO: 12975 - RNA, 18 nt, artificial
  Chemically synthesized
cuucuccaccucgauggu

SEQ ID NO: 12976 - RNA, 18 nt, artificial
  Chemically synthesized
cauagcaagggcgugcgc

SEQ ID NO: 12977 - RNA, 18 nt, artificial
  Chemically synthesized
cuguccgaggagcuguac

SEQ ID NO: 12978 - RNA, 18 nt, artificial
  Chemically synthesized
cgcucgcggcuucccgcu

SEQ ID NO: 12979 - RNA, 18 nt, artificial
  Chemically synthesized
gagcaccgguccgaggcu

SEQ ID NO: 12980 - RNA, 18 nt, artificial
  Chemically synthesized
cagcauuuucaggugauc

SEQ ID NO: 12981 - RNA, 18 nt, artificial
  Chemically synthesized
cuucucagcucagacaaa

SEQ ID NO: 12982 - RNA, 18 nt, artificial
  Chemically synthesized
gcucgcggcuucccgcug

SEQ ID NO: 12983 - RNA, 18 nt, artificial
  Chemically synthesized
gccgaacucaaguuucca

SEQ ID NO: 12984 - RNA, 18 nt, artificial
  Chemically synthesized
cugcccugguggugcggu

SEQ ID NO: 12985 - RNA, 18 nt, artificial
  Chemically synthesized
gcuuagcagaucccugcu

SEQ ID NO: 12986 - RNA, 18 nt, artificial
  Chemically synthesized
ggcggcgacaguuuggag

SEQ ID NO: 12987 - RNA, 18 nt, artificial
  Chemically synthesized
cagcucgcuguccgagga

SEQ ID NO: 12988 - RNA, 18 nt, artificial
  Chemically synthesized
cuuagcagaucccugcuu

SEQ ID NO: 12989 - RNA, 18 nt, artificial
  Chemically synthesized
gggagcaccgguccgagg

SEQ ID NO: 12990 - RNA, 18 nt, artificial
  Chemically synthesized
gggaaggccgacagggag

SEQ ID NO: 12991 - RNA, 18 nt, artificial
  Chemically synthesized
ccaaggucuauagggcuu

SEQ ID NO: 12992 - RNA, 18 nt, artificial
  Chemically synthesized
cccagggaauguguccga

SEQ ID NO: 12993 - RNA, 18 nt, artificial
  Chemically synthesized
cacggucaucugcaggau

SEQ ID NO: 12994 - RNA, 18 nt, artificial
  Chemically synthesized
gcuguccgaggagcugua

SEQ ID NO: 12995 - RNA, 18 nt, artificial
  Chemically synthesized
gaucccugcuucucaaaa

SEQ ID NO: 12996 - RNA, 18 nt, artificial
  Chemically synthesized
ggcagggaggaguuaacu

SEQ ID NO: 12997 - RNA, 18 nt, artificial
  Chemically synthesized
ugcagcauuuucagguga

SEQ ID NO: 12998 - RNA, 18 nt, artificial
  Chemically synthesized
gcagggaggaguuaacua

SEQ ID NO: 12999 - RNA, 18 nt, artificial
  Chemically synthesized
guccagcucgcuguccga

SEQ ID NO: 13000 - RNA, 18 nt, artificial
  Chemically synthesized
gcggcuucccgcugggaa

SEQ ID NO: 13001 - RNA, 18 nt, artificial
  Chemically synthesized
ccugcccugguggugcgg

SEQ ID NO: 13002 - RNA, 18 nt, Artificial Sequence
  Chemically synthesized
ggcgacaguuuggaggcg

SEQ ID NO: 13003 - RNA, 19 nt, artificial
  Chemically synthesized
cgugagaguuuuuguuuaa

SEQ ID NO: 13004 - RNA, 19 nt, artificial
  Chemically synthesized
ggagcacuaggaagagaaa

SEQ ID NO: 13005 - RNA, 19 nt, artificial
  Chemically synthesized
gcaucaguaugucugaauu

SEQ ID NO: 13006 - RNA, 19 nt, artificial
  Chemically synthesized
aguuuaucugaguugagaa

SEQ ID NO: 13007 - RNA, 19 nt, artificial
  Chemically synthesized
gggagcacuaggaagagaa

SEQ ID NO: 13008 - RNA, 19 nt, artificial
  Chemically synthesized
gugcauugguauaagcaau

SEQ ID NO: 13009 - RNA, 19 nt, artificial
  Chemically synthesized
ggguugugguuuuguuuuu

SEQ ID NO: 13010 - RNA, 19 nt, artificial
  Chemically synthesized
cccugaagguagccauaca

SEQ ID NO: 13011 - RNA, 19 nt, artificial
  Chemically synthesized
agaagaguauucugcugaa

SEQ ID NO: 13012 - RNA, 19 nt, artificial
  Chemically synthesized
gcauuacuuuguaaccuuu

SEQ ID NO: 13013 - RNA, 19 nt, artificial
  Chemically synthesized
gaaguuuccuggaaaauau

SEQ ID NO: 13014 - RNA, 19 nt, artificial
  Chemically synthesized
agcaguggaacaaacaaua

SEQ ID NO: 13015 - RNA, 19 nt, artificial
  Chemically synthesized
ggagaaagcaauaaacauu

SEQ ID NO: 13016 - RNA, 19 nt, artificial
  Chemically synthesized
gcuauuuaauucaugccaa

SEQ ID NO: 13017 - RNA, 19 nt, artificial
  Chemically synthesized
gagucuuuacauaccacua

SEQ ID NO: 13018 - RNA, 19 nt, artificial
  Chemically synthesized
acgugagaguuuuuguuua

SEQ ID NO: 13019 - RNA, 19 nt, artificial
  Chemically synthesized
gucuuuacauaccacuaau

SEQ ID NO: 13020 - RNA, 19 nt, artificial
  Chemically synthesized
ccgagagugccuaacagaa

SEQ ID NO: 13021 - RNA, 19 nt, artificial
  Chemically synthesized
gcggauucagcccuccgaa

SEQ ID NO: 13022 - RNA, 19 nt, artificial
  Chemically synthesized
guaggaguuugguuuaauu

SEQ ID NO: 13023 - RNA, 19 nt, artificial
  Chemically synthesized
acaacaacaucucagauua

SEQ ID NO: 13024 - RNA, 19 nt, artificial
  Chemically synthesized
cuguguggagaaagcaaua

SEQ ID NO: 13025 - RNA, 19 nt, artificial
  Chemically synthesized
gcauuugaucccaaaacaa

SEQ ID NO: 13026 - RNA, 19 nt, artificial
  Chemically synthesized
agaccagcaguggaacaaa

SEQ ID NO: 13027 - RNA, 19 nt, artificial
  Chemically synthesized
ggucaaaaugacugcugaa

SEQ ID NO: 13028 - RNA, 19 nt, artificial
  Chemically synthesized
ggauauauaacauugcaca

SEQ ID NO: 13029 - RNA, 19 nt, artificial
  Chemically synthesized
gcgacauggacgagaccau

SEQ ID NO: 13030 - RNA, 19 nt, artificial
  Chemically synthesized
ggacagaaguuggagcuuu

SEQ ID NO: 13031 - RNA, 19 nt, artificial
  Chemically synthesized
cucagauuauggcaagaaa

SEQ ID NO: 13032 - RNA, 19 nt, artificial
  Chemically synthesized
ggugacauuuagcagugca

SEQ ID NO: 13033 - RNA, 19 nt, artificial
  Chemically synthesized
ccauuucagagucagcuua

SEQ ID NO: 13034 - RNA, 19 nt, artificial
  Chemically synthesized
gggacagaagucuugcaau

SEQ ID NO: 13035 - RNA, 19 nt, artificial
  Chemically synthesized
gauugcauuugaucccaaa

SEQ ID NO: 13036 - RNA, 19 nt, artificial
  Chemically synthesized
cugaauucucuugagacua

SEQ ID NO: 13037 - RNA, 19 nt, artificial
  Chemically synthesized
ggcaagaaagaaaaggaga

SEQ ID NO: 13038 - RNA, 19 nt, artificial
  Chemically synthesized
ccagcaguggaacaaacaa

SEQ ID NO: 13039 - RNA, 19 nt, artificial
  Chemically synthesized
aagcuauuugagacacaaa

SEQ ID NO: 13040 - RNA, 19 nt, artificial
  Chemically synthesized
ggcugcagacauuuuaaua

SEQ ID NO: 13041 - RNA, 19 nt, artificial
  Chemically synthesized
ccuaaugaugcaacaucua

SEQ ID NO: 13042 - RNA, 19 nt, artificial
  Chemically synthesized
gauagguuaagaaaggaaa

SEQ ID NO: 13043 - RNA, 19 nt, artificial
  Chemically synthesized
gggagcgagaacaauuacu

SEQ ID NO: 13044 - RNA, 19 nt, artificial
  Chemically synthesized
guuuguaggaguuugguuu

SEQ ID NO: 13045 - RNA, 19 nt, artificial
  Chemically synthesized
gaaguuuucuucuggauau

SEQ ID NO: 13046 - RNA, 19 nt, artificial
  Chemically synthesized
ggauagguuaagaaaggaa

SEQ ID NO: 13047 - RNA, 19 nt, artificial
  Chemically synthesized
gguugugguuuuguuuuuu

SEQ ID NO: 13048 - RNA, 19 nt, artificial
  Chemically synthesized
cauuucagagucagcuuaa

SEQ ID NO: 13049 - RNA, 19 nt, artificial
  Chemically synthesized
cagcaguggaacaaacaau

SEQ ID NO: 13050 - RNA, 19 nt, artificial
  Chemically synthesized
agaaguuuccuggaaaaua

SEQ ID NO: 13051 - RNA, 19 nt, artificial
  Chemically synthesized
gguucaaggcagcucggua

SEQ ID NO: 13052 - RNA, 19 nt, artificial
  Chemically synthesized
ccuucuuuguacagacaug

SEQ ID NO: 13053 - RNA, 19 nt, artificial
  Chemically synthesized
cuuuguacagacaugccaa

SEQ ID NO: 13054 - RNA, 19 nt, artificial
  Chemically synthesized
agaaguuggagcuuuuuaa

SEQ ID NO: 13055 - RNA, 19 nt, artificial
  Chemically synthesized
gcauugguauaagcaauua

SEQ ID NO: 13056 - RNA, 19 nt, artificial
  Chemically synthesized
caagaugaauguaugcaau

SEQ ID NO: 13057 - RNA, 19 nt, artificial
  Chemically synthesized
ggaaguuuucuucuggaua

SEQ ID NO: 13058 - RNA, 19 nt, artificial
  Chemically synthesized
gccugagcuuaggaaguuu

SEQ ID NO: 13059 - RNA, 19 nt, artificial
  Chemically synthesized
ucaucaguucucagauuaa

SEQ ID NO: 13060 - RNA, 19 nt, artificial
  Chemically synthesized
cacccugaagguagccaua

SEQ ID NO: 13061 - RNA, 19 nt, artificial
  Chemically synthesized
aucugaguugagaagacuu

SEQ ID NO: 13062 - RNA, 19 nt, artificial
  Chemically synthesized
ccuagucuuuuuugcauua

SEQ ID NO: 13063 - RNA, 19 nt, artificial
  Chemically synthesized
agugcauugguauaagcaa

SEQ ID NO: 13064 - RNA, 19 nt, artificial
  Chemically synthesized
gccaacugcuuuugaaaaa

SEQ ID NO: 13065 - RNA, 19 nt, artificial
  Chemically synthesized
agagggauuauagagaaaa

SEQ ID NO: 13066 - RNA, 19 nt, artificial
  Chemically synthesized
gcauguauuaugcacuuca

SEQ ID NO: 13067 - RNA, 19 nt, artificial
  Chemically synthesized
cauguauuaugcacuucau

SEQ ID NO: 13068 - RNA, 19 nt, artificial
  Chemically synthesized
agucuuuacauaccacuaa

SEQ ID NO: 13069 - RNA, 19 nt, artificial
  Chemically synthesized
gaauucucuugagacuaga

SEQ ID NO: 13070 - RNA, 19 nt, artificial
  Chemically synthesized
guguggagaaagcaauaaa

SEQ ID NO: 13071 - RNA, 19 nt, artificial
  Chemically synthesized
cugaguugagaagacuugu

SEQ ID NO: 13072 - RNA, 19 nt, artificial
  Chemically synthesized
cucugugauuagauugaau

SEQ ID NO: 13073 - RNA, 19 nt, artificial
  Chemically synthesized
gaagagaaaagcuacaauu

SEQ ID NO: 13074 - RNA, 19 nt, artificial
  Chemically synthesized
gaugcaacaucuauucuug

SEQ ID NO: 13075 - RNA, 19 nt, artificial
  Chemically synthesized
cucagauuaacaagcauuu

SEQ ID NO: 13076 - RNA, 19 nt, artificial
  Chemically synthesized
gugacauuuagcagugcau

SEQ ID NO: 13077 - RNA, 19 nt, artificial
  Chemically synthesized
augcaagagucuuuacaua

SEQ ID NO: 13078 - RNA, 19 nt, artificial
  Chemically synthesized
guaaccuuuuucuaugcaa

SEQ ID NO: 13079 - RNA, 19 nt, artificial
  Chemically synthesized
cuccaugccucagagucaa

SEQ ID NO: 13080 - RNA, 19 nt, artificial
  Chemically synthesized
ugcauuugaucccaaaaca

SEQ ID NO: 13081 - RNA, 19 nt, artificial
  Chemically synthesized
cuucauuucucuacugugu

SEQ ID NO: 13082 - RNA, 19 nt, artificial
  Chemically synthesized
agguuuuacuggucaaaau

SEQ ID NO: 13083 - RNA, 19 nt, artificial
  Chemically synthesized
cuugagacuagaugggaca

SEQ ID NO: 13084 - RNA, 19 nt, artificial
  Chemically synthesized
gauuauagagaaaaggcgu

SEQ ID NO: 13085 - RNA, 19 nt, artificial
  Chemically synthesized
gagggauuauagagaaaag

SEQ ID NO: 13086 - RNA, 19 nt, artificial
  Chemically synthesized
cggauucagcccuccgaau

SEQ ID NO: 13087 - RNA, 19 nt, artificial
  Chemically synthesized
ggaagagaaaagcuacaau

SEQ ID NO: 13088 - RNA, 19 nt, artificial
  Chemically synthesized
aaaugacaguggaucauuu

SEQ ID NO: 13089 - RNA, 19 nt, artificial
  Chemically synthesized
aacugaauguccuccauuu

SEQ ID NO: 13090 - RNA, 19 nt, artificial
  Chemically synthesized
ggaaaauauauggaccgua

SEQ ID NO: 13091 - RNA, 19 nt, artificial
  Chemically synthesized
gggauguacauaaguuauu

SEQ ID NO: 13092 - RNA, 19 nt, artificial
  Chemically synthesized
ggcuauuuaauucaugcca

SEQ ID NO: 13093 - RNA, 19 nt, artificial
  Chemically synthesized
gagcacuaggaagagaaaa

SEQ ID NO: 13094 - RNA, 19 nt, artificial
  Chemically synthesized
cccuuugggagaaguuaca

SEQ ID NO: 13095 - RNA, 19 nt, artificial
  Chemically synthesized
ccaccagaggcuauuuaau

SEQ ID NO: 13096 - RNA, 19 nt, artificial
  Chemically synthesized
aaagcuauuugagacacaa

SEQ ID NO: 13097 - RNA, 19 nt, artificial
  Chemically synthesized
ggaucauuugaagaugcuu

SEQ ID NO: 13098 - RNA, 19 nt, artificial
  Chemically synthesized
cuugcaauaguaacugaau

SEQ ID NO: 13099 - RNA, 19 nt, artificial
  Chemically synthesized
gagaagaguauucugcuga

SEQ ID NO: 13100 - RNA, 19 nt, artificial
  Chemically synthesized
agugcaucaguaugucuga

SEQ ID NO: 13101 - RNA, 19 nt, artificial
  Chemically synthesized
agacuagaugggacauaca

SEQ ID NO: 13102 - RNA, 19 nt, artificial
  Chemically synthesized
gcugcuuuauauaaaccuu

SEQ ID NO: 13103 - RNA, 19 nt, artificial
  Chemically synthesized
cacccuuugggagaaguua

SEQ ID NO: 13104 - RNA, 19 nt, artificial
  Chemically synthesized
ugcaaugggauguacauaa

SEQ ID NO: 13105 - RNA, 19 nt, artificial
  Chemically synthesized
cccaaaacaagaugaaugu

SEQ ID NO: 13106 - RNA, 19 nt, artificial
  Chemically synthesized
ggaagacgaguguggagga

SEQ ID NO: 13107 - RNA, 19 nt, artificial
  Chemically synthesized
caaaaugacugcugaaaau

SEQ ID NO: 13108 - RNA, 19 nt, artificial
  Chemically synthesized
auaacauugcacaagggaa

SEQ ID NO: 13109 - RNA, 19 nt, artificial
  Chemically synthesized
ccuuuuuuguuugguucaa

SEQ ID NO: 13110 - RNA, 19 nt, artificial
  Chemically synthesized
gugcaucaguaugucugaa

SEQ ID NO: 13111 - RNA, 19 nt, artificial
  Chemically synthesized
agagaaaaggcgucgggau

SEQ ID NO: 13112 - RNA, 19 nt, artificial
  Chemically synthesized
aucuauucuugucacccuu

SEQ ID NO: 13113 - RNA, 19 nt, artificial
  Chemically synthesized
cuugaaaacucuccaguuu

SEQ ID NO: 13114 - RNA, 19 nt, artificial
  Chemically synthesized
cuagcucugugauuagauu

SEQ ID NO: 13115 - RNA, 19 nt, artificial
  Chemically synthesized
gagacacagcauguauuau

SEQ ID NO: 13116 - RNA, 19 nt, artificial
  Chemically synthesized
ggauuauagagaaaaggcg

SEQ ID NO: 13117 - RNA, 19 nt, artificial
  Chemically synthesized
uucucuacuguguggagaa

SEQ ID NO: 13118 - RNA, 19 nt, artificial
  Chemically synthesized
auugaauucuccaacaaca

SEQ ID NO: 13119 - RNA, 19 nt, artificial
  Chemically synthesized
ugccaagaggugacauuua

SEQ ID NO: 13120 - RNA, 19 nt, artificial
  Chemically synthesized
ugcauuacuuuguaaccuu

SEQ ID NO: 13121 - RNA, 19 nt, artificial
  Chemically synthesized
gggagaaguuacauuucug

SEQ ID NO: 13122 - RNA, 19 nt, artificial
  Chemically synthesized
acaagaugaauguaugcaa

SEQ ID NO: 13123 - RNA, 19 nt, artificial
  Chemically synthesized
uuagaaguuuccuggaaaa

SEQ ID NO: 13124 - RNA, 19 nt, artificial
  Chemically synthesized
agauuauggcaagaaagaa

SEQ ID NO: 13125 - RNA, 19 nt, artificial
  Chemically synthesized
caagcacgugagaguuuuu

SEQ ID NO: 13126 - RNA, 19 nt, artificial
  Chemically synthesized
gaaaaacaaggaucugcaa

SEQ ID NO: 13127 - RNA, 19 nt, artificial
  Chemically synthesized
agacgaccuccgagagcga

SEQ ID NO: 13128 - RNA, 19 nt, artificial
  Chemically synthesized
acugaauucucuugagacu

SEQ ID NO: 13129 - RNA, 19 nt, artificial
  Chemically synthesized
gaucccaaaacaagaugaa

SEQ ID NO: 13130 - RNA, 19 nt, artificial
  Chemically synthesized
caagagucuuuacauacca

SEQ ID NO: 13131 - RNA, 19 nt, artificial
  Chemically synthesized
cacuuguuaccauuuagaa

SEQ ID NO: 13132 - RNA, 19 nt, artificial
  Chemically synthesized
gaaaugugguauucucuuu

SEQ ID NO: 13133 - RNA, 19 nt, artificial
  Chemically synthesized
aggcgucgggaucggauaa

SEQ ID NO: 13134 - RNA, 19 nt, artificial
  Chemically synthesized
ccauggacuucaugagcau

SEQ ID NO: 13135 - RNA, 19 nt, artificial
  Chemically synthesized
cccuugucaguaucagcca

SEQ ID NO: 13136 - RNA, 19 nt, artificial
  Chemically synthesized
ccgagagcgacauggacga

SEQ ID NO: 13137 - RNA, 19 nt, artificial
  Chemically synthesized
aaggcuacuuugacgcaca

SEQ ID NO: 13138 - RNA, 19 nt, artificial
  Chemically synthesized
caguuucauuaggacuauu

SEQ ID NO: 13139 - RNA, 19 nt, artificial
  Chemically synthesized
acuagaugggacauacaua

SEQ ID NO: 13140 - RNA, 19 nt, artificial
  Chemically synthesized
gaucugcaaaguuagaaaa

SEQ ID NO: 13141 - RNA, 19 nt, artificial
  Chemically synthesized
caacaacaucucagauuau

SEQ ID NO: 13142 - RNA, 19 nt, artificial
  Chemically synthesized
cagagaagaguauucugcu

SEQ ID NO: 13143 - RNA, 19 nt, artificial
  Chemically synthesized
cagcauguauuaugcacuu

SEQ ID NO: 13144 - RNA, 19 nt, artificial
  Chemically synthesized
cuaaugaugcaacaucuau

SEQ ID NO: 13145 - RNA, 19 nt, artificial
  Chemically synthesized
cuagaugggacauacauau

SEQ ID NO: 13146 - RNA, 19 nt, artificial
  Chemically synthesized
caucuauucuugucacccu

SEQ ID NO: 13147 - RNA, 19 nt, artificial
  Chemically synthesized
gggacauacauauauagag

SEQ ID NO: 13148 - RNA, 19 nt, artificial
  Chemically synthesized
cccuuuuuuguuugguuca

SEQ ID NO: 13149 - RNA, 19 nt, artificial
  Chemically synthesized
ggaucggauaaauaacagu

SEQ ID NO: 13150 - RNA, 19 nt, artificial
  Chemically synthesized
aucaguucucagauuaaca

SEQ ID NO: 13151 - RNA, 19 nt, artificial
  Chemically synthesized
gaggagacgaccuccgaga

SEQ ID NO: 13152 - RNA, 19 nt, artificial
  Chemically synthesized
cauuuagaaguuuccugga

SEQ ID NO: 13153 - RNA, 19 nt, artificial
  Chemically synthesized
gacauuuagcagugcauug

SEQ ID NO: 13154 - RNA, 19 nt, artificial
  Chemically synthesized
ccagaggcuauuuaauuca

SEQ ID NO: 13155 - RNA, 19 nt, artificial
  Chemically synthesized
gagucagcuuaaaaccucu

SEQ ID NO: 13156 - RNA, 19 nt, artificial
  Chemically synthesized
ccaaaacaagaugaaugua

SEQ ID NO: 13157 - RNA, 19 nt, artificial
  Chemically synthesized
acuucaugagcauaggauu

SEQ ID NO: 13158 - RNA, 19 nt, artificial
  Chemically synthesized
cucuccaguuuguaggagu

SEQ ID NO: 13159 - RNA, 19 nt, artificial
  Chemically synthesized
agaguugcggcgugggaaa

SEQ ID NO: 13160 - RNA, 19 nt, artificial
  Chemically synthesized
aacaguuuaucugaguuga

SEQ ID NO: 13161 - RNA, 19 nt, artificial
  Chemically synthesized
caguggaucauuugaagau

SEQ ID NO: 13162 - RNA, 19 nt, artificial
  Chemically synthesized
agcccgcccuugucaguau

SEQ ID NO: 13163 - RNA, 19 nt, artificial
  Chemically synthesized
agcuauuugagacacaaac

SEQ ID NO: 13164 - RNA, 19 nt, artificial
  Chemically synthesized
gcaguugccuaccaugugu

SEQ ID NO: 13165 - RNA, 19 nt, artificial
  Chemically synthesized
gugguuuuguuuuuuucga

SEQ ID NO: 13166 - RNA, 19 nt, artificial
  Chemically synthesized
gauaagagacacagcaugu

SEQ ID NO: 13167 - RNA, 19 nt, artificial
  Chemically synthesized
gaauucuccaacaacaaca

SEQ ID NO: 13168 - RNA, 19 nt, artificial
  Chemically synthesized
guaccauccagcagugcau

SEQ ID NO: 13169 - RNA, 19 nt, artificial
  Chemically synthesized
agcucugugauuagauuga

SEQ ID NO: 13170 - RNA, 19 nt, artificial
  Chemically synthesized
cauuucuggaggugaugaa

SEQ ID NO: 13171 - RNA, 19 nt, artificial
  Chemically synthesized
ccuuuuucuaugcaagagu

SEQ ID NO: 13172 - RNA, 19 nt, artificial
  Chemically synthesized
cuggauauauaacauugca

SEQ ID NO: 13173 - RNA, 19 nt, artificial
  Chemically synthesized
ccuugucgccucuccacaa

SEQ ID NO: 13174 - RNA, 19 nt, artificial
  Chemically synthesized
gccagagaagaguauucug

SEQ ID NO: 13175 - RNA, 19 nt, artificial
  Chemically synthesized
agcucuuugucaaguuagu

SEQ ID NO: 13176 - RNA, 19 nt, artificial
  Chemically synthesized
ucucuacuguguggagaaa

SEQ ID NO: 13177 - RNA, 19 nt, artificial
  Chemically synthesized
cagaccagcaguggaacaa

SEQ ID NO: 13178 - RNA, 19 nt, artificial
  Chemically synthesized
ugacauuuagcagugcauu

SEQ ID NO: 13179 - RNA, 19 nt, artificial
  Chemically synthesized
acuguguggagaaagcaau

SEQ ID NO: 13180 - RNA, 19 nt, artificial
  Chemically synthesized
ggagcgagaacaauuacuc

SEQ ID NO: 13181 - RNA, 19 nt, artificial
  Chemically synthesized
auauauagagagagaguga

SEQ ID NO: 13182 - RNA, 19 nt, artificial
  Chemically synthesized
agaggugacauuuagcagu

SEQ ID NO: 13183 - RNA, 19 nt, artificial
  Chemically synthesized
ccaugccagagaagaguau

SEQ ID NO: 13184 - RNA, 19 nt, artificial
  Chemically synthesized
ggaggauagguuaagaaag

SEQ ID NO: 13185 - RNA, 19 nt, artificial
  Chemically synthesized
aagagacacagcauguauu

SEQ ID NO: 13186 - RNA, 19 nt, artificial
  Chemically synthesized
ugaugcaacaucuauucuu

SEQ ID NO: 13187 - RNA, 19 nt, artificial
  Chemically synthesized
aguuugccuucuuuguaca

SEQ ID NO: 13188 - RNA, 19 nt, artificial
  Chemically synthesized
gugccaacugcuuuugaaa

SEQ ID NO: 13189 - RNA, 19 nt, artificial
  Chemically synthesized
uacuguguggagaaagcaa

SEQ ID NO: 13190 - RNA, 19 nt, artificial
  Chemically synthesized
caugccagagaagaguauu

SEQ ID NO: 13191 - RNA, 19 nt, artificial
  Chemically synthesized
cgguaacugacaucagcaa

SEQ ID NO: 13192 - RNA, 19 nt, artificial
  Chemically synthesized
gcacccugaagguagccau

SEQ ID NO: 13193 - RNA, 19 nt, artificial
  Chemically synthesized
uacuguaccuagucuuuuu

SEQ ID NO: 13194 - RNA, 19 nt, artificial
  Chemically synthesized
auugcacaagggaagacga

SEQ ID NO: 13195 - RNA, 19 nt, artificial
  Chemically synthesized
caaguugaaagaucuaguu

SEQ ID NO: 13196 - RNA, 19 nt, artificial
  Chemically synthesized
gaaagaaaaggagagggau

SEQ ID NO: 13197 - RNA, 19 nt, artificial
  Chemically synthesized
ggcagcucgguaacugaca

SEQ ID NO: 13198 - RNA, 19 nt, artificial
  Chemically synthesized
cauggacuucaugagcaua

SEQ ID NO: 13199 - RNA, 19 nt, artificial
  Chemically synthesized
cagcccugcuccagcccaa

SEQ ID NO: 13200 - RNA, 19 nt, artificial
  Chemically synthesized
agugcaccuaugagcaguu

SEQ ID NO: 13201 - RNA, 19 nt, artificial
  Chemically synthesized
uuuagaaguuuccuggaaa

SEQ ID NO: 13202 - RNA, 19 nt, artificial
  Chemically synthesized
gacugaauucucuugagac

SEQ ID NO: 13203 - RNA, 19 nt, artificial
  Chemically synthesized
cuuguuaccauuuagaagu

SEQ ID NO: 13204 - RNA, 19 nt, artificial
  Chemically synthesized
gccuucuuuguacagacau

SEQ ID NO: 13205 - RNA, 19 nt, artificial
  Chemically synthesized
gccauggacuucaugagca

SEQ ID NO: 13206 - RNA, 19 nt, artificial
  Chemically synthesized
gaauguccuccauuucaga

SEQ ID NO: 13207 - RNA, 19 nt, artificial
  Chemically synthesized
auuuagaaguuuccuggaa

SEQ ID NO: 13208 - RNA, 19 nt, artificial
  Chemically synthesized
gacaguggaucauuugaag

SEQ ID NO: 13209 - RNA, 19 nt, artificial
  Chemically synthesized
cgaguggaaaugugguauu

SEQ ID NO: 13210 - RNA, 19 nt, artificial
  Chemically synthesized
ugagacuagaugggacaua

SEQ ID NO: 13211 - RNA, 19 nt, artificial
  Chemically synthesized
caaaugacaguggaucauu

SEQ ID NO: 13212 - RNA, 19 nt, artificial
  Chemically synthesized
gcacgugagaguuuuuguu

SEQ ID NO: 13213 - RNA, 19 nt, artificial
  Chemically synthesized
ccuccgagagcgacaugga

SEQ ID NO: 13214 - RNA, 19 nt, artificial
  Chemically synthesized
auuugagacacaaaccuca

SEQ ID NO: 13215 - RNA, 19 nt, artificial
  Chemically synthesized
uggugcugcuuuauauaaa

SEQ ID NO: 13216 - RNA, 19 nt, artificial
  Chemically synthesized
auuugaucccaaaacaaga

SEQ ID NO: 13217 - RNA, 19 nt, artificial
  Chemically synthesized
agaaaaggagagggauuau

SEQ ID NO: 13218 - RNA, 19 nt, artificial
  Chemically synthesized
gcacaagggaagacgagug

SEQ ID NO: 13219 - RNA, 19 nt, artificial
  Chemically synthesized
gcugaaaccaacagguuuu

SEQ ID NO: 13220 - RNA, 19 nt, artificial
  Chemically synthesized
auugcauuugaucccaaaa

SEQ ID NO: 13221 - RNA, 19 nt, artificial
  Chemically synthesized
ugcacuucauuucucuacu

SEQ ID NO: 13222 - RNA, 19 nt, artificial
  Chemically synthesized
auauggugcugcuuuauau

SEQ ID NO: 13223 - RNA, 19 nt, artificial
  Chemically synthesized
agaugggacauacauauau

SEQ ID NO: 13224 - RNA, 19 nt, artificial
  Chemically synthesized
ucuccaguuuguaggaguu

SEQ ID NO: 13225 - RNA, 19 nt, artificial
  Chemically synthesized
caaaauauggugcugcuuu

SEQ ID NO: 13226 - RNA, 19 nt, artificial
  Chemically synthesized
ggugcugcuuuauauaaac

SEQ ID NO: 13227 - RNA, 19 nt, artificial
  Chemically synthesized
ucaguucucagauuaacaa

SEQ ID NO: 13228 - RNA, 19 nt, artificial
  Chemically synthesized
guccuccauuucagaguca

SEQ ID NO: 13229 - RNA, 19 nt, artificial
  Chemically synthesized
aaggcgucgggaucggaua

SEQ ID NO: 13230 - RNA, 19 nt, artificial
  Chemically synthesized
gcuauuugagacacaaacc

SEQ ID NO: 13231 - RNA, 19 nt, artificial
  Chemically synthesized
aguuagugauugcauuuga

SEQ ID NO: 13232 - RNA, 19 nt, artificial
  Chemically synthesized
ggaaaugugguauucucuu

SEQ ID NO: 13233 - RNA, 19 nt, artificial
  Chemically synthesized
auuucagagucagcuuaaa

SEQ ID NO: 13234 - RNA, 19 nt, artificial
  Chemically synthesized
ucaguaucagccacgucca

SEQ ID NO: 13235 - RNA, 19 nt, artificial
  Chemically synthesized
caacugcuuuugaaaaaca

SEQ ID NO: 13236 - RNA, 19 nt, artificial
  Chemically synthesized
uccacaaaggaacaauaaa

SEQ ID NO: 13237 - RNA, 19 nt, artificial
  Chemically synthesized
ccacguuugcccaugcgga

SEQ ID NO: 13238 - RNA, 19 nt, artificial
  Chemically synthesized
agagaagaguauucugcug

SEQ ID NO: 13239 - RNA, 19 nt, artificial
  Chemically synthesized
guaugcaaugggauguaca

SEQ ID NO: 13240 - RNA, 19 nt, artificial
  Chemically synthesized
gccucuccacaacuucaga

SEQ ID NO: 13241 - RNA, 19 nt, artificial
  Chemically synthesized
accaugccagagaagagua

SEQ ID NO: 13242 - RNA, 19 nt, artificial
  Chemically synthesized
uccuaaugaugcaacaucu

SEQ ID NO: 13243 - RNA, 19 nt, artificial
  Chemically synthesized
auccacaaaggaacaauaa

SEQ ID NO: 13244 - RNA, 19 nt, artificial
  Chemically synthesized
cuuugggagaaguuacauu

SEQ ID NO: 13245 - RNA, 19 nt, artificial
  Chemically synthesized
gcagcucgguaacugacau

SEQ ID NO: 13246 - RNA, 19 nt, artificial
  Chemically synthesized
cacgugagaguuuuuguuu

SEQ ID NO: 13247 - RNA, 19 nt, artificial
  Chemically synthesized
gacuagaugggacauacau

SEQ ID NO: 13248 - RNA, 19 nt, artificial
  Chemically synthesized
ugccuucuuuguacagaca

SEQ ID NO: 13249 - RNA, 19 nt, artificial
  Chemically synthesized
caaaguuagaaaaagcuga

SEQ ID NO: 13250 - RNA, 19 nt, artificial
  Chemically synthesized
ccucuccacaacuucagaa

SEQ ID NO: 13251 - RNA, 19 nt, artificial
  Chemically synthesized
gaccguaccauccagcagu

SEQ ID NO: 13252 - RNA, 19 nt, artificial
  Chemically synthesized
guggagaaagcaauaaaca

SEQ ID NO: 13253 - RNA, 19 nt, artificial
  Chemically synthesized
gucaaaaugacugcugaaa

SEQ ID NO: 13254 - RNA, 19 nt, artificial
  Chemically synthesized
ggugcggcuugugucucau

SEQ ID NO: 13255 - RNA, 19 nt, artificial
  Chemically synthesized
gacagauccacaaaggaac

SEQ ID NO: 13256 - RNA, 19 nt, artificial
  Chemically synthesized
cuaccauguguccaccaga

SEQ ID NO: 13257 - RNA, 19 nt, artificial
  Chemically synthesized
cagugcauugguauaagca

SEQ ID NO: 13258 - RNA, 19 nt, artificial
  Chemically synthesized
ugcacaagggaagacgagu

SEQ ID NO: 13259 - RNA, 19 nt, artificial
  Chemically synthesized
gaguauucugcugaaacca

SEQ ID NO: 13260 - RNA, 19 nt, artificial
  Chemically synthesized
agagcgacauggacgagac

SEQ ID NO: 13261 - RNA, 19 nt, artificial
  Chemically synthesized
cagaaguuggagcuuuuua

SEQ ID NO: 13262 - RNA, 19 nt, artificial
  Chemically synthesized
uggucaaaaugacugcuga

SEQ ID NO: 13263 - RNA, 19 nt, artificial
  Chemically synthesized
aguuuguaggaguuugguu

SEQ ID NO: 13264 - RNA, 19 nt, artificial
  Chemically synthesized
auuuagcagugcauuggua

SEQ ID NO: 13265 - RNA, 19 nt, artificial
  Chemically synthesized
ccacaaaggaacaauaaag

SEQ ID NO: 13266 - RNA, 19 nt, artificial
  Chemically synthesized
uuucuaugcaagagucuuu

SEQ ID NO: 13267 - RNA, 19 nt, artificial
  Chemically synthesized
gggauuauagagaaaaggc

SEQ ID NO: 13268 - RNA, 19 nt, artificial
  Chemically synthesized
aguauucugcugaaaccaa

SEQ ID NO: 13269 - RNA, 19 nt, artificial
  Chemically synthesized
cgaccuccgagagcgacau

SEQ ID NO: 13270 - RNA, 19 nt, artificial
  Chemically synthesized
acuucuugcaauaguaacu

SEQ ID NO: 13271 - RNA, 19 nt, artificial
  Chemically synthesized
caauaaagcuauuugagac

SEQ ID NO: 13272 - RNA, 19 nt, artificial
  Chemically synthesized
guaacugaauguccuccau

SEQ ID NO: 13273 - RNA, 19 nt, artificial
  Chemically synthesized
uccaccagaggcuauuuaa

SEQ ID NO: 13274 - RNA, 19 nt, artificial
  Chemically synthesized
uguaggaguuugguuuaau

SEQ ID NO: 13275 - RNA, 19 nt, artificial
  Chemically synthesized
cagauuaacaagcauuucu

SEQ ID NO: 13276 - RNA, 19 nt, artificial
  Chemically synthesized
gugucucaucucagcacuu

SEQ ID NO: 13277 - RNA, 19 nt, artificial
  Chemically synthesized
ccgacagauccacaaagga

SEQ ID NO: 13278 - RNA, 19 nt, artificial
  Chemically synthesized
ugauugcauuugaucccaa

SEQ ID NO: 13279 - RNA, 19 nt, artificial
  Chemically synthesized
ugcauugguauaagcaauu

SEQ ID NO: 13280 - RNA, 19 nt, artificial
  Chemically synthesized
caaguuagugauugcauuu

SEQ ID NO: 13281 - RNA, 19 nt, artificial
  Chemically synthesized
ugaauucucuugagacuag

SEQ ID NO: 13282 - RNA, 19 nt, artificial
  Chemically synthesized
auauagagagagagugaga

SEQ ID NO: 13283 - RNA, 19 nt, artificial
  Chemically synthesized
gcccugacugaauucucuu

SEQ ID NO: 13284 - RNA, 19 nt, artificial
  Chemically synthesized
acauauauagagagagagu

SEQ ID NO: 13285 - RNA, 19 nt, artificial
  Chemically synthesized
cugaauguccuccauuuca

SEQ ID NO: 13286 - RNA, 19 nt, artificial
  Chemically synthesized
cucuuaauaugcugaaauc

SEQ ID NO: 13287 - RNA, 19 nt, artificial
  Chemically synthesized
cucccuuuuuuguuugguu

SEQ ID NO: 13288 - RNA, 19 nt, artificial
  Chemically synthesized
cagacaugccaagagguga

SEQ ID NO: 13289 - RNA, 19 nt, artificial
  Chemically synthesized
cuauuugagacacaaaccu

SEQ ID NO: 13290 - RNA, 19 nt, artificial
  Chemically synthesized
cauuuagcagugcauuggu

SEQ ID NO: 13291 - RNA, 19 nt, artificial
  Chemically synthesized
agagagagagugagagagu

SEQ ID NO: 13292 - RNA, 19 nt, artificial
  Chemically synthesized
caauaggcugcagacauuu

SEQ ID NO: 13293 - RNA, 19 nt, artificial
  Chemically synthesized
uggagaaagcaauaaacau

SEQ ID NO: 13294 - RNA, 19 nt, artificial
  Chemically synthesized
ccuugucaguaucagccac

SEQ ID NO: 13295 - RNA, 19 nt, artificial
  Chemically synthesized
gaagcaaggagggagcacu

SEQ ID NO: 13296 - RNA, 19 nt, artificial
  Chemically synthesized
ccugagcuuaggaaguuuu

SEQ ID NO: 13297 - RNA, 19 nt, artificial
  Chemically synthesized
ggacgagaccaucgacgug

SEQ ID NO: 13298 - RNA, 19 nt, artificial
  Chemically synthesized
cacgaguggaaauguggua

SEQ ID NO: 13299 - RNA, 19 nt, artificial
  Chemically synthesized
gacuugugccaacugcuuu

SEQ ID NO: 13300 - RNA, 19 nt, artificial
  Chemically synthesized
cucuugccauggacuucau

SEQ ID NO: 13301 - RNA, 19 nt, artificial
  Chemically synthesized
ucuauucuugucacccuuu

SEQ ID NO: 13302 - RNA, 19 nt, artificial
  Chemically synthesized
gcaaaugacaguggaucau

SEQ ID NO: 13303 - RNA, 19 nt, artificial
  Chemically synthesized
ggaggugaugaagcaagga

SEQ ID NO: 13304 - RNA, 19 nt, artificial
  Chemically synthesized
ccucuucauuuucuccuaa

SEQ ID NO: 13305 - RNA, 19 nt, artificial
  Chemically synthesized
gacacaaaccucacgagug

SEQ ID NO: 13306 - RNA, 19 nt, artificial
  Chemically synthesized
cuccaguuuguaggaguuu

SEQ ID NO: 13307 - RNA, 19 nt, artificial
  Chemically synthesized
acagauccacaaaggaaca

SEQ ID NO: 13308 - RNA, 19 nt, artificial
  Chemically synthesized
gcgaggagacgaccuccga

SEQ ID NO: 13309 - RNA, 19 nt, artificial
  Chemically synthesized
gcaacuuuugaaaacuuca

SEQ ID NO: 13310 - RNA, 19 nt, artificial
  Chemically synthesized
gcugaaaucaagcacguga

SEQ ID NO: 13311 - RNA, 19 nt, artificial
  Chemically synthesized
guauuaugcacuucauuuc

SEQ ID NO: 13312 - RNA, 19 nt, artificial
  Chemically synthesized
cugaagguagccauacaga

SEQ ID NO: 13313 - RNA, 19 nt, artificial
  Chemically synthesized
gaauguaugcaaugggaug

SEQ ID NO: 13314 - RNA, 19 nt, artificial
  Chemically synthesized
cucaaaauauggugcugcu

SEQ ID NO: 13315 - RNA, 19 nt, artificial
  Chemically synthesized
guuuaucugaguugagaag

SEQ ID NO: 13316 - RNA, 19 nt, artificial
  Chemically synthesized
cuauuuaauucaugccaac

SEQ ID NO: 13317 - RNA, 19 nt, artificial
  Chemically synthesized
guuagugauugcauuugau

SEQ ID NO: 13318 - RNA, 19 nt, artificial
  Chemically synthesized
uggaggauagguuaagaaa

SEQ ID NO: 13319 - RNA, 19 nt, artificial
  Chemically synthesized
agauccacaaaggaacaau

SEQ ID NO: 13320 - RNA, 19 nt, artificial
  Chemically synthesized
guccaccagaggcuauuua

SEQ ID NO: 13321 - RNA, 19 nt, artificial
  Chemically synthesized
augggauguacauaaguua

SEQ ID NO: 13322 - RNA, 19 nt, artificial
  Chemically synthesized
ugaagguagccauacagau

SEQ ID NO: 13323 - RNA, 19 nt, artificial
  Chemically synthesized
cugugauuagauugaauuc

SEQ ID NO: 13324 - RNA, 19 nt, artificial
  Chemically synthesized
cagccacguccaguccuca

SEQ ID NO: 13325 - RNA, 19 nt, artificial
  Chemically synthesized
uguguggagaaagcaauaa

SEQ ID NO: 13326 - RNA, 19 nt, artificial
  Chemically synthesized
gggacagaaguuggagcuu

SEQ ID NO: 13327 - RNA, 19 nt, artificial
  Chemically synthesized
ugcggauucagcccuccga

SEQ ID NO: 13328 - RNA, 19 nt, artificial
  Chemically synthesized
accuaugagcaguugccua

SEQ ID NO: 13329 - RNA, 19 nt, artificial
  Chemically synthesized
ggauucagcccuccgaaug

SEQ ID NO: 13330 - RNA, 19 nt, artificial
  Chemically synthesized
cuuuuuuuucucucccuuu

SEQ ID NO: 13331 - RNA, 19 nt, artificial
  Chemically synthesized
accuagucuuuuuugcauu

SEQ ID NO: 13332 - RNA, 19 nt, artificial
  Chemically synthesized
gaaguuggagcuuuuuaaa

SEQ ID NO: 13333 - RNA, 19 nt, artificial
  Chemically synthesized
gcagugcaucaguaugucu

SEQ ID NO: 13334 - RNA, 19 nt, artificial
  Chemically synthesized
aguccucagcagaccagca

SEQ ID NO: 13335 - RNA, 19 nt, artificial
  Chemically synthesized
uuagcagugcauugguaua

SEQ ID NO: 13336 - RNA, 19 nt, artificial
  Chemically synthesized
auagagagagagugagaga

SEQ ID NO: 13337 - RNA, 19 nt, artificial
  Chemically synthesized
gcagacauuuuaauaccau

SEQ ID NO: 13338 - RNA, 19 nt, artificial
  Chemically synthesized
ugacugaauucucuugaga

SEQ ID NO: 13339 - RNA, 19 nt, artificial
  Chemically synthesized
ugcaauaggcugcagacau

SEQ ID NO: 13340 - RNA, 19 nt, artificial
  Chemically synthesized
caucaguaugucugaauug

SEQ ID NO: 13341 - RNA, 19 nt, artificial
  Chemically synthesized
guuaccauuuagaaguuuc

SEQ ID NO: 13342 - RNA, 19 nt, artificial
  Chemically synthesized
acauggacgagaccaucga

SEQ ID NO: 13343 - RNA, 19 nt, artificial
  Chemically synthesized
uuuguaggaguuugguuua

SEQ ID NO: 13344 - RNA, 19 nt, artificial
  Chemically synthesized
cucuugagacuagauggga

SEQ ID NO: 13345 - RNA, 19 nt, artificial
  Chemically synthesized
cagguuuuacuggucaaaa

SEQ ID NO: 13346 - RNA, 19 nt, artificial
  Chemically synthesized
cgagagugccuaacagaag

SEQ ID NO: 13347 - RNA, 19 nt, artificial
  Chemically synthesized
cuuuuucuaugcaagaguc

SEQ ID NO: 13348 - RNA, 19 nt, artificial
  Chemically synthesized
guaacugacaucagcaacu

SEQ ID NO: 13349 - RNA, 19 nt, artificial
  Chemically synthesized
agcauaggauuccgagagu

SEQ ID NO: 13350 - RNA, 19 nt, artificial
  Chemically synthesized
guaaaaugcccugacugaa

SEQ ID NO: 13351 - RNA, 19 nt, artificial
  Chemically synthesized
cagaguugcggcgugggaa

SEQ ID NO: 13352 - RNA, 19 nt, artificial
  Chemically synthesized
aguaaaaugcccugacuga

SEQ ID NO: 13353 - RNA, 19 nt, artificial
  Chemically synthesized
aagauaagagacacagcau

SEQ ID NO: 13354 - RNA, 19 nt, artificial
  Chemically synthesized
auccagcagugcaucagua

SEQ ID NO: 13355 - RNA, 19 nt, artificial
  Chemically synthesized
ugcaucaguaugucugaau

SEQ ID NO: 13356 - RNA, 19 nt, artificial
  Chemically synthesized
gcaagagucuuuacauacc

SEQ ID NO: 13357 - RNA, 19 nt, artificial
  Chemically synthesized
agcacuaggaagagaaaag

SEQ ID NO: 13358 - RNA, 19 nt, artificial
  Chemically synthesized
auucaugccaacuugaaaa

SEQ ID NO: 13359 - RNA, 19 nt, artificial
  Chemically synthesized
caguucucagauuaacaag

SEQ ID NO: 13360 - RNA, 19 nt, artificial
  Chemically synthesized
cagacauuuuaauaccaug

SEQ ID NO: 13361 - RNA, 19 nt, artificial
  Chemically synthesized
caugccaagaggugacauu

SEQ ID NO: 13362 - RNA, 19 nt, artificial
  Chemically synthesized
agagugccuaacagaaguu

SEQ ID NO: 13363 - RNA, 19 nt, artificial
  Chemically synthesized
gagacacaaaccucacgag

SEQ ID NO: 13364 - RNA, 19 nt, artificial
  Chemically synthesized
accagcaguggaacaaaca

SEQ ID NO: 13365 - RNA, 19 nt, artificial
  Chemically synthesized
cuaugcaagagucuuuaca

SEQ ID NO: 13366 - RNA, 19 nt, artificial
  Chemically synthesized
uugucacccuuugggagaa

SEQ ID NO: 13367 - RNA, 19 nt, artificial
  Chemically synthesized
aauucucuugagacuagau

SEQ ID NO: 13368 - RNA, 19 nt, artificial
  Chemically synthesized
ccaguuuguaggaguuugg

SEQ ID NO: 13369 - RNA, 19 nt, artificial
  Chemically synthesized
guuuuacuggucaaaauga

SEQ ID NO: 13370 - RNA, 19 nt, artificial
  Chemically synthesized
aucauuugaagaugcuuca

SEQ ID NO: 13371 - RNA, 19 nt, artificial
  Chemically synthesized
acagcuucccucuguccuu

SEQ ID NO: 13372 - RNA, 19 nt, artificial
  Chemically synthesized
ugaaaacucuccaguuugu

SEQ ID NO: 13373 - RNA, 19 nt, artificial
  Chemically synthesized
agauaagagacacagcaug

SEQ ID NO: 13374 - RNA, 19 nt, artificial
  Chemically synthesized
agggagcacuaggaagaga

SEQ ID NO: 13375 - RNA, 19 nt, artificial
  Chemically synthesized
gaagguagccauacagaug

SEQ ID NO: 13376 - RNA, 19 nt, artificial
  Chemically synthesized
aaaucaagcacgugagagu

SEQ ID NO: 13377 - RNA, 19 nt, artificial
  Chemically synthesized
gauuagauugaauucucca

SEQ ID NO: 13378 - RNA, 19 nt, artificial
  Chemically synthesized
gaggugacauuuagcagug

SEQ ID NO: 13379 - RNA, 19 nt, artificial
  Chemically synthesized
gaagaugcuucaggcaaca

SEQ ID NO: 13380 - RNA, 19 nt, artificial
  Chemically synthesized
ugcugaaaccaacagguuu

SEQ ID NO: 13381 - RNA, 19 nt, artificial
  Chemically synthesized
ugcagacauuuuaauacca

SEQ ID NO: 13382 - RNA, 19 nt, artificial
  Chemically synthesized
guggaggauagguuaagaa

SEQ ID NO: 13383 - RNA, 19 nt, artificial
  Chemically synthesized
gagugagagagucguguuu

SEQ ID NO: 13384 - RNA, 19 nt, artificial
  Chemically synthesized
aguguggaggauagguuaa

SEQ ID NO: 13385 - RNA, 19 nt, artificial
  Chemically synthesized
gcaaugggauguacauaag

SEQ ID NO: 13386 - RNA, 19 nt, artificial
  Chemically synthesized
agacuugugccaacugcuu

SEQ ID NO: 13387 - RNA, 19 nt, artificial
  Chemically synthesized
augacaguggaucauuuga

SEQ ID NO: 13388 - RNA, 19 nt, artificial
  Chemically synthesized
gcaagaaagaaaaggagag

SEQ ID NO: 13389 - RNA, 19 nt, artificial
  Chemically synthesized
gggcaaaguacuagcucug

SEQ ID NO: 13390 - RNA, 19 nt, artificial
  Chemically synthesized
gguaaaggcuacuuugacg

SEQ ID NO: 13391 - RNA, 19 nt, artificial
  Chemically synthesized
caaaccucacgaguggaaa

SEQ ID NO: 13392 - RNA, 19 nt, artificial
  Chemically synthesized
agcgacauggacgagacca

SEQ ID NO: 13393 - RNA, 19 nt, artificial
  Chemically synthesized
cauuuauauagugcaccua

SEQ ID NO: 13394 - RNA, 19 nt, artificial
  Chemically synthesized
cuucacacuuguuaccauu

SEQ ID NO: 13395 - RNA, 19 nt, artificial
  Chemically synthesized
cagcagugcaucaguaugu

SEQ ID NO: 13396 - RNA, 19 nt, artificial
  Chemically synthesized
caucaguucucagauuaac

SEQ ID NO: 13397 - RNA, 19 nt, artificial
  Chemically synthesized
gaaagagccgcuaggagca

SEQ ID NO: 13398 - RNA, 19 nt, artificial
  Chemically synthesized
gagcaguugccuaccaugu

SEQ ID NO: 13399 - RNA, 19 nt, artificial
  Chemically synthesized
ccacguccaguccucagca

SEQ ID NO: 13400 - RNA, 19 nt, artificial
  Chemically synthesized
acaucucagauuauggcaa

SEQ ID NO: 13401 - RNA, 19 nt, artificial
  Chemically synthesized
uucuaugcaagagucuuua

SEQ ID NO: 13402 - RNA, 19 nt, artificial
  Chemically synthesized
auggugcugcuuuauauaa

SEQ ID NO: 13403 - RNA, 19 nt, artificial
  Chemically synthesized
uucuugaacuucuugcaau

SEQ ID NO: 13404 - RNA, 19 nt, artificial
  Chemically synthesized
cggucuucgccgggaugaa

SEQ ID NO: 13405 - RNA, 19 nt, artificial
  Chemically synthesized
cccaaacgcagcagcagca

SEQ ID NO: 13406 - RNA, 19 nt, artificial
  Chemically synthesized
ucaaaaugacugcugaaaa

SEQ ID NO: 13407 - RNA, 19 nt, artificial
  Chemically synthesized
gaaguugcgcgguaccuga

SEQ ID NO: 13408 - RNA, 19 nt, artificial
  Chemically synthesized
auugcaaaugacaguggau

SEQ ID NO: 13409 - RNA, 19 nt, artificial
  Chemically synthesized
aagcaaggagggagcacua

SEQ ID NO: 13410 - RNA, 19 nt, artificial
  Chemically synthesized
auuacuguaccuagucuuu

SEQ ID NO: 13411 - RNA, 19 nt, artificial
  Chemically synthesized
gauugaauucuccaacaac

SEQ ID NO: 13412 - RNA, 19 nt, artificial
  Chemically synthesized
acuugaaaacucuccaguu

SEQ ID NO: 13413 - RNA, 19 nt, artificial
  Chemically synthesized
agagucuuuacauaccacu

SEQ ID NO: 13414 - RNA, 19 nt, artificial
  Chemically synthesized
ggguaaaggcuacuuugac

SEQ ID NO: 13415 - RNA, 19 nt, artificial
  Chemically synthesized
aggaagagaaaagcuacaa

SEQ ID NO: 13416 - RNA, 19 nt, artificial
  Chemically synthesized
ucuugcaauaguaacugaa

SEQ ID NO: 13417 - RNA, 19 nt, artificial
  Chemically synthesized
cacuucauuucucuacugu

SEQ ID NO: 13418 - RNA, 19 nt, artificial
  Chemically synthesized
uugaauucuccaacaacaa

SEQ ID NO: 13419 - RNA, 19 nt, artificial
  Chemically synthesized
gcgggugcggcuugugucu

SEQ ID NO: 13420 - RNA, 19 nt, artificial
  Chemically synthesized
ggcucaaaauauggugcug

SEQ ID NO: 13421 - RNA, 19 nt, artificial
  Chemically synthesized
cuacuguguggagaaagca

SEQ ID NO: 13422 - RNA, 19 nt, artificial
  Chemically synthesized
caucagcaacuuuugaaaa

SEQ ID NO: 13423 - RNA, 19 nt, artificial
  Chemically synthesized
cuugucacccuuugggaga

SEQ ID NO: 13424 - RNA, 19 nt, artificial
  Chemically synthesized
gugauugcauuugauccca

SEQ ID NO: 13425 - RNA, 19 nt, artificial
  Chemically synthesized
gagacgaccuccgagagcg

SEQ ID NO: 13426 - RNA, 19 nt, artificial
  Chemically synthesized
gcucuugccauggacuuca

SEQ ID NO: 13427 - RNA, 19 nt, artificial
  Chemically synthesized
aucaagcacgugagaguuu

SEQ ID NO: 13428 - RNA, 19 nt, artificial
  Chemically synthesized
uaucugaguugagaagacu

SEQ ID NO: 13429 - RNA, 19 nt, artificial
  Chemically synthesized
aaaaacaaggaucugcaaa

SEQ ID NO: 13430 - RNA, 19 nt, artificial
  Chemically synthesized
cuuaguuugccuucuuugu

SEQ ID NO: 13431 - RNA, 19 nt, artificial
  Chemically synthesized
uggacgagaccaucgacgu

SEQ ID NO: 13432 - RNA, 19 nt, artificial
  Chemically synthesized
cagcaacuuuugaaaacuu

SEQ ID NO: 13433 - RNA, 19 nt, artificial
  Chemically synthesized
aucccaaaacaagaugaau

SEQ ID NO: 13434 - RNA, 19 nt, artificial
  Chemically synthesized
ugagcauaggauuccgaga

SEQ ID NO: 13435 - RNA, 19 nt, artificial
  Chemically synthesized
cguccaguccucagcagac

SEQ ID NO: 13436 - RNA, 19 nt, artificial
  Chemically synthesized
ugaucccaaaacaagauga

SEQ ID NO: 13437 - RNA, 19 nt, artificial
  Chemically synthesized
acaguggaucauuugaaga

SEQ ID NO: 13438 - RNA, 19 nt, artificial
  Chemically synthesized
auaagagacacagcaugua

SEQ ID NO: 13439 - RNA, 19 nt, artificial
  Chemically synthesized
acuaggaagagaaaagcua

SEQ ID NO: 13440 - RNA, 19 nt, artificial
  Chemically synthesized
ugggauguacauaaguuau

SEQ ID NO: 13441 - RNA, 19 nt, artificial
  Chemically synthesized
caacaucuauucuugucac

SEQ ID NO: 13442 - RNA, 19 nt, artificial
  Chemically synthesized
aggauagguuaagaaagga

SEQ ID NO: 13443 - RNA, 19 nt, artificial
  Chemically synthesized
gaaaauauauggaccguac

SEQ ID NO: 13444 - RNA, 19 nt, artificial
  Chemically synthesized
ucucagauuaacaagcauu

SEQ ID NO: 13445 - RNA, 19 nt, artificial
  Chemically synthesized
gagcgagaacaauuacucg

SEQ ID NO: 13446 - RNA, 19 nt, artificial
  Chemically synthesized
caaggagggagcacuagga

SEQ ID NO: 13447 - RNA, 19 nt, artificial
  Chemically synthesized
cuuugucaaguuagugauu

SEQ ID NO: 13448 - RNA, 19 nt, artificial
  Chemically synthesized
ugaguugagaagacuugug

SEQ ID NO: 13449 - RNA, 19 nt, artificial
  Chemically synthesized
cucuucauuuucuccuaau

SEQ ID NO: 13450 - RNA, 19 nt, artificial
  Chemically synthesized
gcacacagcuucccucugu

SEQ ID NO: 13451 - RNA, 19 nt, artificial
  Chemically synthesized
cuaggaagagaaaagcuac

SEQ ID NO: 13452 - RNA, 19 nt, artificial
  Chemically synthesized
ccaccucucucuugucccu

SEQ ID NO: 13453 - RNA, 19 nt, artificial
  Chemically synthesized
uaugcaagagucuuuacau

SEQ ID NO: 13454 - RNA, 19 nt, artificial
  Chemically synthesized
uaggcugcagacauuuuaa

SEQ ID NO: 13455 - RNA, 19 nt, artificial
  Chemically synthesized
augccaagaggugacauuu

SEQ ID NO: 13456 - RNA, 19 nt, artificial
  Chemically synthesized
gacauacauauauagagag

SEQ ID NO: 13457 - RNA, 19 nt, artificial
  Chemically synthesized
ugcaauaguaacugaaugu

SEQ ID NO: 13458 - RNA, 19 nt, artificial
  Chemically synthesized
guaucagccacguccaguc

SEQ ID NO: 13459 - RNA, 19 nt, artificial
  Chemically synthesized
cgaguguggaggauagguu

SEQ ID NO: 13460 - RNA, 19 nt, artificial
  Chemically synthesized
cacguuugcccaugcggau

SEQ ID NO: 13461 - RNA, 19 nt, artificial
  Chemically synthesized
ggauggcucaaaauauggu

SEQ ID NO: 13462 - RNA, 19 nt, artificial
  Chemically synthesized
gaugccgacagauccacaa

SEQ ID NO: 13463 - RNA, 19 nt, artificial
  Chemically synthesized
gagagagagugagagaguc

SEQ ID NO: 13464 - RNA, 19 nt, artificial
  Chemically synthesized
uuguaggaguuugguuuaa

SEQ ID NO: 13465 - RNA, 19 nt, artificial
  Chemically synthesized
aagggaagacgagugugga

SEQ ID NO: 13466 - RNA, 19 nt, artificial
  Chemically synthesized
ugggagaaguuacauuucu

SEQ ID NO: 13467 - RNA, 19 nt, artificial
  Chemically synthesized
gacaucagcaacuuuugaa

SEQ ID NO: 13468 - RNA, 19 nt, artificial
  Chemically synthesized
gucacccuuugggagaagu

SEQ ID NO: 13469 - RNA, 19 nt, artificial
  Chemically synthesized
aaaccucacgaguggaaau

SEQ ID NO: 13470 - RNA, 19 nt, artificial
  Chemically synthesized
gagcuuaggaaguuuucuu

SEQ ID NO: 13471 - RNA, 19 nt, artificial
  Chemically synthesized
aguggaacaaacaauaaac

SEQ ID NO: 13472 - RNA, 19 nt, artificial
  Chemically synthesized
auuucaucaguucucagau

SEQ ID NO: 13473 - RNA, 19 nt, artificial
  Chemically synthesized
ugaaaaacaaggaucugca

SEQ ID NO: 13474 - RNA, 19 nt, artificial
  Chemically synthesized
cguaccauccagcagugca

SEQ ID NO: 13475 - RNA, 19 nt, artificial
  Chemically synthesized
uuacauuucuggaggugau

SEQ ID NO: 13476 - RNA, 19 nt, artificial
  Chemically synthesized
ugccaacugcuuuugaaaa

SEQ ID NO: 13477 - RNA, 19 nt, artificial
  Chemically synthesized
ccuccauggcccaccacca

SEQ ID NO: 13478 - RNA, 19 nt, artificial
  Chemically synthesized
gcagugcauugguauaagc

SEQ ID NO: 13479 - RNA, 19 nt, artificial
  Chemically synthesized
ccucugcacccugaaggua

SEQ ID NO: 13480 - RNA, 19 nt, artificial
  Chemically synthesized
uccucagcagaccagcagu

SEQ ID NO: 13481 - RNA, 19 nt, artificial
  Chemically synthesized
uaugcacuucauuucucua

SEQ ID NO: 13482 - RNA, 19 nt, artificial
  Chemically synthesized
uauggugcugcuuuauaua

SEQ ID NO: 13483 - RNA, 19 nt, artificial
  Chemically synthesized
agacacaaaccucacgagu

SEQ ID NO: 13484 - RNA, 19 nt, artificial
  Chemically synthesized
uccauuucagagucagcuu

SEQ ID NO: 13485 - RNA, 19 nt, artificial
  Chemically synthesized
cgacauggacgagaccauc

SEQ ID NO: 13486 - RNA, 19 nt, artificial
  Chemically synthesized
cuccaacaacaacaucuca

SEQ ID NO: 13487 - RNA, 19 nt, artificial
  Chemically synthesized
gaucauuugaagaugcuuc

SEQ ID NO: 13488 - RNA, 19 nt, artificial
  Chemically synthesized
augaauguaugcaauggga

SEQ ID NO: 13489 - RNA, 19 nt, artificial
  Chemically synthesized
guggaaaugugguauucuc

SEQ ID NO: 13490 - RNA, 19 nt, artificial
  Chemically synthesized
gagaaguuacauuucugga

SEQ ID NO: 13491 - RNA, 19 nt, artificial
  Chemically synthesized
ggaacaauaaagcuauuug

SEQ ID NO: 13492 - RNA, 19 nt, artificial
  Chemically synthesized
cacaagggaagacgagugu

SEQ ID NO: 13493 - RNA, 19 nt, artificial
  Chemically synthesized
ugaaauuacuguaccuagu

SEQ ID NO: 13494 - RNA, 19 nt, artificial
  Chemically synthesized
cucuacuguguggagaaag

SEQ ID NO: 13495 - RNA, 19 nt, artificial
  Chemically synthesized
uccaguuuguaggaguuug

SEQ ID NO: 13496 - RNA, 19 nt, artificial
  Chemically synthesized
acguccaguccucagcaga

SEQ ID NO: 13497 - RNA, 19 nt, artificial
  Chemically synthesized
cagccaccgcggcugcaca

SEQ ID NO: 13498 - RNA, 19 nt, artificial
  Chemically synthesized
guaccuagucuuuuuugca

SEQ ID NO: 13499 - RNA, 19 nt, artificial
  Chemically synthesized
ggcuugugucucaucucag

SEQ ID NO: 13500 - RNA, 19 nt, artificial
  Chemically synthesized
cacaaaccucacgagugga

SEQ ID NO: 13501 - RNA, 19 nt, artificial
  Chemically synthesized
aacugacaucagcaacuuu

SEQ ID NO: 13502 - RNA, 19 nt, artificial
  Chemically synthesized
uugagaagacuugugccaa

SEQ ID NO: 13503 - RNA, 19 nt, artificial
  Chemically synthesized
acgaccuccgagagcgaca

SEQ ID NO: 13504 - RNA, 19 nt, artificial
  Chemically synthesized
gaaguaaaaugcccugacu

SEQ ID NO: 13505 - RNA, 19 nt, artificial
  Chemically synthesized
agacacagcauguauuaug

SEQ ID NO: 13506 - RNA, 19 nt, artificial
  Chemically synthesized
ugugccaacugcuuuugaa

SEQ ID NO: 13507 - RNA, 19 nt, artificial
  Chemically synthesized
agcacgugagaguuuuugu

SEQ ID NO: 13508 - RNA, 19 nt, artificial
  Chemically synthesized
gccgacagauccacaaagg

SEQ ID NO: 13509 - RNA, 19 nt, artificial
  Chemically synthesized
uccgagagugccuaacaga

SEQ ID NO: 13510 - RNA, 19 nt, artificial
  Chemically synthesized
aauucaugccaacuugaaa

SEQ ID NO: 13511 - RNA, 19 nt, artificial
  Chemically synthesized
ccaugcggauucagcccuc

SEQ ID NO: 13512 - RNA, 19 nt, artificial
  Chemically synthesized
gguuuuacuggucaaaaug

SEQ ID NO: 13513 - RNA, 19 nt, artificial
  Chemically synthesized
aaccuuuuucuaugcaaga

SEQ ID NO: 13514 - RNA, 19 nt, artificial
  Chemically synthesized
augcaaugggauguacaua

SEQ ID NO: 13515 - RNA, 19 nt, artificial
  Chemically synthesized
gguaccugagcuccgugga

SEQ ID NO: 13516 - RNA, 19 nt, artificial
  Chemically synthesized
ucagcagaccagcagugga

SEQ ID NO: 13517 - RNA, 19 nt, artificial
  Chemically synthesized
ggccuggacuccucggauc

SEQ ID NO: 13518 - RNA, 19 nt, artificial
  Chemically synthesized
acaucagcaacuuuugaaa

SEQ ID NO: 13519 - RNA, 19 nt, artificial
  Chemically synthesized
cugaaauauugcaaaugac

SEQ ID NO: 13520 - RNA, 19 nt, artificial
  Chemically synthesized
cacacuuguuaccauuuag

SEQ ID NO: 13521 - RNA, 19 nt, artificial
  Chemically synthesized
ucaagcacgugagaguuuu

SEQ ID NO: 13522 - RNA, 19 nt, artificial
  Chemically synthesized
guuugcccaugcggauuca

SEQ ID NO: 13523 - RNA, 19 nt, artificial
  Chemically synthesized
uccaguccucagcagacca

SEQ ID NO: 13524 - RNA, 19 nt, artificial
  Chemically synthesized
uuugggagaaguuacauuu

SEQ ID NO: 13525 - RNA, 19 nt, artificial
  Chemically synthesized
agaaaggaaagggacagaa

SEQ ID NO: 13526 - RNA, 19 nt, artificial
  Chemically synthesized
cauccagcagugcaucagu

SEQ ID NO: 13527 - RNA, 19 nt, artificial
  Chemically synthesized
caaggaucugcaaaguuag

SEQ ID NO: 13528 - RNA, 19 nt, artificial
  Chemically synthesized
ucaguuucauuaggacuau

SEQ ID NO: 13529 - RNA, 19 nt, artificial
  Chemically synthesized
ucgccucuccacaacuuca

SEQ ID NO: 13530 - RNA, 19 nt, artificial
  Chemically synthesized
cuuugacgcacacgcucuu

SEQ ID NO: 13531 - RNA, 19 nt, artificial
  Chemically synthesized
aaagcucuuugucaaguua

SEQ ID NO: 13532 - RNA, 19 nt, artificial
  Chemically synthesized
auggcaagaaagaaaagga

SEQ ID NO: 13533 - RNA, 19 nt, artificial
  Chemically synthesized
ggcaaaguacuagcucugu

SEQ ID NO: 13534 - RNA, 19 nt, artificial
  Chemically synthesized
ucugaguugagaagacuug

SEQ ID NO: 13535 - RNA, 19 nt, artificial
  Chemically synthesized
agcagugcauugguauaag

SEQ ID NO: 13536 - RNA, 19 nt, artificial
  Chemically synthesized
aggcugcagacauuuuaau

SEQ ID NO: 13537 - RNA, 19 nt, artificial
  Chemically synthesized
aaggcagcucgguaacuga

SEQ ID NO: 13538 - RNA, 19 nt, artificial
  Chemically synthesized
agauuaacaagcauuucug

SEQ ID NO: 13539 - RNA, 19 nt, artificial
  Chemically synthesized
guguccaccagaggcuauu

SEQ ID NO: 13540 - RNA, 19 nt, artificial
  Chemically synthesized
uuaaacaaaaacucucacg

SEQ ID NO: 13541 - RNA, 19 nt, artificial
  Chemically synthesized
uuucucuuccuagugcucc

SEQ ID NO: 13542 - RNA, 19 nt, artificial
  Chemically synthesized
aauucagacauacugaugc

SEQ ID NO: 13543 - RNA, 19 nt, artificial
  Chemically synthesized
uucucaacucagauaaacu

SEQ ID NO: 13544 - RNA, 19 nt, artificial
  Chemically synthesized
uucucuuccuagugcuccc

SEQ ID NO: 13545 - RNA, 19 nt, artificial
  Chemically synthesized
auugcuuauaccaaugcac

SEQ ID NO: 13546 - RNA, 19 nt, artificial
  Chemically synthesized
aaaaacaaaaccacaaccc

SEQ ID NO: 13547 - RNA, 19 nt, artificial
  Chemically synthesized
uguauggcuaccuucaggg

SEQ ID NO: 13548 - RNA, 19 nt, artificial
  Chemically synthesized
uucagcagaauacucuucu

SEQ ID NO: 13549 - RNA, 19 nt, artificial
  Chemically synthesized
aaagguuacaaaguaaugc

SEQ ID NO: 13550 - RNA, 19 nt, artificial
  Chemically synthesized
auauuuuccaggaaacuuc

SEQ ID NO: 13551 - RNA, 19 nt, artificial
  Chemically synthesized
uauuguuuguuccacugcu

SEQ ID NO: 13552 - RNA, 19 nt, artificial
  Chemically synthesized
aauguuuauugcuuucucc

SEQ ID NO: 13553 - RNA, 19 nt, artificial
  Chemically synthesized
uuggcaugaauuaaauagc

SEQ ID NO: 13554 - RNA, 19 nt, artificial
  Chemically synthesized
uagugguauguaaagacuc

SEQ ID NO: 13555 - RNA, 19 nt, artificial
  Chemically synthesized
uaaacaaaaacucucacgu

SEQ ID NO: 13556 - RNA, 19 nt, artificial
  Chemically synthesized
auuagugguauguaaagac

SEQ ID NO: 13557 - RNA, 19 nt, artificial
  Chemically synthesized
uucuguuaggcacucucgg

SEQ ID NO: 13558 - RNA, 19 nt, artificial
  Chemically synthesized
uucggagggcugaauccgc

SEQ ID NO: 13559 - RNA, 19 nt, artificial
  Chemically synthesized
aauuaaaccaaacuccuac

SEQ ID NO: 13560 - RNA, 19 nt, artificial
  Chemically synthesized
uaaucugagauguuguugu

SEQ ID NO: 13561 - RNA, 19 nt, artificial
  Chemically synthesized
uauugcuuucuccacacag

SEQ ID NO: 13562 - RNA, 19 nt, artificial
  Chemically synthesized
uuguuuugggaucaaaugc

SEQ ID NO: 13563 - RNA, 19 nt, artificial
  Chemically synthesized
uuuguuccacugcuggucu

SEQ ID NO: 13564 - RNA, 19 nt, artificial
  Chemically synthesized
uucagcagucauuuugacc

SEQ ID NO: 13565 - RNA, 19 nt, artificial
  Chemically synthesized
ugugcaauguuauauaucc

SEQ ID NO: 13566 - RNA, 19 nt, artificial
  Chemically synthesized
auggucucguccaugucgc

SEQ ID NO: 13567 - RNA, 19 nt, artificial
  Chemically synthesized
aaagcuccaacuucugucc

SEQ ID NO: 13568 - RNA, 19 nt, artificial
  Chemically synthesized
uuucuugccauaaucugag

SEQ ID NO: 13569 - RNA, 19 nt, artificial
  Chemically synthesized
ugcacugcuaaaugucacc

SEQ ID NO: 13570 - RNA, 19 nt, artificial
  Chemically synthesized
uaagcugacucugaaaugg

SEQ ID NO: 13571 - RNA, 19 nt, artificial
  Chemically synthesized
auugcaagacuucuguccc

SEQ ID NO: 13572 - RNA, 19 nt, artificial
  Chemically synthesized
uuugggaucaaaugcaauc

SEQ ID NO: 13573 - RNA, 19 nt, artificial
  Chemically synthesized
uagucucaagagaauucag

SEQ ID NO: 13574 - RNA, 19 nt, artificial
  Chemically synthesized
ucuccuuuucuuucuugcc

SEQ ID NO: 13575 - RNA, 19 nt, artificial
  Chemically synthesized
uuguuuguuccacugcugg

SEQ ID NO: 13576 - RNA, 19 nt, artificial
  Chemically synthesized
uuugugucucaaauagcuu

SEQ ID NO: 13577 - RNA, 19 nt, artificial
  Chemically synthesized
uauuaaaaugucugcagcc

SEQ ID NO: 13578 - RNA, 19 nt, artificial
  Chemically synthesized
uagauguugcaucauuagg

SEQ ID NO: 13579 - RNA, 19 nt, artificial
  Chemically synthesized
uuuccuuucuuaaccuauc

SEQ ID NO: 13580 - RNA, 19 nt, artificial
  Chemically synthesized
aguaauuguucucgcuccc

SEQ ID NO: 13581 - RNA, 19 nt, artificial
  Chemically synthesized
aaaccaaacuccuacaaac

SEQ ID NO: 13582 - RNA, 19 nt, artificial
  Chemically synthesized
auauccagaagaaaacuuc

SEQ ID NO: 13583 - RNA, 19 nt, artificial
  Chemically synthesized
uuccuuucuuaaccuaucc

SEQ ID NO: 13584 - RNA, 19 nt, artificial
  Chemically synthesized
aaaaaacaaaaccacaacc

SEQ ID NO: 13585 - RNA, 19 nt, artificial
  Chemically synthesized
uuaagcugacucugaaaug

SEQ ID NO: 13586 - RNA, 19 nt, artificial
  Chemically synthesized
auuguuuguuccacugcug

SEQ ID NO: 13587 - RNA, 19 nt, artificial
  Chemically synthesized
uauuuuccaggaaacuucu

SEQ ID NO: 13588 - RNA, 19 nt, artificial
  Chemically synthesized
uaccgagcugccuugaacc

SEQ ID NO: 13589 - RNA, 19 nt, artificial
  Chemically synthesized
caugucuguacaaagaagg

SEQ ID NO: 13590 - RNA, 19 nt, artificial
  Chemically synthesized
uuggcaugucuguacaaag

SEQ ID NO: 13591 - RNA, 19 nt, artificial
  Chemically synthesized
uuaaaaagcuccaacuucu

SEQ ID NO: 13592 - RNA, 19 nt, artificial
  Chemically synthesized
uaauugcuuauaccaaugc

SEQ ID NO: 13593 - RNA, 19 nt, artificial
  Chemically synthesized
auugcauacauucaucuug

SEQ ID NO: 13594 - RNA, 19 nt, artificial
  Chemically synthesized
uauccagaagaaaacuucc

SEQ ID NO: 13595 - RNA, 19 nt, artificial
  Chemically synthesized
aaacuuccuaagcucaggc

SEQ ID NO: 13596 - RNA, 19 nt, artificial
  Chemically synthesized
uuaaucugagaacugauga

SEQ ID NO: 13597 - RNA, 19 nt, artificial
  Chemically synthesized
uauggcuaccuucagggug

SEQ ID NO: 13598 - RNA, 19 nt, artificial
  Chemically synthesized
aagucuucucaacucagau

SEQ ID NO: 13599 - RNA, 19 nt, artificial
  Chemically synthesized
uaaugcaaaaaagacuagg

SEQ ID NO: 13600 - RNA, 19 nt, artificial
  Chemically synthesized
uugcuuauaccaaugcacu

SEQ ID NO: 13601 - RNA, 19 nt, artificial
  Chemically synthesized
uuuuucaaaagcaguuggc

SEQ ID NO: 13602 - RNA, 19 nt, artificial
  Chemically synthesized
uuuucucuauaaucccucu

SEQ ID NO: 13603 - RNA, 19 nt, artificial
  Chemically synthesized
ugaagugcauaauacaugc

SEQ ID NO: 13604 - RNA, 19 nt, artificial
  Chemically synthesized
augaagugcauaauacaug

SEQ ID NO: 13605 - RNA, 19 nt, artificial
  Chemically synthesized
uuagugguauguaaagacu

SEQ ID NO: 13606 - RNA, 19 nt, artificial
  Chemically synthesized
ucuagucucaagagaauuc

SEQ ID NO: 13607 - RNA, 19 nt, artificial
  Chemically synthesized
uuuauugcuuucuccacac

SEQ ID NO: 13608 - RNA, 19 nt, artificial
  Chemically synthesized
acaagucuucucaacucag

SEQ ID NO: 13609 - RNA, 19 nt, artificial
  Chemically synthesized
auucaaucuaaucacagag

SEQ ID NO: 13610 - RNA, 19 nt, artificial
  Chemically synthesized
aauuguagcuuuucucuuc

SEQ ID NO: 13611 - RNA, 19 nt, artificial
  Chemically synthesized
caagaauagauguugcauc

SEQ ID NO: 13612 - RNA, 19 nt, artificial
  Chemically synthesized
aaaugcuuguuaaucugag

SEQ ID NO: 13613 - RNA, 19 nt, artificial
  Chemically synthesized
augcacugcuaaaugucac

SEQ ID NO: 13614 - RNA, 19 nt, artificial
  Chemically synthesized
uauguaaagacucuugcau

SEQ ID NO: 13615 - RNA, 19 nt, artificial
  Chemically synthesized
uugcauagaaaaagguuac

SEQ ID NO: 13616 - RNA, 19 nt, artificial
  Chemically synthesized
uugacucugaggcauggag

SEQ ID NO: 13617 - RNA, 19 nt, artificial
  Chemically synthesized
uguuuugggaucaaaugca

SEQ ID NO: 13618 - RNA, 19 nt, artificial
  Chemically synthesized
acacaguagagaaaugaag

SEQ ID NO: 13619 - RNA, 19 nt, artificial
  Chemically synthesized
auuuugaccaguaaaaccu

SEQ ID NO: 13620 - RNA, 19 nt, artificial
  Chemically synthesized
ugucccaucuagucucaag

SEQ ID NO: 13621 - RNA, 19 nt, artificial
  Chemically synthesized
acgccuuuucucuauaauc

SEQ ID NO: 13622 - RNA, 19 nt, artificial
  Chemically synthesized
cuuuucucuauaaucccuc

SEQ ID NO: 13623 - RNA, 19 nt, artificial
  Chemically synthesized
auucggagggcugaauccg

SEQ ID NO: 13624 - RNA, 19 nt, artificial
  Chemically synthesized
auuguagcuuuucucuucc

SEQ ID NO: 13625 - RNA, 19 nt, artificial
  Chemically synthesized
aaaugauccacugucauuu

SEQ ID NO: 13626 - RNA, 19 nt, artificial
  Chemically synthesized
aaauggaggacauucaguu

SEQ ID NO: 13627 - RNA, 19 nt, artificial
  Chemically synthesized
uacgguccauauauuuucc

SEQ ID NO: 13628 - RNA, 19 nt, artificial
  Chemically synthesized
aauaacuuauguacauccc

SEQ ID NO: 13629 - RNA, 19 nt, artificial
  Chemically synthesized
uggcaugaauuaaauagcc

SEQ ID NO: 13630 - RNA, 19 nt, artificial
  Chemically synthesized
uuuucucuuccuagugcuc

SEQ ID NO: 13631 - RNA, 19 nt, artificial
  Chemically synthesized
uguaacuucucccaaaggg

SEQ ID NO: 13632 - RNA, 19 nt, artificial
  Chemically synthesized
auuaaauagccucuggugg

SEQ ID NO: 13633 - RNA, 19 nt, artificial
  Chemically synthesized
uugugucucaaauagcuuu

SEQ ID NO: 13634 - RNA, 19 nt, artificial
  Chemically synthesized
aagcaucuucaaaugaucc

SEQ ID NO: 13635 - RNA, 19 nt, artificial
  Chemically synthesized
auucaguuacuauugcaag

SEQ ID NO: 13636 - RNA, 19 nt, artificial
  Chemically synthesized
ucagcagaauacucuucuc

SEQ ID NO: 13637 - RNA, 19 nt, artificial
  Chemically synthesized
ucagacauacugaugcacu

SEQ ID NO: 13638 - RNA, 19 nt, artificial
  Chemically synthesized
uguaugucccaucuagucu

SEQ ID NO: 13639 - RNA, 19 nt, artificial
  Chemically synthesized
aagguuuauauaaagcagc

SEQ ID NO: 13640 - RNA, 19 nt, artificial
  Chemically synthesized
uaacuucucccaaagggug

SEQ ID NO: 13641 - RNA, 19 nt, artificial
  Chemically synthesized
uuauguacaucccauugca

SEQ ID NO: 13642 - RNA, 19 nt, artificial
  Chemically synthesized
acauucaucuuguuuuggg

SEQ ID NO: 13643 - RNA, 19 nt, artificial
  Chemically synthesized
uccuccacacucgucuucc

SEQ ID NO: 13644 - RNA, 19 nt, artificial
  Chemically synthesized
auuuucagcagucauuuug

SEQ ID NO: 13645 - RNA, 19 nt, artificial
  Chemically synthesized
uucccuugugcaauguuau

SEQ ID NO: 13646 - RNA, 19 nt, artificial
  Chemically synthesized
uugaaccaaacaaaaaagg

SEQ ID NO: 13647 - RNA, 19 nt, artificial
  Chemically synthesized
uucagacauacugaugcac

SEQ ID NO: 13648 - RNA, 19 nt, artificial
  Chemically synthesized
aucccgacgccuuuucucu

SEQ ID NO: 13649 - RNA, 19 nt, artificial
  Chemically synthesized
aagggugacaagaauagau

SEQ ID NO: 13650 - RNA, 19 nt, artificial
  Chemically synthesized
aaacuggagaguuuucaag

SEQ ID NO: 13651 - RNA, 19 nt, artificial
  Chemically synthesized
aaucuaaucacagagcuag

SEQ ID NO: 13652 - RNA, 19 nt, artificial
  Chemically synthesized
auaauacaugcugugucuc

SEQ ID NO: 13653 - RNA, 19 nt, artificial
  Chemically synthesized
cgccuuuucucuauaaucc

SEQ ID NO: 13654 - RNA, 19 nt, artificial
  Chemically synthesized
uucuccacacaguagagaa

SEQ ID NO: 13655 - RNA, 19 nt, artificial
  Chemically synthesized
uguuguuggagaauucaau

SEQ ID NO: 13656 - RNA, 19 nt, artificial
  Chemically synthesized
uaaaugucaccucuuggca

SEQ ID NO: 13657 - RNA, 19 nt, artificial
  Chemically synthesized
aagguuacaaaguaaugca

SEQ ID NO: 13658 - RNA, 19 nt, artificial
  Chemically synthesized
cagaaauguaacuucuccc

SEQ ID NO: 13659 - RNA, 19 nt, artificial
  Chemically synthesized
uugcauacauucaucuugu

SEQ ID NO: 13660 - RNA, 19 nt, artificial
  Chemically synthesized
uuuuccaggaaacuucuaa

SEQ ID NO: 13661 - RNA, 19 nt, artificial
  Chemically synthesized
uucuuucuugccauaaucu

SEQ ID NO: 13662 - RNA, 19 nt, artificial
  Chemically synthesized
aaaaacucucacgugcuug

SEQ ID NO: 13663 - RNA, 19 nt, artificial
  Chemically synthesized
uugcagauccuuguuuuuc

SEQ ID NO: 13664 - RNA, 19 nt, artificial
  Chemically synthesized
ucgcucucggaggucgucu

SEQ ID NO: 13665 - RNA, 19 nt, artificial
  Chemically synthesized
agucucaagagaauucagu

SEQ ID NO: 13666 - RNA, 19 nt, artificial
  Chemically synthesized
uucaucuuguuuugggauc

SEQ ID NO: 13667 - RNA, 19 nt, artificial
  Chemically synthesized
ugguauguaaagacucuug

SEQ ID NO: 13668 - RNA, 19 nt, artificial
  Chemically synthesized
uucuaaaugguaacaagug

SEQ ID NO: 13669 - RNA, 19 nt, artificial
  Chemically synthesized
aaagagaauaccacauuuc

SEQ ID NO: 13670 - RNA, 19 nt, artificial
  Chemically synthesized
uuauccgaucccgacgccu

SEQ ID NO: 13671 - RNA, 19 nt, artificial
  Chemically synthesized
augcucaugaaguccaugg

SEQ ID NO: 13672 - RNA, 19 nt, artificial
  Chemically synthesized
uggcugauacugacaaggg

SEQ ID NO: 13673 - RNA, 19 nt, artificial
  Chemically synthesized
ucguccaugucgcucucgg

SEQ ID NO: 13674 - RNA, 19 nt, artificial
  Chemically synthesized
ugugcgucaaaguagccuu

SEQ ID NO: 13675 - RNA, 19 nt, artificial
  Chemically synthesized
aauaguccuaaugaaacug

SEQ ID NO: 13676 - RNA, 19 nt, artificial
  Chemically synthesized
uauguaugucccaucuagu

SEQ ID NO: 13677 - RNA, 19 nt, artificial
  Chemically synthesized
uuuucuaacuuugcagauc

SEQ ID NO: 13678 - RNA, 19 nt, artificial
  Chemically synthesized
auaaucugagauguuguug

SEQ ID NO: 13679 - RNA, 19 nt, artificial
  Chemically synthesized
agcagaauacucuucucug

SEQ ID NO: 13680 - RNA, 19 nt, artificial
  Chemically synthesized
aagugcauaauacaugcug

SEQ ID NO: 13681 - RNA, 19 nt, artificial
  Chemically synthesized
auagauguugcaucauuag

SEQ ID NO: 13682 - RNA, 19 nt, artificial
  Chemically synthesized
auauguaugucccaucuag

SEQ ID NO: 13683 - RNA, 19 nt, artificial
  Chemically synthesized
agggugacaagaauagaug

SEQ ID NO: 13684 - RNA, 19 nt, artificial
  Chemically synthesized
cucuauauauguauguccc

SEQ ID NO: 13685 - RNA, 19 nt, artificial
  Chemically synthesized
ugaaccaaacaaaaaaggg

SEQ ID NO: 13686 - RNA, 19 nt, artificial
  Chemically synthesized
acuguuauuuauccgaucc

SEQ ID NO: 13687 - RNA, 19 nt, artificial
  Chemically synthesized
uguuaaucugagaacugau

SEQ ID NO: 13688 - RNA, 19 nt, artificial
  Chemically synthesized
ucucggaggucgucuccuc

SEQ ID NO: 13689 - RNA, 19 nt, artificial
  Chemically synthesized
uccaggaaacuucuaaaug

SEQ ID NO: 13690 - RNA, 19 nt, artificial
  Chemically synthesized
caaugcacugcuaaauguc

SEQ ID NO: 13691 - RNA, 19 nt, artificial
  Chemically synthesized
ugaauuaaauagccucugg

SEQ ID NO: 13692 - RNA, 19 nt, artificial
  Chemically synthesized
agagguuuuaagcugacuc

SEQ ID NO: 13693 - RNA, 19 nt, artificial
  Chemically synthesized
uacauucaucuuguuuugg

SEQ ID NO: 13694 - RNA, 19 nt, artificial
  Chemically synthesized
aauccuaugcucaugaagu

SEQ ID NO: 13695 - RNA, 19 nt, artificial
  Chemically synthesized
acuccuacaaacuggagag

SEQ ID NO: 13696 - RNA, 19 nt, artificial
  Chemically synthesized
uuucccacgccgcaacucu

SEQ ID NO: 13697 - RNA, 19 nt, artificial
  Chemically synthesized
ucaacucagauaaacuguu

SEQ ID NO: 13698 - RNA, 19 nt, artificial
  Chemically synthesized
aucuucaaaugauccacug

SEQ ID NO: 13699 - RNA, 19 nt, artificial
  Chemically synthesized
auacugacaagggcgggcu

SEQ ID NO: 13700 - RNA, 19 nt, artificial
  Chemically synthesized
guuugugucucaaauagcu

SEQ ID NO: 13701 - RNA, 19 nt, artificial
  Chemically synthesized
acacaugguaggcaacugc

SEQ ID NO: 13702 - RNA, 19 nt, artificial
  Chemically synthesized
ucgaaaaaaacaaaaccac

SEQ ID NO: 13703 - RNA, 19 nt, artificial
  Chemically synthesized
acaugcugugucucuuauc

SEQ ID NO: 13704 - RNA, 19 nt, artificial
  Chemically synthesized
uguuguuguuggagaauuc

SEQ ID NO: 13705 - RNA, 19 nt, artificial
  Chemically synthesized
augcacugcuggaugguac

SEQ ID NO: 13706 - RNA, 19 nt, artificial
  Chemically synthesized
ucaaucuaaucacagagcu

SEQ ID NO: 13707 - RNA, 19 nt, artificial
  Chemically synthesized
uucaucaccuccagaaaug

SEQ ID NO: 13708 - RNA, 19 nt, artificial
  Chemically synthesized
acucuugcauagaaaaagg

SEQ ID NO: 13709 - RNA, 19 nt, artificial
  Chemically synthesized
ugcaauguuauauauccag

SEQ ID NO: 13710 - RNA, 19 nt, artificial
  Chemically synthesized
uuguggagaggcgacaagg

SEQ ID NO: 13711 - RNA, 19 nt, artificial
  Chemically synthesized
cagaauacucuucucuggc

SEQ ID NO: 13712 - RNA, 19 nt, artificial
  Chemically synthesized
acuaacuugacaaagagcu

SEQ ID NO: 13713 - RNA, 19 nt, artificial
  Chemically synthesized
uuucuccacacaguagaga

SEQ ID NO: 13714 - RNA, 19 nt, artificial
  Chemically synthesized
uuguuccacugcuggucug

SEQ ID NO: 13715 - RNA, 19 nt, artificial
  Chemically synthesized
aaugcacugcuaaauguca

SEQ ID NO: 13716 - RNA, 19 nt, artificial
  Chemically synthesized
auugcuuucuccacacagu

SEQ ID NO: 13717 - RNA, 19 nt, artificial
  Chemically synthesized
gaguaauuguucucgcucc

SEQ ID NO: 13718 - RNA, 19 nt, artificial
  Chemically synthesized
ucacucucucucuauauau

SEQ ID NO: 13719 - RNA, 19 nt, artificial
  Chemically synthesized
acugcuaaaugucaccucu

SEQ ID NO: 13720 - RNA, 19 nt, artificial
  Chemically synthesized
auacucuucucuggcaugg

SEQ ID NO: 13721 - RNA, 19 nt, artificial
  Chemically synthesized
cuuucuuaaccuauccucc

SEQ ID NO: 13722 - RNA, 19 nt, artificial
  Chemically synthesized
aauacaugcugugucucuu

SEQ ID NO: 13723 - RNA, 19 nt, artificial
  Chemically synthesized
aagaauagauguugcauca

SEQ ID NO: 13724 - RNA, 19 nt, artificial
  Chemically synthesized
uguacaaagaaggcaaacu

SEQ ID NO: 13725 - RNA, 19 nt, artificial
  Chemically synthesized
uuucaaaagcaguuggcac

SEQ ID NO: 13726 - RNA, 19 nt, artificial
  Chemically synthesized
uugcuuucuccacacagua

SEQ ID NO: 13727 - RNA, 19 nt, artificial
  Chemically synthesized
aauacucuucucuggcaug

SEQ ID NO: 13728 - RNA, 19 nt, artificial
  Chemically synthesized
uugcugaugucaguuaccg

SEQ ID NO: 13729 - RNA, 19 nt, artificial
  Chemically synthesized
auggcuaccuucagggugc

SEQ ID NO: 13730 - RNA, 19 nt, artificial
  Chemically synthesized
aaaaagacuagguacagua

SEQ ID NO: 13731 - RNA, 19 nt, artificial
  Chemically synthesized
ucgucuucccuugugcaau

SEQ ID NO: 13732 - RNA, 19 nt, artificial
  Chemically synthesized
aacuagaucuuucaacuug

SEQ ID NO: 13733 - RNA, 19 nt, artificial
  Chemically synthesized
aucccucuccuuuucuuuc

SEQ ID NO: 13734 - RNA, 19 nt, artificial
  Chemically synthesized
ugucaguuaccgagcugcc

SEQ ID NO: 13735 - RNA, 19 nt, artificial
  Chemically synthesized
uaugcucaugaaguccaug

SEQ ID NO: 13736 - RNA, 19 nt, artificial
  Chemically synthesized
uugggcuggagcagggcug

SEQ ID NO: 13737 - RNA, 19 nt, artificial
  Chemically synthesized
aacugcucauaggugcacu

SEQ ID NO: 13738 - RNA, 19 nt, artificial
  Chemically synthesized
uuuccaggaaacuucuaaa

SEQ ID NO: 13739 - RNA, 19 nt, artificial
  Chemically synthesized
gucucaagagaauucaguc

SEQ ID NO: 13740 - RNA, 19 nt, artificial
  Chemically synthesized
acuucuaaaugguaacaag

SEQ ID NO: 13741 - RNA, 19 nt, artificial
  Chemically synthesized
augucuguacaaagaaggc

SEQ ID NO: 13742 - RNA, 19 nt, artificial
  Chemically synthesized
ugcucaugaaguccauggc

SEQ ID NO: 13743 - RNA, 19 nt, artificial
  Chemically synthesized
ucugaaauggaggacauuc

SEQ ID NO: 13744 - RNA, 19 nt, artificial
  Chemically synthesized
uuccaggaaacuucuaaau

SEQ ID NO: 13745 - RNA, 19 nt, artificial
  Chemically synthesized
cuucaaaugauccacuguc

SEQ ID NO: 13746 - RNA, 19 nt, artificial
  Chemically synthesized
aauaccacauuuccacucg

SEQ ID NO: 13747 - RNA, 19 nt, artificial
  Chemically synthesized
uaugucccaucuagucuca

SEQ ID NO: 13748 - RNA, 19 nt, artificial
  Chemically synthesized
aaugauccacugucauuug

SEQ ID NO: 13749 - RNA, 19 nt, artificial
  Chemically synthesized
aacaaaaacucucacgugc

SEQ ID NO: 13750 - RNA, 19 nt, artificial
  Chemically synthesized
uccaugucgcucucggagg

SEQ ID NO: 13751 - RNA, 19 nt, artificial
  Chemically synthesized
ugagguuugugucucaaau

SEQ ID NO: 13752 - RNA, 19 nt, artificial
  Chemically synthesized
uuuauauaaagcagcacca

SEQ ID NO: 13753 - RNA, 19 nt, artificial
  Chemically synthesized
ucuuguuuugggaucaaau

SEQ ID NO: 13754 - RNA, 19 nt, artificial
  Chemically synthesized
auaaucccucuccuuuucu

SEQ ID NO: 13755 - RNA, 19 nt, artificial
  Chemically synthesized
cacucgucuucccuugugc

SEQ ID NO: 13756 - RNA, 19 nt, artificial
  Chemically synthesized
aaaaccuguugguuucagc

SEQ ID NO: 13757 - RNA, 19 nt, artificial
  Chemically synthesized
uuuugggaucaaaugcaau

SEQ ID NO: 13758 - RNA, 19 nt, artificial
  Chemically synthesized
aguagagaaaugaagugca

SEQ ID NO: 13759 - RNA, 19 nt, artificial
  Chemically synthesized
auauaaagcagcaccauau

SEQ ID NO: 13760 - RNA, 19 nt, artificial
  Chemically synthesized
auauauguaugucccaucu

SEQ ID NO: 13761 - RNA, 19 nt, artificial
  Chemically synthesized
aacuccuacaaacuggaga

SEQ ID NO: 13762 - RNA, 19 nt, artificial
  Chemically synthesized
aaagcagcaccauauuuug

SEQ ID NO: 13763 - RNA, 19 nt, artificial
  Chemically synthesized
guuuauauaaagcagcacc

SEQ ID NO: 13764 - RNA, 19 nt, artificial
  Chemically synthesized
uuguuaaucugagaacuga

SEQ ID NO: 13765 - RNA, 19 nt, artificial
  Chemically synthesized
ugacucugaaauggaggac

SEQ ID NO: 13766 - RNA, 19 nt, artificial
  Chemically synthesized
uauccgaucccgacgccuu

SEQ ID NO: 13767 - RNA, 19 nt, artificial
  Chemically synthesized
gguuugugucucaaauagc

SEQ ID NO: 13768 - RNA, 19 nt, artificial
  Chemically synthesized
ucaaaugcaaucacuaacu

SEQ ID NO: 13769 - RNA, 19 nt, artificial
  Chemically synthesized
aagagaauaccacauuucc

SEQ ID NO: 13770 - RNA, 19 nt, artificial
  Chemically synthesized
uuuaagcugacucugaaau

SEQ ID NO: 13771 - RNA, 19 nt, artificial
  Chemically synthesized
uggacguggcugauacuga

SEQ ID NO: 13772 - RNA, 19 nt, artificial
  Chemically synthesized
uguuuuucaaaagcaguug

SEQ ID NO: 13773 - RNA, 19 nt, artificial
  Chemically synthesized
uuuauuguuccuuugugga

SEQ ID NO: 13774 - RNA, 19 nt, artificial
  Chemically synthesized
uccgcaugggcaaacgugg

SEQ ID NO: 13775 - RNA, 19 nt, artificial
  Chemically synthesized
cagcagaauacucuucucu

SEQ ID NO: 13776 - RNA, 19 nt, artificial
  Chemically synthesized
uguacaucccauugcauac

SEQ ID NO: 13777 - RNA, 19 nt, artificial
  Chemically synthesized
ucugaaguuguggagaggc

SEQ ID NO: 13778 - RNA, 19 nt, artificial
  Chemically synthesized
uacucuucucuggcauggu

SEQ ID NO: 13779 - RNA, 19 nt, artificial
  Chemically synthesized
agauguugcaucauuagga

SEQ ID NO: 13780 - RNA, 19 nt, artificial
  Chemically synthesized
uuauuguuccuuuguggau

SEQ ID NO: 13781 - RNA, 19 nt, artificial
  Chemically synthesized
aauguaacuucucccaaag

SEQ ID NO: 13782 - RNA, 19 nt, artificial
  Chemically synthesized
augucaguuaccgagcugc

SEQ ID NO: 13783 - RNA, 19 nt, artificial
  Chemically synthesized
aaacaaaaacucucacgug

SEQ ID NO: 13784 - RNA, 19 nt, artificial
  Chemically synthesized
auguaugucccaucuaguc

SEQ ID NO: 13785 - RNA, 19 nt, artificial
  Chemically synthesized
ugucuguacaaagaaggca

SEQ ID NO: 13786 - RNA, 19 nt, artificial
  Chemically synthesized
ucagcuuuuucuaacuuug

SEQ ID NO: 13787 - RNA, 19 nt, artificial
  Chemically synthesized
uucugaaguuguggagagg

SEQ ID NO: 13788 - RNA, 19 nt, artificial
  Chemically synthesized
acugcuggaugguacgguc

SEQ ID NO: 13789 - RNA, 19 nt, artificial
  Chemically synthesized
uguuuauugcuuucuccac

SEQ ID NO: 13790 - RNA, 19 nt, artificial
  Chemically synthesized
uuucagcagucauuuugac

SEQ ID NO: 13791 - RNA, 19 nt, artificial
  Chemically synthesized
augagacacaagccgcacc

SEQ ID NO: 13792 - RNA, 19 nt, artificial
  Chemically synthesized
guuccuuuguggaucuguc

SEQ ID NO: 13793 - RNA, 19 nt, artificial
  Chemically synthesized
ucugguggacacaugguag

SEQ ID NO: 13794 - RNA, 19 nt, artificial
  Chemically synthesized
ugcuuauaccaaugcacug

SEQ ID NO: 13795 - RNA, 19 nt, artificial
  Chemically synthesized
acucgucuucccuugugca

SEQ ID NO: 13796 - RNA, 19 nt, artificial
  Chemically synthesized
ugguuucagcagaauacuc

SEQ ID NO: 13797 - RNA, 19 nt, artificial
  Chemically synthesized
gucucguccaugucgcucu

SEQ ID NO: 13798 - RNA, 19 nt, artificial
  Chemically synthesized
uaaaaagcuccaacuucug

SEQ ID NO: 13799 - RNA, 19 nt, artificial
  Chemically synthesized
ucagcagucauuuugacca

SEQ ID NO: 13800 - RNA, 19 nt, artificial
  Chemically synthesized
aaccaaacuccuacaaacu

SEQ ID NO: 13801 - RNA, 19 nt, artificial
  Chemically synthesized
uaccaaugcacugcuaaau

SEQ ID NO: 13802 - RNA, 19 nt, artificial
  Chemically synthesized
cuuuauuguuccuuugugg

SEQ ID NO: 13803 - RNA, 19 nt, artificial
  Chemically synthesized
aaagacucuugcauagaaa

SEQ ID NO: 13804 - RNA, 19 nt, artificial
  Chemically synthesized
gccuuuucucuauaauccc

SEQ ID NO: 13805 - RNA, 19 nt, artificial
  Chemically synthesized
uugguuucagcagaauacu

SEQ ID NO: 13806 - RNA, 19 nt, artificial
  Chemically synthesized
augucgcucucggaggucg

SEQ ID NO: 13807 - RNA, 19 nt, artificial
  Chemically synthesized
aguuacuauugcaagaagu

SEQ ID NO: 13808 - RNA, 19 nt, artificial
  Chemically synthesized
gucucaaauagcuuuauug

SEQ ID NO: 13809 - RNA, 19 nt, artificial
  Chemically synthesized
auggaggacauucaguuac

SEQ ID NO: 13810 - RNA, 19 nt, artificial
  Chemically synthesized
uuaaauagccucuggugga

SEQ ID NO: 13811 - RNA, 19 nt, artificial
  Chemically synthesized
auuaaaccaaacuccuaca

SEQ ID NO: 13812 - RNA, 19 nt, artificial
  Chemically synthesized
agaaaugcuuguuaaucug

SEQ ID NO: 13813 - RNA, 19 nt, artificial
  Chemically synthesized
aagugcugagaugagacac

SEQ ID NO: 13814 - RNA, 19 nt, artificial
  Chemically synthesized
uccuuuguggaucugucgg

SEQ ID NO: 13815 - RNA, 19 nt, artificial
  Chemically synthesized
uugggaucaaaugcaauca

SEQ ID NO: 13816 - RNA, 19 nt, artificial
  Chemically synthesized
aauugcuuauaccaaugca

SEQ ID NO: 13817 - RNA, 19 nt, artificial
  Chemically synthesized
aaaugcaaucacuaacuug

SEQ ID NO: 13818 - RNA, 19 nt, artificial
  Chemically synthesized
cuagucucaagagaauuca

SEQ ID NO: 13819 - RNA, 19 nt, artificial
  Chemically synthesized
ucucacucucucucuauau

SEQ ID NO: 13820 - RNA, 19 nt, artificial
  Chemically synthesized
aagagaauucagucagggc

SEQ ID NO: 13821 - RNA, 19 nt, artificial
  Chemically synthesized
acucucucucuauauaugu

SEQ ID NO: 13822 - RNA, 19 nt, artificial
  Chemically synthesized
ugaaauggaggacauucag

SEQ ID NO: 13823 - RNA, 19 nt, artificial
  Chemically synthesized
gauuucagcauauuaagag

SEQ ID NO: 13824 - RNA, 19 nt, artificial
  Chemically synthesized
aaccaaacaaaaaagggag

SEQ ID NO: 13825 - RNA, 19 nt, artificial
  Chemically synthesized
ucaccucuuggcaugucug

SEQ ID NO: 13826 - RNA, 19 nt, artificial
  Chemically synthesized
agguuugugucucaaauag

SEQ ID NO: 13827 - RNA, 19 nt, artificial
  Chemically synthesized
accaaugcacugcuaaaug

SEQ ID NO: 13828 - RNA, 19 nt, artificial
  Chemically synthesized
acucucucacucucucucu

SEQ ID NO: 13829 - RNA, 19 nt, artificial
  Chemically synthesized
aaaugucugcagccuauug

SEQ ID NO: 13830 - RNA, 19 nt, artificial
  Chemically synthesized
auguuuauugcuuucucca

SEQ ID NO: 13831 - RNA, 19 nt, artificial
  Chemically synthesized
guggcugauacugacaagg

SEQ ID NO: 13832 - RNA, 19 nt, artificial
  Chemically synthesized
agugcucccuccuugcuuc

SEQ ID NO: 13833 - RNA, 19 nt, artificial
  Chemically synthesized
aaaacuuccuaagcucagg

SEQ ID NO: 13834 - RNA, 19 nt, artificial
  Chemically synthesized
cacgucgauggucucgucc

SEQ ID NO: 13835 - RNA, 19 nt, artificial
  Chemically synthesized
uaccacauuuccacucgug

SEQ ID NO: 13836 - RNA, 19 nt, artificial
  Chemically synthesized
aaagcaguuggcacaaguc

SEQ ID NO: 13837 - RNA, 19 nt, artificial
  Chemically synthesized
augaaguccauggcaagag

SEQ ID NO: 13838 - RNA, 19 nt, artificial
  Chemically synthesized
aaagggugacaagaauaga

SEQ ID NO: 13839 - RNA, 19 nt, artificial
  Chemically synthesized
augauccacugucauuugc

SEQ ID NO: 13840 - RNA, 19 nt, artificial
  Chemically synthesized
uccuugcuucaucaccucc

SEQ ID NO: 13841 - RNA, 19 nt, artificial
  Chemically synthesized
uuaggagaaaaugaagagg

SEQ ID NO: 13842 - RNA, 19 nt, artificial
  Chemically synthesized
cacucgugagguuuguguc

SEQ ID NO: 13843 - RNA, 19 nt, artificial
  Chemically synthesized
aaacuccuacaaacuggag

SEQ ID NO: 13844 - RNA, 19 nt, artificial
  Chemically synthesized
uguuccuuuguggaucugu

SEQ ID NO: 13845 - RNA, 19 nt, artificial
  Chemically synthesized
ucggaggucgucuccucgc

SEQ ID NO: 13846 - RNA, 19 nt, artificial
  Chemically synthesized
ugaaguuuucaaaaguugc

SEQ ID NO: 13847 - RNA, 19 nt, artificial
  Chemically synthesized
ucacgugcuugauuucagc

SEQ ID NO: 13848 - RNA, 19 nt, artificial
  Chemically synthesized
gaaaugaagugcauaauac

SEQ ID NO: 13849 - RNA, 19 nt, artificial
  Chemically synthesized
ucuguauggcuaccuucag

SEQ ID NO: 13850 - RNA, 19 nt, artificial
  Chemically synthesized
caucccauugcauacauuc

SEQ ID NO: 13851 - RNA, 19 nt, artificial
  Chemically synthesized
agcagcaccauauuuugag

SEQ ID NO: 13852 - RNA, 19 nt, artificial
  Chemically synthesized
cuucucaacucagauaaac

SEQ ID NO: 13853 - RNA, 19 nt, artificial
  Chemically synthesized
guuggcaugaauuaaauag

SEQ ID NO: 13854 - RNA, 19 nt, artificial
  Chemically synthesized
aucaaaugcaaucacuaac

SEQ ID NO: 13855 - RNA, 19 nt, artificial
  Chemically synthesized
uuucuuaaccuauccucca

SEQ ID NO: 13856 - RNA, 19 nt, artificial
  Chemically synthesized
auuguuccuuuguggaucu

SEQ ID NO: 13857 - RNA, 19 nt, artificial
  Chemically synthesized
uaaauagccucugguggac

SEQ ID NO: 13858 - RNA, 19 nt, artificial
  Chemically synthesized
uaacuuauguacaucccau

SEQ ID NO: 13859 - RNA, 19 nt, artificial
  Chemically synthesized
aucuguauggcuaccuuca

SEQ ID NO: 13860 - RNA, 19 nt, artificial
  Chemically synthesized
gaauucaaucuaaucacag

SEQ ID NO: 13861 - RNA, 19 nt, artificial
  Chemically synthesized
ugaggacuggacguggcug

SEQ ID NO: 13862 - RNA, 19 nt, artificial
  Chemically synthesized
uuauugcuuucuccacaca

SEQ ID NO: 13863 - RNA, 19 nt, artificial
  Chemically synthesized
aagcuccaacuucuguccc

SEQ ID NO: 13864 - RNA, 19 nt, artificial
  Chemically synthesized
ucggagggcugaauccgca

SEQ ID NO: 13865 - RNA, 19 nt, artificial
  Chemically synthesized
uaggcaacugcucauaggu

SEQ ID NO: 13866 - RNA, 19 nt, artificial
  Chemically synthesized
cauucggagggcugaaucc

SEQ ID NO: 13867 - RNA, 19 nt, artificial
  Chemically synthesized
aaagggagagaaaaaaaag

SEQ ID NO: 13868 - RNA, 19 nt, artificial
  Chemically synthesized
aaugcaaaaaagacuaggu

SEQ ID NO: 13869 - RNA, 19 nt, artificial
  Chemically synthesized
uuuaaaaagcuccaacuuc

SEQ ID NO: 13870 - RNA, 19 nt, artificial
  Chemically synthesized
agacauacugaugcacugc

SEQ ID NO: 13871 - RNA, 19 nt, artificial
  Chemically synthesized
ugcuggucugcugaggacu

SEQ ID NO: 13872 - RNA, 19 nt, artificial
  Chemically synthesized
uauaccaaugcacugcuaa

SEQ ID NO: 13873 - RNA, 19 nt, artificial
  Chemically synthesized
ucucucacucucucucuau

SEQ ID NO: 13874 - RNA, 19 nt, artificial
  Chemically synthesized
augguauuaaaaugucugc

SEQ ID NO: 13875 - RNA, 19 nt, artificial
  Chemically synthesized
ucucaagagaauucaguca

SEQ ID NO: 13876 - RNA, 19 nt, artificial
  Chemically synthesized
augucugcagccuauugca

SEQ ID NO: 13877 - RNA, 19 nt, artificial
  Chemically synthesized
caauucagacauacugaug

SEQ ID NO: 13878 - RNA, 19 nt, artificial
  Chemically synthesized
gaaacuucuaaaugguaac

SEQ ID NO: 13879 - RNA, 19 nt, artificial
  Chemically synthesized
ucgauggucucguccaugu

SEQ ID NO: 13880 - RNA, 19 nt, artificial
  Chemically synthesized
uaaaccaaacuccuacaaa

SEQ ID NO: 13881 - RNA, 19 nt, artificial
  Chemically synthesized
ucccaucuagucucaagag

SEQ ID NO: 13882 - RNA, 19 nt, artificial
  Chemically synthesized
uuuugaccaguaaaaccug

SEQ ID NO: 13883 - RNA, 19 nt, artificial
  Chemically synthesized
cuucuguuaggcacucucg

SEQ ID NO: 13884 - RNA, 19 nt, artificial
  Chemically synthesized
gacucuugcauagaaaaag

SEQ ID NO: 13885 - RNA, 19 nt, artificial
  Chemically synthesized
aguugcugaugucaguuac

SEQ ID NO: 13886 - RNA, 19 nt, artificial
  Chemically synthesized
acucucggaauccuaugcu

SEQ ID NO: 13887 - RNA, 19 nt, artificial
  Chemically synthesized
uucagucagggcauuuuac

SEQ ID NO: 13888 - RNA, 19 nt, artificial
  Chemically synthesized
uucccacgccgcaacucug

SEQ ID NO: 13889 - RNA, 19 nt, artificial
  Chemically synthesized
ucagucagggcauuuuacu

SEQ ID NO: 13890 - RNA, 19 nt, artificial
  Chemically synthesized
augcugugucucuuaucuu

SEQ ID NO: 13891 - RNA, 19 nt, artificial
  Chemically synthesized
uacugaugcacugcuggau

SEQ ID NO: 13892 - RNA, 19 nt, artificial
  Chemically synthesized
auucagacauacugaugca

SEQ ID NO: 13893 - RNA, 19 nt, artificial
  Chemically synthesized
gguauguaaagacucuugc

SEQ ID NO: 13894 - RNA, 19 nt, artificial
  Chemically synthesized
cuuuucucuuccuagugcu

SEQ ID NO: 13895 - RNA, 19 nt, artificial
  Chemically synthesized
uuuucaaguuggcaugaau

SEQ ID NO: 13896 - RNA, 19 nt, artificial
  Chemically synthesized
cuuguuaaucugagaacug

SEQ ID NO: 13897 - RNA, 19 nt, artificial
  Chemically synthesized
caugguauuaaaaugucug

SEQ ID NO: 13898 - RNA, 19 nt, artificial
  Chemically synthesized
aaugucaccucuuggcaug

SEQ ID NO: 13899 - RNA, 19 nt, artificial
  Chemically synthesized
aacuucuguuaggcacucu

SEQ ID NO: 13900 - RNA, 19 nt, artificial
  Chemically synthesized
cucgugagguuugugucuc

SEQ ID NO: 13901 - RNA, 19 nt, artificial
  Chemically synthesized
uguuuguuccacugcuggu

SEQ ID NO: 13902 - RNA, 19 nt, artificial
  Chemically synthesized
uguaaagacucuugcauag

SEQ ID NO: 13903 - RNA, 19 nt, artificial
  Chemically synthesized
uucucccaaagggugacaa

SEQ ID NO: 13904 - RNA, 19 nt, artificial
  Chemically synthesized
aucuagucucaagagaauu

SEQ ID NO: 13905 - RNA, 19 nt, artificial
  Chemically synthesized
ccaaacuccuacaaacugg

SEQ ID NO: 13906 - RNA, 19 nt, artificial
  Chemically synthesized
ucauuuugaccaguaaaac

SEQ ID NO: 13907 - RNA, 19 nt, artificial
  Chemically synthesized
ugaagcaucuucaaaugau

SEQ ID NO: 13908 - RNA, 19 nt, artificial
  Chemically synthesized
aaggacagagggaagcugu

SEQ ID NO: 13909 - RNA, 19 nt, artificial
  Chemically synthesized
acaaacuggagaguuuuca

SEQ ID NO: 13910 - RNA, 19 nt, artificial
  Chemically synthesized
caugcugugucucuuaucu

SEQ ID NO: 13911 - RNA, 19 nt, artificial
  Chemically synthesized
ucucuuccuagugcucccu

SEQ ID NO: 13912 - RNA, 19 nt, artificial
  Chemically synthesized
caucuguauggcuaccuuc

SEQ ID NO: 13913 - RNA, 19 nt, artificial
  Chemically synthesized
acucucacgugcuugauuu

SEQ ID NO: 13914 - RNA, 19 nt, artificial
  Chemically synthesized
uggagaauucaaucuaauc

SEQ ID NO: 13915 - RNA, 19 nt, artificial
  Chemically synthesized
cacugcuaaaugucaccuc

SEQ ID NO: 13916 - RNA, 19 nt, artificial
  Chemically synthesized
uguugccugaagcaucuuc

SEQ ID NO: 13917 - RNA, 19 nt, artificial
  Chemically synthesized
aaaccuguugguuucagca

SEQ ID NO: 13918 - RNA, 19 nt, artificial
  Chemically synthesized
ugguauuaaaaugucugca

SEQ ID NO: 13919 - RNA, 19 nt, artificial
  Chemically synthesized
uucuuaaccuauccuccac

SEQ ID NO: 13920 - RNA, 19 nt, artificial
  Chemically synthesized
aaacacgacucucucacuc

SEQ ID NO: 13921 - RNA, 19 nt, artificial
  Chemically synthesized
uuaaccuauccuccacacu

SEQ ID NO: 13922 - RNA, 19 nt, artificial
  Chemically synthesized
cuuauguacaucccauugc

SEQ ID NO: 13923 - RNA, 19 nt, artificial
  Chemically synthesized
aagcaguuggcacaagucu

SEQ ID NO: 13924 - RNA, 19 nt, artificial
  Chemically synthesized
ucaaaugauccacugucau

SEQ ID NO: 13925 - RNA, 19 nt, artificial
  Chemically synthesized
cucuccuuuucuuucuugc

SEQ ID NO: 13926 - RNA, 19 nt, artificial
  Chemically synthesized
cagagcuaguacuuugccc

SEQ ID NO: 13927 - RNA, 19 nt, artificial
  Chemically synthesized
cgucaaaguagccuuuacc

SEQ ID NO: 13928 - RNA, 19 nt, artificial
  Chemically synthesized
uuuccacucgugagguuug

SEQ ID NO: 13929 - RNA, 19 nt, artificial
  Chemically synthesized
uggucucguccaugucgcu

SEQ ID NO: 13930 - RNA, 19 nt, artificial
  Chemically synthesized
uaggugcacuauauaaaug

SEQ ID NO: 13931 - RNA, 19 nt, artificial
  Chemically synthesized
aaugguaacaagugugaag

SEQ ID NO: 13932 - RNA, 19 nt, artificial
  Chemically synthesized
acauacugaugcacugcug

SEQ ID NO: 13933 - RNA, 19 nt, artificial
  Chemically synthesized
guuaaucugagaacugaug

SEQ ID NO: 13934 - RNA, 19 nt, artificial
  Chemically synthesized
ugcuccuagcggcucuuuc

SEQ ID NO: 13935 - RNA, 19 nt, artificial
  Chemically synthesized
acaugguaggcaacugcuc

SEQ ID NO: 13936 - RNA, 19 nt, artificial
  Chemically synthesized
ugcugaggacuggacgugg

SEQ ID NO: 13937 - RNA, 19 nt, artificial
  Chemically synthesized
uugccauaaucugagaugu

SEQ ID NO: 13938 - RNA, 19 nt, artificial
  Chemically synthesized
uaaagacucuugcauagaa

SEQ ID NO: 13939 - RNA, 19 nt, artificial
  Chemically synthesized
uuauauaaagcagcaccau

SEQ ID NO: 13940 - RNA, 19 nt, artificial
  Chemically synthesized
auugcaagaaguucaagaa

SEQ ID NO: 13941 - RNA, 19 nt, artificial
  Chemically synthesized
uucaucccggcgaagaccg

SEQ ID NO: 13942 - RNA, 19 nt, artificial
  Chemically synthesized
ugcugcugcugcguuuggg

SEQ ID NO: 13943 - RNA, 19 nt, artificial
  Chemically synthesized
uuuucagcagucauuuuga

SEQ ID NO: 13944 - RNA, 19 nt, artificial
  Chemically synthesized
ucagguaccgcgcaacuuc

SEQ ID NO: 13945 - RNA, 19 nt, artificial
  Chemically synthesized
auccacugucauuugcaau

SEQ ID NO: 13946 - RNA, 19 nt, artificial
  Chemically synthesized
uagugcucccuccuugcuu

SEQ ID NO: 13947 - RNA, 19 nt, artificial
  Chemically synthesized
aaagacuagguacaguaau

SEQ ID NO: 13948 - RNA, 19 nt, artificial
  Chemically synthesized
guuguuggagaauucaauc

SEQ ID NO: 13949 - RNA, 19 nt, artificial
  Chemically synthesized
aacuggagaguuuucaagu

SEQ ID NO: 13950 - RNA, 19 nt, artificial
  Chemically synthesized
agugguauguaaagacucu

SEQ ID NO: 13951 - RNA, 19 nt, artificial
  Chemically synthesized
gucaaaguagccuuuaccc

SEQ ID NO: 13952 - RNA, 19 nt, artificial
  Chemically synthesized
uuguagcuuuucucuuccu

SEQ ID NO: 13953 - RNA, 19 nt, artificial
  Chemically synthesized
uucaguuacuauugcaaga

SEQ ID NO: 13954 - RNA, 19 nt, artificial
  Chemically synthesized
acaguagagaaaugaagug

SEQ ID NO: 13955 - RNA, 19 nt, artificial
  Chemically synthesized
uuguuguuggagaauucaa

SEQ ID NO: 13956 - RNA, 19 nt, artificial
  Chemically synthesized
agacacaagccgcacccgc

SEQ ID NO: 13957 - RNA, 19 nt, artificial
  Chemically synthesized
cagcaccauauuuugagcc

SEQ ID NO: 13958 - RNA, 19 nt, artificial
  Chemically synthesized
ugcuuucuccacacaguag

SEQ ID NO: 13959 - RNA, 19 nt, artificial
  Chemically synthesized
uuuucaaaaguugcugaug

SEQ ID NO: 13960 - RNA, 19 nt, artificial
  Chemically synthesized
ucucccaaagggugacaag

SEQ ID NO: 13961 - RNA, 19 nt, artificial
  Chemically synthesized
ugggaucaaaugcaaucac

SEQ ID NO: 13962 - RNA, 19 nt, artificial
  Chemically synthesized
cgcucucggaggucgucuc

SEQ ID NO: 13963 - RNA, 19 nt, artificial
  Chemically synthesized
ugaaguccauggcaagagc

SEQ ID NO: 13964 - RNA, 19 nt, artificial
  Chemically synthesized
aaacucucacgugcuugau

SEQ ID NO: 13965 - RNA, 19 nt, artificial
  Chemically synthesized
agucuucucaacucagaua

SEQ ID NO: 13966 - RNA, 19 nt, artificial
  Chemically synthesized
uuugcagauccuuguuuuu

SEQ ID NO: 13967 - RNA, 19 nt, artificial
  Chemically synthesized
acaaagaaggcaaacuaag

SEQ ID NO: 13968 - RNA, 19 nt, artificial
  Chemically synthesized
acgucgauggucucgucca

SEQ ID NO: 13969 - RNA, 19 nt, artificial
  Chemically synthesized
aaguuuucaaaaguugcug

SEQ ID NO: 13970 - RNA, 19 nt, artificial
  Chemically synthesized
auucaucuuguuuugggau

SEQ ID NO: 13971 - RNA, 19 nt, artificial
  Chemically synthesized
ucucggaauccuaugcuca

SEQ ID NO: 13972 - RNA, 19 nt, artificial
  Chemically synthesized
gucugcugaggacuggacg

SEQ ID NO: 13973 - RNA, 19 nt, artificial
  Chemically synthesized
ucaucuuguuuugggauca

SEQ ID NO: 13974 - RNA, 19 nt, artificial
  Chemically synthesized
ucuucaaaugauccacugu

SEQ ID NO: 13975 - RNA, 19 nt, artificial
  Chemically synthesized
uacaugcugugucucuuau

SEQ ID NO: 13976 - RNA, 19 nt, artificial
  Chemically synthesized
uagcuuuucucuuccuagu

SEQ ID NO: 13977 - RNA, 19 nt, artificial
  Chemically synthesized
auaacuuauguacauccca

SEQ ID NO: 13978 - RNA, 19 nt, artificial
  Chemically synthesized
gugacaagaauagauguug

SEQ ID NO: 13979 - RNA, 19 nt, artificial
  Chemically synthesized
uccuuucuuaaccuauccu

SEQ ID NO: 13980 - RNA, 19 nt, artificial
  Chemically synthesized
guacgguccauauauuuuc

SEQ ID NO: 13981 - RNA, 19 nt, artificial
  Chemically synthesized
aaugcuuguuaaucugaga

SEQ ID NO: 13982 - RNA, 19 nt, artificial
  Chemically synthesized
cgaguaauuguucucgcuc

SEQ ID NO: 13983 - RNA, 19 nt, artificial
  Chemically synthesized
uccuagugcucccuccuug

SEQ ID NO: 13984 - RNA, 19 nt, artificial
  Chemically synthesized
aaucacuaacuugacaaag

SEQ ID NO: 13985 - RNA, 19 nt, artificial
  Chemically synthesized
cacaagucuucucaacuca

SEQ ID NO: 13986 - RNA, 19 nt, artificial
  Chemically synthesized
auuaggagaaaaugaagag

SEQ ID NO: 13987 - RNA, 19 nt, artificial
  Chemically synthesized
acagagggaagcugugugc

SEQ ID NO: 13988 - RNA, 19 nt, artificial
  Chemically synthesized
guagcuuuucucuuccuag

SEQ ID NO: 13989 - RNA, 19 nt, artificial
  Chemically synthesized
agggacaagagagaggugg

SEQ ID NO: 13990 - RNA, 19 nt, artificial
  Chemically synthesized
auguaaagacucuugcaua

SEQ ID NO: 13991 - RNA, 19 nt, artificial
  Chemically synthesized
uuaaaaugucugcagccua

SEQ ID NO: 13992 - RNA, 19 nt, artificial
  Chemically synthesized
aaaugucaccucuuggcau

SEQ ID NO: 13993 - RNA, 19 nt, artificial
  Chemically synthesized
cucucuauauauguauguc

SEQ ID NO: 13994 - RNA, 19 nt, artificial
  Chemically synthesized
acauucaguuacuauugca

SEQ ID NO: 13995 - RNA, 19 nt, artificial
  Chemically synthesized
gacuggacguggcugauac

SEQ ID NO: 13996 - RNA, 19 nt, artificial
  Chemically synthesized
aaccuauccuccacacucg

SEQ ID NO: 13997 - RNA, 19 nt, artificial
  Chemically synthesized
auccgcaugggcaaacgug

SEQ ID NO: 13998 - RNA, 19 nt, artificial
  Chemically synthesized
accauauuuugagccaucc

SEQ ID NO: 13999 - RNA, 19 nt, artificial
  Chemically synthesized
uuguggaucugucggcauc

SEQ ID NO: 14000 - RNA, 19 nt, artificial
  Chemically synthesized
gacucucucacucucucuc

SEQ ID NO: 14001 - RNA, 19 nt, artificial
  Chemically synthesized
uuaaaccaaacuccuacaa

SEQ ID NO: 14002 - RNA, 19 nt, artificial
  Chemically synthesized
uccacacucgucuucccuu

SEQ ID NO: 14003 - RNA, 19 nt, artificial
  Chemically synthesized
agaaauguaacuucuccca

SEQ ID NO: 14004 - RNA, 19 nt, artificial
  Chemically synthesized
uucaaaaguugcugauguc

SEQ ID NO: 14005 - RNA, 19 nt, artificial
  Chemically synthesized
acuucucccaaagggugac

SEQ ID NO: 14006 - RNA, 19 nt, artificial
  Chemically synthesized
auuuccacucgugagguuu

SEQ ID NO: 14007 - RNA, 19 nt, artificial
  Chemically synthesized
aagaaaacuuccuaagcuc

SEQ ID NO: 14008 - RNA, 19 nt, artificial
  Chemically synthesized
guuuauuguuuguuccacu

SEQ ID NO: 14009 - RNA, 19 nt, artificial
  Chemically synthesized
aucugagaacugaugaaau

SEQ ID NO: 14010 - RNA, 19 nt, artificial
  Chemically synthesized
ugcagauccuuguuuuuca

SEQ ID NO: 14011 - RNA, 19 nt, artificial
  Chemically synthesized
ugcacugcuggaugguacg

SEQ ID NO: 14012 - RNA, 19 nt, artificial
  Chemically synthesized
aucaccuccagaaauguaa

SEQ ID NO: 14013 - RNA, 19 nt, artificial
  Chemically synthesized
uuuucaaaagcaguuggca

SEQ ID NO: 14014 - RNA, 19 nt, artificial
  Chemically synthesized
ugguggugggccauggagg

SEQ ID NO: 14015 - RNA, 19 nt, artificial
  Chemically synthesized
gcuuauaccaaugcacugc

SEQ ID NO: 14016 - RNA, 19 nt, artificial
  Chemically synthesized
uaccuucagggugcagagg

SEQ ID NO: 14017 - RNA, 19 nt, artificial
  Chemically synthesized
acugcuggucugcugagga

SEQ ID NO: 14018 - RNA, 19 nt, artificial
  Chemically synthesized
uagagaaaugaagugcaua

SEQ ID NO: 14019 - RNA, 19 nt, artificial
  Chemically synthesized
uauauaaagcagcaccaua

SEQ ID NO: 14020 - RNA, 19 nt, artificial
  Chemically synthesized
acucgugagguuugugucu

SEQ ID NO: 14021 - RNA, 19 nt, artificial
  Chemically synthesized
aagcugacucugaaaugga

SEQ ID NO: 14022 - RNA, 19 nt, artificial
  Chemically synthesized
gauggucucguccaugucg

SEQ ID NO: 14023 - RNA, 19 nt, artificial
  Chemically synthesized
ugagauguuguuguuggag

SEQ ID NO: 14024 - RNA, 19 nt, artificial
  Chemically synthesized
gaagcaucuucaaaugauc

SEQ ID NO: 14025 - RNA, 19 nt, artificial
  Chemically synthesized
ucccauugcauacauucau

SEQ ID NO: 14026 - RNA, 19 nt, artificial
  Chemically synthesized
gagaauaccacauuuccac

SEQ ID NO: 14027 - RNA, 19 nt, artificial
  Chemically synthesized
uccagaaauguaacuucuc

SEQ ID NO: 14028 - RNA, 19 nt, artificial
  Chemically synthesized
caaauagcuuuauuguucc

SEQ ID NO: 14029 - RNA, 19 nt, artificial
  Chemically synthesized
acacucgucuucccuugug

SEQ ID NO: 14030 - RNA, 19 nt, artificial
  Chemically synthesized
acuagguacaguaauuuca

SEQ ID NO: 14031 - RNA, 19 nt, artificial
  Chemically synthesized
cuuucuccacacaguagag

SEQ ID NO: 14032 - RNA, 19 nt, artificial
  Chemically synthesized
caaacuccuacaaacugga

SEQ ID NO: 14033 - RNA, 19 nt, artificial
  Chemically synthesized
ucugcugaggacuggacgu

SEQ ID NO: 14034 - RNA, 19 nt, artificial
  Chemically synthesized
ugugcagccgcgguggcug

SEQ ID NO: 14035 - RNA, 19 nt, artificial
  Chemically synthesized
ugcaaaaaagacuagguac

SEQ ID NO: 14036 - RNA, 19 nt, artificial
  Chemically synthesized
cugagaugagacacaagcc

SEQ ID NO: 14037 - RNA, 19 nt, artificial
  Chemically synthesized
uccacucgugagguuugug

SEQ ID NO: 14038 - RNA, 19 nt, artificial
  Chemically synthesized
aaaguugcugaugucaguu

SEQ ID NO: 14039 - RNA, 19 nt, artificial
  Chemically synthesized
uuggcacaagucuucucaa

SEQ ID NO: 14040 - RNA, 19 nt, artificial
  Chemically synthesized
ugucgcucucggaggucgu

SEQ ID NO: 14041 - RNA, 19 nt, artificial
  Chemically synthesized
agucagggcauuuuacuuc

SEQ ID NO: 14042 - RNA, 19 nt, artificial
  Chemically synthesized
cauaauacaugcugugucu

SEQ ID NO: 14043 - RNA, 19 nt, artificial
  Chemically synthesized
uucaaaagcaguuggcaca

SEQ ID NO: 14044 - RNA, 19 nt, artificial
  Chemically synthesized
acaaaaacucucacgugcu

SEQ ID NO: 14045 - RNA, 19 nt, artificial
  Chemically synthesized
ccuuuguggaucugucggc

SEQ ID NO: 14046 - RNA, 19 nt, artificial
  Chemically synthesized
ucuguuaggcacucucgga

SEQ ID NO: 14047 - RNA, 19 nt, artificial
  Chemically synthesized
uuucaaguuggcaugaauu

SEQ ID NO: 14048 - RNA, 19 nt, artificial
  Chemically synthesized
gagggcugaauccgcaugg

SEQ ID NO: 14049 - RNA, 19 nt, artificial
  Chemically synthesized
cauuuugaccaguaaaacc

SEQ ID NO: 14050 - RNA, 19 nt, artificial
  Chemically synthesized
ucuugcauagaaaaagguu

SEQ ID NO: 14051 - RNA, 19 nt, artificial
  Chemically synthesized
uauguacaucccauugcau

SEQ ID NO: 14052 - RNA, 19 nt, artificial
  Chemically synthesized
uccacggagcucagguacc

SEQ ID NO: 14053 - RNA, 19 nt, artificial
  Chemically synthesized
uccacugcuggucugcuga

SEQ ID NO: 14054 - RNA, 19 nt, artificial
  Chemically synthesized
gauccgaggaguccaggcc

SEQ ID NO: 14055 - RNA, 19 nt, artificial
  Chemically synthesized
uuucaaaaguugcugaugu

SEQ ID NO: 14056 - RNA, 19 nt, artificial
  Chemically synthesized
gucauuugcaauauuucag

SEQ ID NO: 14057 - RNA, 19 nt, artificial
  Chemically synthesized
cuaaaugguaacaagugug

SEQ ID NO: 14058 - RNA, 19 nt, artificial
  Chemically synthesized
aaaacucucacgugcuuga

SEQ ID NO: 14059 - RNA, 19 nt, artificial
  Chemically synthesized
ugaauccgcaugggcaaac

SEQ ID NO: 14060 - RNA, 19 nt, artificial
  Chemically synthesized
uggucugcugaggacugga

SEQ ID NO: 14061 - RNA, 19 nt, artificial
  Chemically synthesized
aaauguaacuucucccaaa

SEQ ID NO: 14062 - RNA, 19 nt, artificial
  Chemically synthesized
uucugucccuuuccuuucu

SEQ ID NO: 14063 - RNA, 19 nt, artificial
  Chemically synthesized
acugaugcacugcuggaug

SEQ ID NO: 14064 - RNA, 19 nt, artificial
  Chemically synthesized
cuaacuuugcagauccuug

SEQ ID NO: 14065 - RNA, 19 nt, artificial
  Chemically synthesized
auaguccuaaugaaacuga

SEQ ID NO: 14066 - RNA, 19 nt, artificial
  Chemically synthesized
ugaaguuguggagaggcga

SEQ ID NO: 14067 - RNA, 19 nt, artificial
  Chemically synthesized
aagagcgugugcgucaaag

SEQ ID NO: 14068 - RNA, 19 nt, artificial
  Chemically synthesized
uaacuugacaaagagcuuu

SEQ ID NO: 14069 - RNA, 19 nt, artificial
  Chemically synthesized
uccuuuucuuucuugccau

SEQ ID NO: 14070 - RNA, 19 nt, artificial
  Chemically synthesized
acagagcuaguacuuugcc

SEQ ID NO: 14071 - RNA, 19 nt, artificial
  Chemically synthesized
caagucuucucaacucaga

SEQ ID NO: 14072 - RNA, 19 nt, artificial
  Chemically synthesized
cuuauaccaaugcacugcu

SEQ ID NO: 14073 - RNA, 19 nt, artificial
  Chemically synthesized
auuaaaaugucugcagccu

SEQ ID NO: 14074 - RNA, 19 nt, artificial
  Chemically synthesized
ucaguuaccgagcugccuu

SEQ ID NO: 14075 - RNA, 19 nt, artificial
  Chemically synthesized
cagaaaugcuuguuaaucu

SEQ ID NO: 14076 - RNA, 19 nt, Artificial Sequence
  Chemically synthesized
aauagccucugguggacac

SEQ ID NO: 14077 - RNA, 19 nt, artificial
  Chemically synthesized
ccauggcccaccaccauca

SEQ ID NO: 14078 - RNA, 19 nt, artificial
  Chemically synthesized
gcuuuugaaaaacaaggau

SEQ ID NO: 14079 - RNA, 19 nt, artificial
  Chemically synthesized
gaggcuauuuaauucaugc

SEQ ID NO: 14080 - RNA, 19 nt, artificial
  Chemically synthesized
agggacagaagucuugcaa

SEQ ID NO: 14081 - RNA, 19 nt, artificial
  Chemically synthesized
gacagaagucuugcaauag

SEQ ID NO: 14082 - RNA, 19 nt, artificial
  Chemically synthesized
uccucuucauuuucuccua

SEQ ID NO: 14083 - RNA, 19 nt, artificial
  Chemically synthesized
ugcuuuugaaaaacaagga

SEQ ID NO: 14084 - RNA, 19 nt, artificial
  Chemically synthesized
aguggaucauuugaagaug

SEQ ID NO: 14085 - RNA, 19 nt, artificial
  Chemically synthesized
caagaggugacauuuagca

SEQ ID NO: 14086 - RNA, 19 nt, artificial
  Chemically synthesized
acccuuugggagaaguuac

SEQ ID NO: 14087 - RNA, 19 nt, artificial
  Chemically synthesized
ccuaaacuagugcuaugua

SEQ ID NO: 14088 - RNA, 19 nt, artificial
  Chemically synthesized
uucuugcaauaguaacuga

SEQ ID NO: 14089 - RNA, 19 nt, artificial
  Chemically synthesized
caaugggauguacauaagu

SEQ ID NO: 14090 - RNA, 19 nt, artificial
  Chemically synthesized
guuacauuucuggagguga

SEQ ID NO: 14091 - RNA, 19 nt, artificial
  Chemically synthesized
cuauucuugucacccuuug

SEQ ID NO: 14092 - RNA, 19 nt, artificial
  Chemically synthesized
aggaaguuuucuucuggau

SEQ ID NO: 14093 - RNA, 19 nt, artificial
  Chemically synthesized
uaaagcuauuugagacaca

SEQ ID NO: 14094 - RNA, 19 nt, artificial
  Chemically synthesized
uauugcaaaugacagugga

SEQ ID NO: 14095 - RNA, 19 nt, artificial
  Chemically synthesized
caguuuguaggaguuuggu

SEQ ID NO: 14096 - RNA, 19 nt, artificial
  Chemically synthesized
aucucagauuauggcaaga

SEQ ID NO: 14097 - RNA, 19 nt, artificial
  Chemically synthesized
cucuuugucaaguuaguga

SEQ ID NO: 14098 - RNA, 19 nt, artificial
  Chemically synthesized
ugaauguaugcaaugggau

SEQ ID NO: 14099 - RNA, 19 nt, artificial
  Chemically synthesized
agaguauucugcugaaacc

SEQ ID NO: 14100 - RNA, 19 nt, artificial
  Chemically synthesized
uaugcaaugggauguacau

SEQ ID NO: 14101 - RNA, 19 nt, artificial
  Chemically synthesized
ccauuuagaaguuuccugg

SEQ ID NO: 14102 - RNA, 19 nt, artificial
  Chemically synthesized
cagauccacaaaggaacaa

SEQ ID NO: 14103 - RNA, 19 nt, artificial
  Chemically synthesized
acauuuauauagugcaccu

SEQ ID NO: 14104 - RNA, 19 nt, artificial
  Chemically synthesized
ccuuugggagaaguuacau

SEQ ID NO: 14105 - RNA, 19 nt, artificial
  Chemically synthesized
accagaggcuauuuaauuc

SEQ ID NO: 14106 - RNA, 19 nt, artificial
  Chemically synthesized
uucuggaggugaugaagca

SEQ ID NO: 14107 - RNA, 19 nt, artificial
  Chemically synthesized
acuucauuucucuacugug

SEQ ID NO: 14108 - RNA, 19 nt, artificial
  Chemically synthesized
cuugcaauaggcugcagac

SEQ ID NO: 14109 - RNA, 19 nt, artificial
  Chemically synthesized
agaggcuauuuaauucaug

SEQ ID NO: 14110 - RNA, 19 nt, artificial
  Chemically synthesized
ucacccuuugggagaaguu

SEQ ID NO: 14111 - RNA, 19 nt, artificial
  Chemically synthesized
ccugaagguagccauacag

SEQ ID NO: 14112 - RNA, 19 nt, artificial
  Chemically synthesized
augccaacuugaaaacucu

SEQ ID NO: 14113 - RNA, 19 nt, artificial
  Chemically synthesized
augcaacaucuauucuugu

SEQ ID NO: 14114 - RNA, 19 nt, artificial
  Chemically synthesized
aguaacugaauguccucca

SEQ ID NO: 14115 - RNA, 19 nt, artificial
  Chemically synthesized
aauaguaacugaauguccu

SEQ ID NO: 14116 - RNA, 19 nt, artificial
  Chemically synthesized
gccuaaacuagugcuaugu

SEQ ID NO: 14117 - RNA, 19 nt, artificial
  Chemically synthesized
guggaucauuugaagaugc

SEQ ID NO: 14118 - RNA, 19 nt, artificial
  Chemically synthesized
aggugaugaagcaaggagg

SEQ ID NO: 14119 - RNA, 19 nt, artificial
  Chemically synthesized
cauccuccauggcccacca

SEQ ID NO: 14120 - RNA, 19 nt, artificial
  Chemically synthesized
auaggcugcagacauuuua

SEQ ID NO: 14121 - RNA, 19 nt, artificial
  Chemically synthesized
ugcaagagucuuuacauac

SEQ ID NO: 14122 - RNA, 19 nt, artificial
  Chemically synthesized
augccgacagauccacaaa

SEQ ID NO: 14123 - RNA, 19 nt, artificial
  Chemically synthesized
agagagagugagagagucg

SEQ ID NO: 14124 - RNA, 19 nt, artificial
  Chemically synthesized
ugagacacaaaccucacga

SEQ ID NO: 14125 - RNA, 19 nt, artificial
  Chemically synthesized
uaauucaugccaacuugaa

SEQ ID NO: 14126 - RNA, 19 nt, artificial
  Chemically synthesized
ucgauuucguuuaaugaca

SEQ ID NO: 14127 - RNA, 19 nt, artificial
  Chemically synthesized
gugccugagcuuaggaagu

SEQ ID NO: 14128 - RNA, 19 nt, artificial
  Chemically synthesized
agcucgguaacugacauca

SEQ ID NO: 14129 - RNA, 19 nt, artificial
  Chemically synthesized
acauuucuggaggugauga

SEQ ID NO: 14130 - RNA, 19 nt, artificial
  Chemically synthesized
agccauacagaugccgaca

SEQ ID NO: 14131 - RNA, 19 nt, artificial
  Chemically synthesized
ucuacuguguggagaaagc

SEQ ID NO: 14132 - RNA, 19 nt, artificial
  Chemically synthesized
ccucucuccaccucucucu

SEQ ID NO: 14133 - RNA, 19 nt, artificial
  Chemically synthesized
accucugcacccugaaggu

SEQ ID NO: 14134 - RNA, 19 nt, artificial
  Chemically synthesized
uaaccuuuuucuaugcaag

SEQ ID NO: 14135 - RNA, 19 nt, artificial
  Chemically synthesized
cucugcacccugaagguag

SEQ ID NO: 14136 - RNA, 19 nt, artificial
  Chemically synthesized
auguaugcaaugggaugua

SEQ ID NO: 14137 - RNA, 19 nt, artificial
  Chemically synthesized
ucucagauuauggcaagaa

SEQ ID NO: 14138 - RNA, 19 nt, artificial
  Chemically synthesized
acuguaccuagucuuuuuu

SEQ ID NO: 14139 - RNA, 19 nt, artificial
  Chemically synthesized
ggugaugaagcaaggaggg

SEQ ID NO: 14140 - RNA, 19 nt, artificial
  Chemically synthesized
agaugaauguaugcaaugg

SEQ ID NO: 14141 - RNA, 19 nt, artificial
  Chemically synthesized
ggagaaguuacauuucugg

SEQ ID NO: 14142 - RNA, 19 nt, artificial
  Chemically synthesized
ucuggaggugaugaagcaa

SEQ ID NO: 14143 - RNA, 19 nt, artificial
  Chemically synthesized
aauuacuguaccuagucuu

SEQ ID NO: 14144 - RNA, 19 nt, artificial
  Chemically synthesized
caauaguaacugaaugucc

SEQ ID NO: 14145 - RNA, 19 nt, artificial
  Chemically synthesized
guccaguccucagcagacc

SEQ ID NO: 14146 - RNA, 19 nt, artificial
  Chemically synthesized
accauccagcagugcauca

SEQ ID NO: 14147 - RNA, 19 nt, artificial
  Chemically synthesized
agacaugccaagaggugac

SEQ ID NO: 14148 - RNA, 19 nt, artificial
  Chemically synthesized
ggcugcacacagcuucccu

SEQ ID NO: 14149 - RNA, 19 nt, artificial
  Chemically synthesized
gaaauauugcaaaugacag

SEQ ID NO: 14150 - RNA, 19 nt, artificial
  Chemically synthesized
ucagauuauggcaagaaag

SEQ ID NO: 14151 - RNA, 19 nt, artificial
  Chemically synthesized
uguggagaaagcaauaaac

SEQ ID NO: 14152 - RNA, 19 nt, artificial
  Chemically synthesized
uucucucccuuuuuuguuu

SEQ ID NO: 14153 - RNA, 19 nt, artificial
  Chemically synthesized
uguggaggauagguuaaga

SEQ ID NO: 14154 - RNA, 19 nt, artificial
  Chemically synthesized
agaagucuugcaauaggcu

SEQ ID NO: 14155 - RNA, 19 nt, artificial
  Chemically synthesized
cagaagucuugcaauaggc

SEQ ID NO: 14156 - RNA, 19 nt, artificial
  Chemically synthesized
agcugaaauauugcaaaug

SEQ ID NO: 14157 - RNA, 19 nt, artificial
  Chemically synthesized
gcugcagacauuuuaauac

SEQ ID NO: 14158 - RNA, 19 nt, artificial
  Chemically synthesized
guagccauacagaugccga

SEQ ID NO: 14159 - RNA, 19 nt, artificial
  Chemically synthesized
cugcacacagcuucccucu

SEQ ID NO: 14160 - RNA, 19 nt, artificial
  Chemically synthesized
ugcaacaucuauucuuguc

SEQ ID NO: 14161 - RNA, 19 nt, artificial
  Chemically synthesized
uagaaguuuccuggaaaau

SEQ ID NO: 14162 - RNA, 19 nt, artificial
  Chemically synthesized
acagaaguuggagcuuuuu

SEQ ID NO: 14163 - RNA, 19 nt, artificial
  Chemically synthesized
cauuucucuacugugugga

SEQ ID NO: 14164 - RNA, 19 nt, artificial
  Chemically synthesized
accauuuagaaguuuccug

SEQ ID NO: 14165 - RNA, 19 nt, artificial
  Chemically synthesized
uggaucauuugaagaugcu

SEQ ID NO: 14166 - RNA, 19 nt, artificial
  Chemically synthesized
gcuuaggaaguuuucuucu

SEQ ID NO: 14167 - RNA, 19 nt, artificial
  Chemically synthesized
gucaaguuagugauugcau

SEQ ID NO: 14168 - RNA, 19 nt, artificial
  Chemically synthesized
cauacagaugccgacagau

SEQ ID NO: 14169 - RNA, 19 nt, artificial
  Chemically synthesized
gacaugccaagaggugaca

SEQ ID NO: 14170 - RNA, 19 nt, artificial
  Chemically synthesized
uggaggugaugaagcaagg

SEQ ID NO: 14171 - RNA, 19 nt, artificial
  Chemically synthesized
gcaauaguaacugaauguc

SEQ ID NO: 14172 - RNA, 19 nt, artificial
  Chemically synthesized
ccaccucucuccaccucuc

SEQ ID NO: 14173 - RNA, 19 nt, artificial
  Chemically synthesized
uagugcaccuaugagcagu

SEQ ID NO: 14174 - RNA, 19 nt, artificial
  Chemically synthesized
acgagaccaucgacguggg

SEQ ID NO: 14175 - RNA, 19 nt, artificial
  Chemically synthesized
aggugacauuuagcagugc

SEQ ID NO: 14176 - RNA, 19 nt, artificial
  Chemically synthesized
gugaugaagcaaggaggga

SEQ ID NO: 14177 - RNA, 19 nt, artificial
  Chemically synthesized
agaugccgacagauccaca

SEQ ID NO: 14178 - RNA, 19 nt, artificial
  Chemically synthesized
uuaauucaugccaacuuga

SEQ ID NO: 14179 - RNA, 19 nt, artificial
  Chemically synthesized
ugaauguccuccauuucag

SEQ ID NO: 14180 - RNA, 19 nt, artificial
  Chemically synthesized
aauaggcugcagacauuuu

SEQ ID NO: 14181 - RNA, 19 nt, artificial
  Chemically synthesized
guacagacaugccaagagg

SEQ ID NO: 14182 - RNA, 19 nt, artificial
  Chemically synthesized
ccaagaggugacauuuagc

SEQ ID NO: 14183 - RNA, 19 nt, artificial
  Chemically synthesized
aauguaugcaaugggaugu

SEQ ID NO: 14184 - RNA, 19 nt, artificial
  Chemically synthesized
cuuuugaaaaacaaggauc

SEQ ID NO: 14185 - RNA, 19 nt, artificial
  Chemically synthesized
ucuuugucaaguuagugau

SEQ ID NO: 14186 - RNA, 19 nt, artificial
  Chemically synthesized
cacacagcuucccucuguc

SEQ ID NO: 14187 - RNA, 19 nt, artificial
  Chemically synthesized
ccuuacauuuauauagugc

SEQ ID NO: 14188 - RNA, 19 nt, artificial
  Chemically synthesized
uuuucuaugcaagagucuu

SEQ ID NO: 14189 - RNA, 19 nt, artificial
  Chemically synthesized
gccaccucucuccaccucu

SEQ ID NO: 14190 - RNA, 19 nt, artificial
  Chemically synthesized
cuggaggugaugaagcaag

SEQ ID NO: 14191 - RNA, 19 nt, artificial
  Chemically synthesized
uuuagcagugcauugguau

SEQ ID NO: 14192 - RNA, 19 nt, artificial
  Chemically synthesized
cuuaaaaccucugcacccu

SEQ ID NO: 14193 - RNA, 19 nt, artificial
  Chemically synthesized
cagcuucccucuguccuuc

SEQ ID NO: 14194 - RNA, 19 nt, artificial
  Chemically synthesized
agucuugcaauaggcugca

SEQ ID NO: 14195 - RNA, 19 nt, artificial
  Chemically synthesized
aaauuacuguaccuagucu

SEQ ID NO: 14196 - RNA, 19 nt, artificial
  Chemically synthesized
cugcagacauuuuaauacc

SEQ ID NO: 14197 - RNA, 19 nt, artificial
  Chemically synthesized
ugacauccuccauggccca

SEQ ID NO: 14198 - RNA, 19 nt, artificial
  Chemically synthesized
ugaaaacuucacacuuguu

SEQ ID NO: 14199 - RNA, 19 nt, artificial
  Chemically synthesized
gugcaccuaugagcaguug

SEQ ID NO: 14200 - RNA, 19 nt, artificial
  Chemically synthesized
uuauauagugcaccuauga

SEQ ID NO: 14201 - RNA, 19 nt, artificial
  Chemically synthesized
gugccaccucucuccaccu

SEQ ID NO: 14202 - RNA, 19 nt, artificial
  Chemically synthesized
gaugaagcaaggagggagc

SEQ ID NO: 14203 - RNA, 19 nt, artificial
  Chemically synthesized
uaacugaauguccuccauu

SEQ ID NO: 14204 - RNA, 19 nt, artificial
  Chemically synthesized
gcagcccugcuccagccca

SEQ ID NO: 14205 - RNA, 19 nt, artificial
  Chemically synthesized
uugcaauaguaacugaaug

SEQ ID NO: 14206 - RNA, 19 nt, artificial
  Chemically synthesized
uuucucuacuguguggaga

SEQ ID NO: 14207 - RNA, 19 nt, artificial
  Chemically synthesized
cuugaacuucuugcaauag

SEQ ID NO: 14208 - RNA, 19 nt, artificial
  Chemically synthesized
ccacuaauuaaaugaaguc

SEQ ID NO: 14209 - RNA, 19 nt, artificial
  Chemically synthesized
gcuacaauuuuuaaagcuc

SEQ ID NO: 14210 - RNA, 19 nt, artificial
  Chemically synthesized
uugcaauaggcugcagaca

SEQ ID NO: 14211 - RNA, 19 nt, artificial
  Chemically synthesized
acauuuuaauaccaugcca

SEQ ID NO: 14212 - RNA, 19 nt, artificial
  Chemically synthesized
auuuuaauaccaugccaga

SEQ ID NO: 14213 - RNA, 19 nt, artificial
  Chemically synthesized
accuuuuucuaugcaagag

SEQ ID NO: 14214 - RNA, 19 nt, artificial
  Chemically synthesized
acugaauguccuccauuuc

SEQ ID NO: 14215 - RNA, 19 nt, artificial
  Chemically synthesized
uaaagcucuuugucaaguu

SEQ ID NO: 14216 - RNA, 19 nt, artificial
  Chemically synthesized
acagaagucuugcaauagg

SEQ ID NO: 14217 - RNA, 19 nt, artificial
  Chemically synthesized
gacgagaccaucgacgugg

SEQ ID NO: 14218 - RNA, 19 nt, artificial
  Chemically synthesized
uguaaccuuuuucuaugca

SEQ ID NO: 14219 - RNA, 19 nt, artificial
  Chemically synthesized
cuccauggcccaccaccau

SEQ ID NO: 14220 - RNA, 19 nt, artificial
  Chemically synthesized
ucuaugcaagagucuuuac

SEQ ID NO: 14221 - RNA, 19 nt, artificial
  Chemically synthesized
uaccauuuagaaguuuccu

SEQ ID NO: 14222 - RNA, 19 nt, artificial
  Chemically synthesized
gauuaacaagcauuucugc

SEQ ID NO: 14223 - RNA, 19 nt, artificial
  Chemically synthesized
uuucuugaacuucuugcaa

SEQ ID NO: 14224 - RNA, 19 nt, artificial
  Chemically synthesized
uuuaauucaugccaacuug

SEQ ID NO: 14225 - RNA, 19 nt, artificial
  Chemically synthesized
agaaguuacauuucuggag

SEQ ID NO: 14226 - RNA, 19 nt, artificial
  Chemically synthesized
aaaaccucugcacccugaa

SEQ ID NO: 14227 - RNA, 19 nt, artificial
  Chemically synthesized
uugaacuucuugcaauagu

SEQ ID NO: 14228 - RNA, 19 nt, artificial
  Chemically synthesized
cccugcgugccaccucucu

SEQ ID NO: 14229 - RNA, 19 nt, artificial
  Chemically synthesized
aaugacaguggaucauuug

SEQ ID NO: 14230 - RNA, 19 nt, artificial
  Chemically synthesized
cauaaguuauuuuugccca

SEQ ID NO: 14231 - RNA, 19 nt, artificial
  Chemically synthesized
aacuucuugcaauaguaac

SEQ ID NO: 14232 - RNA, 19 nt, artificial
  Chemically synthesized
uuuucuugaacuucuugca

SEQ ID NO: 14233 - RNA, 19 nt, artificial
  Chemically synthesized
acauuuagcagugcauugg

SEQ ID NO: 14234 - RNA, 19 nt, artificial
  Chemically synthesized
cacagcuucccucuguccu

SEQ ID NO: 14235 - RNA, 19 nt, artificial
  Chemically synthesized
acagaugccgacagaucca

SEQ ID NO: 14236 - RNA, 19 nt, artificial
  Chemically synthesized
ugaugaagcaaggagggag

SEQ ID NO: 14237 - RNA, 19 nt, artificial
  Chemically synthesized
cggcucugcucuccucacg

SEQ ID NO: 14238 - RNA, 19 nt, artificial
  Chemically synthesized
ucauuucucuacugugugg

SEQ ID NO: 14239 - RNA, 19 nt, artificial
  Chemically synthesized
uuuauauagugcaccuaug

SEQ ID NO: 14240 - RNA, 19 nt, artificial
  Chemically synthesized
uacagacaugccaagaggu

SEQ ID NO: 14241 - RNA, 19 nt, artificial
  Chemically synthesized
uaacaagcauuucugcucu

SEQ ID NO: 14242 - RNA, 19 nt, artificial
  Chemically synthesized
gaugaauguaugcaauggg

SEQ ID NO: 14243 - RNA, 19 nt, artificial
  Chemically synthesized
cuuaggaaguuuucuucug

SEQ ID NO: 14244 - RNA, 19 nt, artificial
  Chemically synthesized
uauuugagacacaaaccuc

SEQ ID NO: 14245 - RNA, 19 nt, artificial
  Chemically synthesized
cauuucugcucugccugca

SEQ ID NO: 14246 - RNA, 19 nt, artificial
  Chemically synthesized
uuaugcacuucauuucucu

SEQ ID NO: 14247 - RNA, 19 nt, artificial
  Chemically synthesized
ucuugcaauaggcugcaga

SEQ ID NO: 14248 - RNA, 19 nt, artificial
  Chemically synthesized
caugccaacuugaaaacuc

SEQ ID NO: 14249 - RNA, 19 nt, artificial
  Chemically synthesized
gaggugaugaagcaaggag

SEQ ID NO: 14250 - RNA, 19 nt, artificial
  Chemically synthesized
agacauuuuaauaccaugc

SEQ ID NO: 14251 - RNA, 19 nt, artificial
  Chemically synthesized
caagaaagaaaaggagagg

SEQ ID NO: 14252 - RNA, 19 nt, artificial
  Chemically synthesized
gcugcacacagcuucccuc

SEQ ID NO: 14253 - RNA, 19 nt, artificial
  Chemically synthesized
uauagugcaccuaugagca

SEQ ID NO: 14254 - RNA, 19 nt, artificial
  Chemically synthesized
gcuuaaaaccucugcaccc

SEQ ID NO: 14255 - RNA, 19 nt, artificial
  Chemically synthesized
uaggaaguuuucuucugga

SEQ ID NO: 14256 - RNA, 19 nt, artificial
  Chemically synthesized
caccucucuccaccucucu

SEQ ID NO: 14257 - RNA, 19 nt, artificial
  Chemically synthesized
ucagauuaacaagcauuuc

SEQ ID NO: 14258 - RNA, 19 nt, artificial
  Chemically synthesized
aaguuacauuucuggaggu

SEQ ID NO: 14259 - RNA, 19 nt, artificial
  Chemically synthesized
acaaaggaacaauaaagcu

SEQ ID NO: 14260 - RNA, 19 nt, artificial
  Chemically synthesized
uaaaaugcccugacugaau

SEQ ID NO: 14261 - RNA, 19 nt, artificial
  Chemically synthesized
ccauccagcagugcaucag

SEQ ID NO: 14262 - RNA, 19 nt, artificial
  Chemically synthesized
cacaaaggaacaauaaagc

SEQ ID NO: 14263 - RNA, 19 nt, artificial
  Chemically synthesized
auuucuggaggugaugaag

SEQ ID NO: 14264 - RNA, 19 nt, artificial
  Chemically synthesized
agcuuaggaaguuuucuuc

SEQ ID NO: 14265 - RNA, 19 nt, artificial
  Chemically synthesized
uugcauuacuuuguaaccu

SEQ ID NO: 14266 - RNA, 19 nt, artificial
  Chemically synthesized
ucccuuuuuuguuugguuc

SEQ ID NO: 14267 - RNA, 19 nt, artificial
  Chemically synthesized
aagcauuucugcucugccu

SEQ ID NO: 14268 - RNA, 19 nt, artificial
  Chemically synthesized
gaagucuugcaauaggcug

SEQ ID NO: 14269 - RNA, 19 nt, artificial
  Chemically synthesized
cuuuugaaaacuucacacu

SEQ ID NO: 14270 - RNA, 19 nt, artificial
  Chemically synthesized
ugagcuuaggaaguuuucu

SEQ ID NO: 14271 - RNA, 19 nt, artificial
  Chemically synthesized
agcaacuuuugaaaacuuc

SEQ ID NO: 14272 - RNA, 19 nt, artificial
  Chemically synthesized
aagaugaauguaugcaaug

SEQ ID NO: 14273 - RNA, 19 nt, artificial
  Chemically synthesized
gucuugcaauaggcugcag

SEQ ID NO: 14274 - RNA, 19 nt, artificial
  Chemically synthesized
agugauugcauuugauccc

SEQ ID NO: 14275 - RNA, 19 nt, artificial
  Chemically synthesized
ugccgacagauccacaaag

SEQ ID NO: 14276 - RNA, 19 nt, artificial
  Chemically synthesized
gauggcucaaaauauggug

SEQ ID NO: 14277 - RNA, 19 nt, artificial
  Chemically synthesized
aggcuauuuaauucaugcc

SEQ ID NO: 14278 - RNA, 19 nt, artificial
  Chemically synthesized
ucagcuuaaaaccucugca

SEQ ID NO: 14279 - RNA, 19 nt, artificial
  Chemically synthesized
ucuucauuuucuccuaaug

SEQ ID NO: 14280 - RNA, 19 nt, artificial
  Chemically synthesized
uucuugucacccuuuggga

SEQ ID NO: 14281 - RNA, 19 nt, artificial
  Chemically synthesized
gcucuuugucaaguuagug

SEQ ID NO: 14282 - RNA, 19 nt, artificial
  Chemically synthesized
augcacuucauuucucuac

SEQ ID NO: 14283 - RNA, 19 nt, artificial
  Chemically synthesized
gaaguuacauuucuggagg

SEQ ID NO: 14284 - RNA, 19 nt, artificial
  Chemically synthesized
gaaauuacuguaccuaguc

SEQ ID NO: 14285 - RNA, 19 nt, artificial
  Chemically synthesized
uaaaggcuacuuugacgca

SEQ ID NO: 14286 - RNA, 19 nt, artificial
  Chemically synthesized
uugaaaacuucacacuugu

SEQ ID NO: 14287 - RNA, 19 nt, artificial
  Chemically synthesized
auaguaacugaauguccuc

SEQ ID NO: 14288 - RNA, 19 nt, artificial
  Chemically synthesized
ugucacccuuugggagaag

SEQ ID NO: 14289 - RNA, 19 nt, artificial
  Chemically synthesized
agcccugcuccagcccaac

SEQ ID NO: 14290 - RNA, 19 nt, artificial
  Chemically synthesized
ugucaaguuagugauugca

SEQ ID NO: 14291 - RNA, 19 nt, artificial
  Chemically synthesized
uggcucaaaauauggugcu

SEQ ID NO: 14292 - RNA, 19 nt, artificial
  Chemically synthesized
agcuucccucuguccuucg

SEQ ID NO: 14293 - RNA, 19 nt, artificial
  Chemically synthesized
cuucuugcaauaguaacug

SEQ ID NO: 14294 - RNA, 19 nt, artificial
  Chemically synthesized
uggcaagaaagaaaaggag

SEQ ID NO: 14295 - RNA, 19 nt, artificial
  Chemically synthesized
acccugaagguagccauac

SEQ ID NO: 14296 - RNA, 19 nt, artificial
  Chemically synthesized
uugggagaaguuacauuuc

SEQ ID NO: 14297 - RNA, 19 nt, artificial
  Chemically synthesized
uguaugcaaugggauguac

SEQ ID NO: 14298 - RNA, 19 nt, artificial
  Chemically synthesized
agugccugagcuuaggaag

SEQ ID NO: 14299 - RNA, 19 nt, artificial
  Chemically synthesized
uagagagagagugagagag

SEQ ID NO: 14300 - RNA, 19 nt, artificial
  Chemically synthesized
cugagcuuaggaaguuuuc

SEQ ID NO: 14301 - RNA, 19 nt, artificial
  Chemically synthesized
cagcuuaaaaccucugcac

SEQ ID NO: 14302 - RNA, 19 nt, artificial
  Chemically synthesized
uuguacagacaugccaaga

SEQ ID NO: 14303 - RNA, 19 nt, artificial
  Chemically synthesized
gccauacagaugccgacag

SEQ ID NO: 14304 - RNA, 19 nt, artificial
  Chemically synthesized
ucugcacccugaagguagc

SEQ ID NO: 14305 - RNA, 19 nt, artificial
  Chemically synthesized
augaagcaaggagggagca

SEQ ID NO: 14306 - RNA, 19 nt, artificial
  Chemically synthesized
aagaguauucugcugaaac

SEQ ID NO: 14307 - RNA, 19 nt, artificial
  Chemically synthesized
cagcucgguaacugacauc

SEQ ID NO: 14308 - RNA, 19 nt, artificial
  Chemically synthesized
cuucagaagugccuccugc

SEQ ID NO: 14309 - RNA, 19 nt, artificial
  Chemically synthesized
ugcaccuaugagcaguugc

SEQ ID NO: 14310 - RNA, 19 nt, artificial
  Chemically synthesized
guaagugccugagcuuagg

SEQ ID NO: 14311 - RNA, 19 nt, artificial
  Chemically synthesized
aggcagcucgguaacugac

SEQ ID NO: 14312 - RNA, 19 nt, artificial
  Chemically synthesized
auggacgagaccaucgacg

SEQ ID NO: 14313 - RNA, 19 nt, artificial
  Chemically synthesized
aacaucuauucuugucacc

SEQ ID NO: 14314 - RNA, 19 nt, artificial
  Chemically synthesized
uguacagacaugccaagag

SEQ ID NO: 14315 - RNA, 19 nt, artificial
  Chemically synthesized
guguggaggauagguuaag

SEQ ID NO: 14316 - RNA, 19 nt, artificial
  Chemically synthesized
cauggcccaccaccaucau

SEQ ID NO: 14317 - RNA, 19 nt, artificial
  Chemically synthesized
uagugauugcauuugaucc

SEQ ID NO: 14318 - RNA, 19 nt, artificial
  Chemically synthesized
uuacuguaccuagucuuuu

SEQ ID NO: 14319 - RNA, 19 nt, artificial
  Chemically synthesized
auuucucuacuguguggag

SEQ ID NO: 14320 - RNA, 19 nt, artificial
  Chemically synthesized
aagugccugagcuuaggaa

SEQ ID NO: 14321 - RNA, 19 nt, artificial
  Chemically synthesized
uauucuugucacccuuugg

SEQ ID NO: 14322 - RNA, 19 nt, artificial
  Chemically synthesized
acaugccaagaggugacau

SEQ ID NO: 14323 - RNA, 19 nt, artificial
  Chemically synthesized
agguagccauacagaugcc

SEQ ID NO: 14324 - RNA, 19 nt, artificial
  Chemically synthesized
uuguaaccuuuuucuaugc

SEQ ID NO: 14325 - RNA, 19 nt, artificial
  Chemically synthesized
agcuuaaaaccucugcacc

SEQ ID NO: 14326 - RNA, 19 nt, artificial
  Chemically synthesized
gcgugccaccucucuccac

SEQ ID NO: 14327 - RNA, 19 nt, artificial
  Chemically synthesized
uuugaaaacuucacacuug

SEQ ID NO: 14328 - RNA, 19 nt, artificial
  Chemically synthesized
gcuucccucuguccuucgc

SEQ ID NO: 14329 - RNA, 19 nt, artificial
  Chemically synthesized
uaaaaccucugcacccuga

SEQ ID NO: 14330 - RNA, 19 nt, artificial
  Chemically synthesized
uuuuucuaugcaagagucu

SEQ ID NO: 14331 - RNA, 19 nt, artificial
  Chemically synthesized
cucucccuuuuuuguuugg

SEQ ID NO: 14332 - RNA, 19 nt, artificial
  Chemically synthesized
uucauuucucuacugugug

SEQ ID NO: 14333 - RNA, 19 nt, artificial
  Chemically synthesized
ugcacccugaagguagcca

SEQ ID NO: 14334 - RNA, 19 nt, artificial
  Chemically synthesized
caacuuuugaaaacuucac

SEQ ID NO: 14335 - RNA, 19 nt, artificial
  Chemically synthesized
gcauuucugcucugccugc

SEQ ID NO: 14336 - RNA, 19 nt, artificial
  Chemically synthesized
ugcacacagcuucccucug

SEQ ID NO: 14337 - RNA, 19 nt, artificial
  Chemically synthesized
acuucagaagugccuccug

SEQ ID NO: 14338 - RNA, 19 nt, artificial
  Chemically synthesized
ccugcgugccaccucucuc

SEQ ID NO: 14339 - RNA, 19 nt, artificial
  Chemically synthesized
ugcgugccaccucucucca

SEQ ID NO: 14340 - RNA, 19 nt, artificial
  Chemically synthesized
agcauuucugcucugccug

SEQ ID NO: 14341 - RNA, 19 nt, artificial
  Chemically synthesized
uugcaaaugacaguggauc

SEQ ID NO: 14342 - RNA, 19 nt, artificial
  Chemically synthesized
uuugagacacaaaccucac

SEQ ID NO: 14343 - RNA, 19 nt, artificial
  Chemically synthesized
uuugcauuacuuuguaacc

SEQ ID NO: 14344 - RNA, 19 nt, artificial
  Chemically synthesized
auuaacaagcauuucugcu

SEQ ID NO: 14345 - RNA, 19 nt, artificial
  Chemically synthesized
aagucuugcaauaggcugc

SEQ ID NO: 14346 - RNA, 19 nt, artificial
  Chemically synthesized
auuaugcacuucauuucuc

SEQ ID NO: 14347 - RNA, 19 nt, artificial
  Chemically synthesized
uacauuucuggaggugaug

SEQ ID NO: 14348 - RNA, 19 nt, artificial
  Chemically synthesized
gaaaaggcgucgggaucgg

SEQ ID NO: 14349 - RNA, 19 nt, artificial
  Chemically synthesized
uugucaaguuagugauugc

SEQ ID NO: 14350 - RNA, 19 nt, artificial
  Chemically synthesized
cuggucaaaaugacugcug

SEQ ID NO: 14351 - RNA, 19 nt, artificial
  Chemically synthesized
acuagugcuauguaauggg

SEQ ID NO: 14352 - RNA, 19 nt, artificial
  Chemically synthesized
aagaggugacauuuagcag

SEQ ID NO: 14353 - RNA, 19 nt, artificial
  Chemically synthesized
auaaagcuauuugagacac

SEQ ID NO: 14354 - RNA, 19 nt, artificial
  Chemically synthesized
cacuaauuaaaugaagucc

SEQ ID NO: 14355 - RNA, 19 nt, artificial
  Chemically synthesized
aagguagccauacagaugc

SEQ ID NO: 14356 - RNA, 19 nt, artificial
  Chemically synthesized
cauuuuaauaccaugccag

SEQ ID NO: 14357 - RNA, 19 nt, artificial
  Chemically synthesized
uuauggcaagaaagaaaag

SEQ ID NO: 14358 - RNA, 19 nt, artificial
  Chemically synthesized
aagcucuuugucaaguuag

SEQ ID NO: 14359 - RNA, 19 nt, artificial
  Chemically synthesized
cgugccaccucucuccacc

SEQ ID NO: 14360 - RNA, 19 nt, artificial
  Chemically synthesized
ucuugucacccuuugggag

SEQ ID NO: 14361 - RNA, 19 nt, artificial
  Chemically synthesized
cugcgugccaccucucucc

SEQ ID NO: 14362 - RNA, 19 nt, artificial
  Chemically synthesized
aacuagugcuauguaaugg

SEQ ID NO: 14363 - RNA, 19 nt, artificial
  Chemically synthesized
acagacaugccaagaggug

SEQ ID NO: 14364 - RNA, 19 nt, artificial
  Chemically synthesized
aauauugcaaaugacagug

SEQ ID NO: 14365 - RNA, 19 nt, artificial
  Chemically synthesized
acaucuauucuugucaccc

SEQ ID NO: 14366 - RNA, 19 nt, artificial
  Chemically synthesized
aaaugaaguccuuuuugac

SEQ ID NO: 14367 - RNA, 19 nt, artificial
  Chemically synthesized
uugagacacaaaccucacg

SEQ ID NO: 14368 - RNA, 19 nt, artificial
  Chemically synthesized
augacauccuccauggccc

SEQ ID NO: 14369 - RNA, 19 nt, artificial
  Chemically synthesized
aguuacauuucuggaggug

SEQ ID NO: 14370 - RNA, 19 nt, artificial
  Chemically synthesized
aaaccucugcacccugaag

SEQ ID NO: 14371 - RNA, 19 nt, artificial
  Chemically synthesized
ucucucccuuuuuuguuug

SEQ ID NO: 14372 - RNA, 19 nt, artificial
  Chemically synthesized
aacaagcauuucugcucug

SEQ ID NO: 14373 - RNA, 19 nt, artificial
  Chemically synthesized
accucucuccaccucucuc

SEQ ID NO: 14374 - RNA, 19 nt, artificial
  Chemically synthesized
auauugcaaaugacagugg

SEQ ID NO: 14375 - RNA, 19 nt, artificial
  Chemically synthesized
auacagaugccgacagauc

SEQ ID NO: 14376 - RNA, 19 nt, artificial
  Chemically synthesized
uagccauacagaugccgac

SEQ ID NO: 14377 - RNA, 19 nt, artificial
  Chemically synthesized
agucagcuuaaaaccucug

SEQ ID NO: 14378 - RNA, 19 nt, artificial
  Chemically synthesized
uaccauccagcagugcauc

SEQ ID NO: 14379 - RNA, 19 nt, artificial
  Chemically synthesized
uuaacaagcauuucugcuc

SEQ ID NO: 14380 - RNA, 19 nt, artificial
  Chemically synthesized
auauagugcaccuaugagc

SEQ ID NO: 14381 - RNA, 19 nt, artificial
  Chemically synthesized
acacagcuucccucugucc

SEQ ID NO: 14382 - RNA, 19 nt, artificial
  Chemically synthesized
gguagccauacagaugccg

SEQ ID NO: 14383 - RNA, 19 nt, artificial
  Chemically synthesized
uuagugauugcauuugauc

SEQ ID NO: 14384 - RNA, 19 nt, artificial
  Chemically synthesized
aaaugcccugacugaauuc

SEQ ID NO: 14385 - RNA, 19 nt, artificial
  Chemically synthesized
uaaaagauaagagacacag

SEQ ID NO: 14386 - RNA, 19 nt, artificial
  Chemically synthesized
aaguuagugauugcauuug

SEQ ID NO: 14387 - RNA, 19 nt, artificial
  Chemically synthesized
ucaugccaacuugaaaacu

SEQ ID NO: 14388 - RNA, 19 nt, artificial
  Chemically synthesized
uuugaaaaacaaggaucug

SEQ ID NO: 14389 - RNA, 19 nt, artificial
  Chemically synthesized
auagugcaccuaugagcag

SEQ ID NO: 14390 - RNA, 19 nt, artificial
  Chemically synthesized
ugaagcaaggagggagcac

SEQ ID NO: 14391 - RNA, 19 nt, artificial
  Chemically synthesized
aagaaagaaaaggagaggg

SEQ ID NO: 14392 - RNA, 19 nt, artificial
  Chemically synthesized
ucucccuuuuuuguuuggu

SEQ ID NO: 14393 - RNA, 19 nt, artificial
  Chemically synthesized
uuuaaagcucuuugucaag

SEQ ID NO: 14394 - RNA, 19 nt, artificial
  Chemically synthesized
cuucccucuguccuucgcg

SEQ ID NO: 14395 - RNA, 19 nt, artificial
  Chemically synthesized
aaccucugcacccugaagg

SEQ ID NO: 14396 - RNA, 19 nt, artificial
  Chemically synthesized
cagaugccgacagauccac

SEQ ID NO: 14397 - RNA, 19 nt, artificial
  Chemically synthesized
auggcucaaaauauggugc

SEQ ID NO: 14398 - RNA, 19 nt, artificial
  Chemically synthesized
uacagaugccgacagaucc

SEQ ID NO: 14399 - RNA, 19 nt, artificial
  Chemically synthesized
uucgauuucguuuaaugac

SEQ ID NO: 14400 - RNA, 19 nt, artificial
  Chemically synthesized
uuaaagcucuuugucaagu

SEQ ID NO: 14401 - RNA, 19 nt, artificial
  Chemically synthesized
caagcauuucugcucugcc

SEQ ID NO: 14402 - RNA, 19 nt, artificial
  Chemically synthesized
gacauuuuaauaccaugcc

SEQ ID NO: 14403 - RNA, 19 nt, artificial
  Chemically synthesized
uauauagugcaccuaugag

SEQ ID NO: 14404 - RNA, 19 nt, artificial
  Chemically synthesized
uaagugccugagcuuagga

SEQ ID NO: 14405 - RNA, 19 nt, artificial
  Chemically synthesized
uuucuggaggugaugaagc

SEQ ID NO: 14406 - RNA, 19 nt, artificial
  Chemically synthesized
uucaugccaacuugaaaac

SEQ ID NO: 14407 - RNA, 19 nt, artificial
  Chemically synthesized
acuuuugaaaacuucacac

SEQ ID NO: 14408 - RNA, 19 nt, artificial
  Chemically synthesized
uauggcaagaaagaaaagg

SEQ ID NO: 14409 - RNA, 19 nt, artificial
  Chemically synthesized
uugaaaaacaaggaucugc

SEQ ID NO: 14410 - RNA, 19 nt, artificial
  Chemically synthesized
gucagcuuaaaaccucugc

SEQ ID NO: 14411 - RNA, 19 nt, artificial
  Chemically synthesized
uucagaagugccuccugcc

SEQ ID NO: 14412 - RNA, 19 nt, artificial
  Chemically synthesized
uuaggaaguuuucuucugg

SEQ ID NO: 14413 - RNA, 19 nt, artificial
  Chemically synthesized
uuugucaaguuagugauug

SEQ ID NO: 14414 - RNA, 19 nt, artificial
  Chemically synthesized
auucuugucacccuuuggg

SEQ ID NO: 14415 - RNA, 19 nt, artificial
  Chemically synthesized
caugacauccuccauggcc

SEQ ID NO: 14416 - RNA, 19 nt, artificial
  Chemically synthesized
auuucugcucugccugcag

SEQ ID NO: 14417 - RNA, 19 nt, artificial
  Chemically synthesized
acaagcauuucugcucugc

SEQ ID NO: 14418 - RNA, 19 nt, artificial
  Chemically synthesized
ugccaccucucuccaccuc

SEQ ID NO: 14419 - RNA, 19 nt, artificial
  Chemically synthesized
uuauccucuucauuuucuc

SEQ ID NO: 14420 - RNA, 19 nt, artificial
  Chemically synthesized
auaugcugaaaucaagcac

SEQ ID NO: 14421 - RNA, 19 nt, artificial
  Chemically synthesized
auccucuucauuuucuccu

SEQ ID NO: 14422 - RNA, 19 nt, artificial
  Chemically synthesized
cugcacccugaagguagcc

SEQ ID NO: 14423 - RNA, 19 nt, artificial
  Chemically synthesized
uacauuuauauagugcacc

SEQ ID NO: 14424 - RNA, 19 nt, artificial
  Chemically synthesized
uccauggcccaccaccauc

SEQ ID NO: 14425 - RNA, 19 nt, artificial
  Chemically synthesized
gacauccuccauggcccac

SEQ ID NO: 14426 - RNA, 19 nt, artificial
  Chemically synthesized
uaguaacugaauguccucc

SEQ ID NO: 14427 - RNA, 19 nt, artificial
  Chemically synthesized
aaaccuuaccgacccuggg

SEQ ID NO: 14428 - RNA, 19 nt, artificial
  Chemically synthesized
uaaguuauuuuugcccaug

SEQ ID NO: 14429 - RNA, 19 nt, artificial
  Chemically synthesized
acauccuccauggcccacc

SEQ ID NO: 14430 - RNA, 19 nt, artificial
  Chemically synthesized
uccuccauggcccaccacc

SEQ ID NO: 14431 - RNA, 19 nt, artificial
  Chemically synthesized
uuuuucuugaacuucuugc

SEQ ID NO: 14432 - RNA, 19 nt, artificial
  Chemically synthesized
uuaaaaccucugcacccug

SEQ ID NO: 14433 - RNA, 19 nt, artificial
  Chemically synthesized
uuuuaauaccaugccagag

SEQ ID NO: 14434 - RNA, 19 nt, artificial
  Chemically synthesized
uauccucuucauuuucucc

SEQ ID NO: 14435 - RNA, 19 nt, artificial
  Chemically synthesized
auccuccauggcccaccac

SEQ ID NO: 14436 - RNA, 19 nt, artificial
  Chemically synthesized
uaaaccuuaccgacccugg

SEQ ID NO: 14437 - RNA, 19 nt, artificial
  Chemically synthesized
acauaaguuauuuuugccc

SEQ ID NO: 14438 - RNA, 19 nt, artificial
  Chemically synthesized
auaaaccuuaccgacccug

SEQ ID NO: 14439 - RNA, 19 nt, artificial
  Chemically synthesized
ugaugguggugggccaugg

SEQ ID NO: 14440 - RNA, 19 nt, artificial
  Chemically synthesized
auccuuguuuuucaaaagc

SEQ ID NO: 14441 - RNA, 19 nt, artificial
  Chemically synthesized
gcaugaauuaaauagccuc

SEQ ID NO: 14442 - RNA, 19 nt, artificial
  Chemically synthesized
uugcaagacuucugucccu

SEQ ID NO: 14443 - RNA, 19 nt, artificial
  Chemically synthesized
cuauugcaagacuucuguc

SEQ ID NO: 14444 - RNA, 19 nt, artificial
  Chemically synthesized
uaggagaaaaugaagagga

SEQ ID NO: 14445 - RNA, 19 nt, artificial
  Chemically synthesized
uccuuguuuuucaaaagca

SEQ ID NO: 14446 - RNA, 19 nt, artificial
  Chemically synthesized
caucuucaaaugauccacu

SEQ ID NO: 14447 - RNA, 19 nt, artificial
  Chemically synthesized
ugcuaaaugucaccucuug

SEQ ID NO: 14448 - RNA, 19 nt, artificial
  Chemically synthesized
guaacuucucccaaagggu

SEQ ID NO: 14449 - RNA, 19 nt, artificial
  Chemically synthesized
uacauagcacuaguuuagg

SEQ ID NO: 14450 - RNA, 19 nt, artificial
  Chemically synthesized
ucaguuacuauugcaagaa

SEQ ID NO: 14451 - RNA, 19 nt, artificial
  Chemically synthesized
acuuauguacaucccauug

SEQ ID NO: 14452 - RNA, 19 nt, artificial
  Chemically synthesized
ucaccuccagaaauguaac

SEQ ID NO: 14453 - RNA, 19 nt, artificial
  Chemically synthesized
caaagggugacaagaauag

SEQ ID NO: 14454 - RNA, 19 nt, artificial
  Chemically synthesized
auccagaagaaaacuuccu

SEQ ID NO: 14455 - RNA, 19 nt, artificial
  Chemically synthesized
ugugucucaaauagcuuua

SEQ ID NO: 14456 - RNA, 19 nt, artificial
  Chemically synthesized
uccacugucauuugcaaua

SEQ ID NO: 14457 - RNA, 19 nt, artificial
  Chemically synthesized
accaaacuccuacaaacug

SEQ ID NO: 14458 - RNA, 19 nt, artificial
  Chemically synthesized
ucuugccauaaucugagau

SEQ ID NO: 14459 - RNA, 19 nt, artificial
  Chemically synthesized
ucacuaacuugacaaagag

SEQ ID NO: 14460 - RNA, 19 nt, artificial
  Chemically synthesized
aucccauugcauacauuca

SEQ ID NO: 14461 - RNA, 19 nt, artificial
  Chemically synthesized
gguuucagcagaauacucu

SEQ ID NO: 14462 - RNA, 19 nt, artificial
  Chemically synthesized
auguacaucccauugcaua

SEQ ID NO: 14463 - RNA, 19 nt, artificial
  Chemically synthesized
ccaggaaacuucuaaaugg

SEQ ID NO: 14464 - RNA, 19 nt, artificial
  Chemically synthesized
uuguuccuuuguggaucug

SEQ ID NO: 14465 - RNA, 19 nt, artificial
  Chemically synthesized
aggugcacuauauaaaugu

SEQ ID NO: 14466 - RNA, 19 nt, artificial
  Chemically synthesized
auguaacuucucccaaagg

SEQ ID NO: 14467 - RNA, 19 nt, artificial
  Chemically synthesized
gaauuaaauagccucuggu

SEQ ID NO: 14468 - RNA, 19 nt, artificial
  Chemically synthesized
ugcuucaucaccuccagaa

SEQ ID NO: 14469 - RNA, 19 nt, artificial
  Chemically synthesized
cacaguagagaaaugaagu

SEQ ID NO: 14470 - RNA, 19 nt, artificial
  Chemically synthesized
gucugcagccuauugcaag

SEQ ID NO: 14471 - RNA, 19 nt, artificial
  Chemically synthesized
caugaauuaaauagccucu

SEQ ID NO: 14472 - RNA, 19 nt, artificial
  Chemically synthesized
aacuucucccaaaggguga

SEQ ID NO: 14473 - RNA, 19 nt, artificial
  Chemically synthesized
cuguauggcuaccuucagg

SEQ ID NO: 14474 - RNA, 19 nt, artificial
  Chemically synthesized
agaguuuucaaguuggcau

SEQ ID NO: 14475 - RNA, 19 nt, artificial
  Chemically synthesized
acaagaauagauguugcau

SEQ ID NO: 14476 - RNA, 19 nt, artificial
  Chemically synthesized
uggaggacauucaguuacu

SEQ ID NO: 14477 - RNA, 19 nt, artificial
  Chemically synthesized
aggacauucaguuacuauu

SEQ ID NO: 14478 - RNA, 19 nt, artificial
  Chemically synthesized
acauagcacuaguuuaggc

SEQ ID NO: 14479 - RNA, 19 nt, artificial
  Chemically synthesized
gcaucuucaaaugauccac

SEQ ID NO: 14480 - RNA, 19 nt, artificial
  Chemically synthesized
ccuccuugcuucaucaccu

SEQ ID NO: 14481 - RNA, 19 nt, artificial
  Chemically synthesized
uggugggccauggaggaug

SEQ ID NO: 14482 - RNA, 19 nt, artificial
  Chemically synthesized
uaaaaugucugcagccuau

SEQ ID NO: 14483 - RNA, 19 nt, artificial
  Chemically synthesized
guauguaaagacucuugca

SEQ ID NO: 14484 - RNA, 19 nt, artificial
  Chemically synthesized
uuuguggaucugucggcau

SEQ ID NO: 14485 - RNA, 19 nt, artificial
  Chemically synthesized
cgacucucucacucucucu

SEQ ID NO: 14486 - RNA, 19 nt, artificial
  Chemically synthesized
ucgugagguuugugucuca

SEQ ID NO: 14487 - RNA, 19 nt, artificial
  Chemically synthesized
uucaaguuggcaugaauua

SEQ ID NO: 14488 - RNA, 19 nt, artificial
  Chemically synthesized
ugucauuaaacgaaaucga

SEQ ID NO: 14489 - RNA, 19 nt, artificial
  Chemically synthesized
acuuccuaagcucaggcac

SEQ ID NO: 14490 - RNA, 19 nt, artificial
  Chemically synthesized
ugaugucaguuaccgagcu

SEQ ID NO: 14491 - RNA, 19 nt, artificial
  Chemically synthesized
ucaucaccuccagaaaugu

SEQ ID NO: 14492 - RNA, 19 nt, artificial
  Chemically synthesized
ugucggcaucuguauggcu

SEQ ID NO: 14493 - RNA, 19 nt, artificial
  Chemically synthesized
gcuuucuccacacaguaga

SEQ ID NO: 14494 - RNA, 19 nt, artificial
  Chemically synthesized
agagagagguggagagagg

SEQ ID NO: 14495 - RNA, 19 nt, artificial
  Chemically synthesized
accuucagggugcagaggu

SEQ ID NO: 14496 - RNA, 19 nt, artificial
  Chemically synthesized
cuugcauagaaaaagguua

SEQ ID NO: 14497 - RNA, 19 nt, artificial
  Chemically synthesized
cuaccuucagggugcagag

SEQ ID NO: 14498 - RNA, 19 nt, artificial
  Chemically synthesized
uacaucccauugcauacau

SEQ ID NO: 14499 - RNA, 19 nt, artificial
  Chemically synthesized
uucuugccauaaucugaga

SEQ ID NO: 14500 - RNA, 19 nt, artificial
  Chemically synthesized
aaaaaagacuagguacagu

SEQ ID NO: 14501 - RNA, 19 nt, artificial
  Chemically synthesized
cccuccuugcuucaucacc

SEQ ID NO: 14502 - RNA, 19 nt, artificial
  Chemically synthesized
ccauugcauacauucaucu

SEQ ID NO: 14503 - RNA, 19 nt, artificial
  Chemically synthesized
ccagaaauguaacuucucc

SEQ ID NO: 14504 - RNA, 19 nt, artificial
  Chemically synthesized
uugcuucaucaccuccaga

SEQ ID NO: 14505 - RNA, 19 nt, artificial
  Chemically synthesized
aagacuagguacaguaauu

SEQ ID NO: 14506 - RNA, 19 nt, artificial
  Chemically synthesized
ggacauucaguuacuauug

SEQ ID NO: 14507 - RNA, 19 nt, artificial
  Chemically synthesized
ggucugcugaggacuggac

SEQ ID NO: 14508 - RNA, 19 nt, artificial
  Chemically synthesized
ugaugcacugcuggauggu

SEQ ID NO: 14509 - RNA, 19 nt, artificial
  Chemically synthesized
gucaccucuuggcaugucu

SEQ ID NO: 14510 - RNA, 19 nt, artificial
  Chemically synthesized
agggaagcugugugcagcc

SEQ ID NO: 14511 - RNA, 19 nt, artificial
  Chemically synthesized
cugucauuugcaauauuuc

SEQ ID NO: 14512 - RNA, 19 nt, artificial
  Chemically synthesized
cuuucuugccauaaucuga

SEQ ID NO: 14513 - RNA, 19 nt, artificial
  Chemically synthesized
guuuauugcuuucuccaca

SEQ ID NO: 14514 - RNA, 19 nt, artificial
  Chemically synthesized
aaacaaaaaagggagagaa

SEQ ID NO: 14515 - RNA, 19 nt, artificial
  Chemically synthesized
ucuuaaccuauccuccaca

SEQ ID NO: 14516 - RNA, 19 nt, artificial
  Chemically synthesized
agccuauugcaagacuucu

SEQ ID NO: 14517 - RNA, 19 nt, artificial
  Chemically synthesized
gccuauugcaagacuucug

SEQ ID NO: 14518 - RNA, 19 nt, artificial
  Chemically synthesized
cauuugcaauauuucagcu

SEQ ID NO: 14519 - RNA, 19 nt, artificial
  Chemically synthesized
guauuaaaaugucugcagc

SEQ ID NO: 14520 - RNA, 19 nt, artificial
  Chemically synthesized
ucggcaucuguauggcuac

SEQ ID NO: 14521 - RNA, 19 nt, artificial
  Chemically synthesized
agagggaagcugugugcag

SEQ ID NO: 14522 - RNA, 19 nt, artificial
  Chemically synthesized
gacaagaauagauguugca

SEQ ID NO: 14523 - RNA, 19 nt, artificial
  Chemically synthesized
auuuuccaggaaacuucua

SEQ ID NO: 14524 - RNA, 19 nt, artificial
  Chemically synthesized
aaaaagcuccaacuucugu

SEQ ID NO: 14525 - RNA, 19 nt, artificial
  Chemically synthesized
uccacacaguagagaaaug

SEQ ID NO: 14526 - RNA, 19 nt, artificial
  Chemically synthesized
caggaaacuucuaaauggu

SEQ ID NO: 14527 - RNA, 19 nt, artificial
  Chemically synthesized
agcaucuucaaaugaucca

SEQ ID NO: 14528 - RNA, 19 nt, artificial
  Chemically synthesized
agaagaaaacuuccuaagc

SEQ ID NO: 14529 - RNA, 19 nt, artificial
  Chemically synthesized
augcaaucacuaacuugac

SEQ ID NO: 14530 - RNA, 19 nt, artificial
  Chemically synthesized
aucugucggcaucuguaug

SEQ ID NO: 14531 - RNA, 19 nt, artificial
  Chemically synthesized
ugucaccucuuggcauguc

SEQ ID NO: 14532 - RNA, 19 nt, artificial
  Chemically synthesized
ccuugcuucaucaccucca

SEQ ID NO: 14533 - RNA, 19 nt, artificial
  Chemically synthesized
gacauucaguuacuauugc

SEQ ID NO: 14534 - RNA, 19 nt, artificial
  Chemically synthesized
gagagguggagagaggugg

SEQ ID NO: 14535 - RNA, 19 nt, artificial
  Chemically synthesized
acugcucauaggugcacua

SEQ ID NO: 14536 - RNA, 19 nt, artificial
  Chemically synthesized
cccacgucgauggucucgu

SEQ ID NO: 14537 - RNA, 19 nt, artificial
  Chemically synthesized
gcacugcuaaaugucaccu

SEQ ID NO: 14538 - RNA, 19 nt, artificial
  Chemically synthesized
ucccuccuugcuucaucac

SEQ ID NO: 14539 - RNA, 19 nt, artificial
  Chemically synthesized
uguggaucugucggcaucu

SEQ ID NO: 14540 - RNA, 19 nt, artificial
  Chemically synthesized
ucaaguuggcaugaauuaa

SEQ ID NO: 14541 - RNA, 19 nt, artificial
  Chemically synthesized
cugaaauggaggacauuca

SEQ ID NO: 14542 - RNA, 19 nt, artificial
  Chemically synthesized
aaaaugucugcagccuauu

SEQ ID NO: 14543 - RNA, 19 nt, artificial
  Chemically synthesized
ccucuuggcaugucuguac

SEQ ID NO: 14544 - RNA, 19 nt, artificial
  Chemically synthesized
gcuaaaugucaccucuugg

SEQ ID NO: 14545 - RNA, 19 nt, artificial
  Chemically synthesized
acaucccauugcauacauu

SEQ ID NO: 14546 - RNA, 19 nt, artificial
  Chemically synthesized
gauccuuguuuuucaaaag

SEQ ID NO: 14547 - RNA, 19 nt, artificial
  Chemically synthesized
aucacuaacuugacaaaga

SEQ ID NO: 14548 - RNA, 19 nt, artificial
  Chemically synthesized
gacagagggaagcugugug

SEQ ID NO: 14549 - RNA, 19 nt, artificial
  Chemically synthesized
gcacuauauaaauguaagg

SEQ ID NO: 14550 - RNA, 19 nt, artificial
  Chemically synthesized
aagacucuugcauagaaaa

SEQ ID NO: 14551 - RNA, 19 nt, artificial
  Chemically synthesized
agagguggagagagguggc

SEQ ID NO: 14552 - RNA, 19 nt, artificial
  Chemically synthesized
cuugcuucaucaccuccag

SEQ ID NO: 14553 - RNA, 19 nt, artificial
  Chemically synthesized
auaccaaugcacugcuaaa

SEQ ID NO: 14554 - RNA, 19 nt, artificial
  Chemically synthesized
agggugcagagguuuuaag

SEQ ID NO: 14555 - RNA, 19 nt, artificial
  Chemically synthesized
gaaggacagagggaagcug

SEQ ID NO: 14556 - RNA, 19 nt, artificial
  Chemically synthesized
ugcagccuauugcaagacu

SEQ ID NO: 14557 - RNA, 19 nt, artificial
  Chemically synthesized
agacuagguacaguaauuu

SEQ ID NO: 14558 - RNA, 19 nt, artificial
  Chemically synthesized
gguauuaaaaugucugcag

SEQ ID NO: 14559 - RNA, 19 nt, artificial
  Chemically synthesized
ugggccauggaggauguca

SEQ ID NO: 14560 - RNA, 19 nt, artificial
  Chemically synthesized
aacaagugugaaguuuuca

SEQ ID NO: 14561 - RNA, 19 nt, artificial
  Chemically synthesized
caacugcucauaggugcac

SEQ ID NO: 14562 - RNA, 19 nt, artificial
  Chemically synthesized
ucauaggugcacuauauaa

SEQ ID NO: 14563 - RNA, 19 nt, artificial
  Chemically synthesized
agguggagagagguggcac

SEQ ID NO: 14564 - RNA, 19 nt, artificial
  Chemically synthesized
gcucccuccuugcuucauc

SEQ ID NO: 14565 - RNA, 19 nt, artificial
  Chemically synthesized
aauggaggacauucaguua

SEQ ID NO: 14566 - RNA, 19 nt, artificial
  Chemically synthesized
ugggcuggagcagggcugc

SEQ ID NO: 14567 - RNA, 19 nt, artificial
  Chemically synthesized
cauucaguuacuauugcaa

SEQ ID NO: 14568 - RNA, 19 nt, artificial
  Chemically synthesized
ucuccacacaguagagaaa

SEQ ID NO: 14569 - RNA, 19 nt, artificial
  Chemically synthesized
cuauugcaagaaguucaag

SEQ ID NO: 14570 - RNA, 19 nt, artificial
  Chemically synthesized
gacuucauuuaauuagugg

SEQ ID NO: 14571 - RNA, 19 nt, artificial
  Chemically synthesized
gagcuuuaaaaauuguagc

SEQ ID NO: 14572 - RNA, 19 nt, artificial
  Chemically synthesized
ugucugcagccuauugcaa

SEQ ID NO: 14573 - RNA, 19 nt, artificial
  Chemically synthesized
uggcaugguauuaaaaugu

SEQ ID NO: 14574 - RNA, 19 nt, artificial
  Chemically synthesized
ucuggcaugguauuaaaau

SEQ ID NO: 14575 - RNA, 19 nt, artificial
  Chemically synthesized
cucuugcauagaaaaaggu

SEQ ID NO: 14576 - RNA, 19 nt, artificial
  Chemically synthesized
gaaauggaggacauucagu

SEQ ID NO: 14577 - RNA, 19 nt, artificial
  Chemically synthesized
aacuugacaaagagcuuua

SEQ ID NO: 14578 - RNA, 19 nt, artificial
  Chemically synthesized
ccuauugcaagacuucugu

SEQ ID NO: 14579 - RNA, 19 nt, artificial
  Chemically synthesized
ccacgucgauggucucguc

SEQ ID NO: 14580 - RNA, 19 nt, artificial
  Chemically synthesized
ugcauagaaaaagguuaca

SEQ ID NO: 14581 - RNA, 19 nt, artificial
  Chemically synthesized
augguggugggccauggag

SEQ ID NO: 14582 - RNA, 19 nt, artificial
  Chemically synthesized
guaaagacucuugcauaga

SEQ ID NO: 14583 - RNA, 19 nt, artificial
  Chemically synthesized
aggaaacuucuaaauggua

SEQ ID NO: 14584 - RNA, 19 nt, artificial
  Chemically synthesized
gcagaaaugcuuguuaauc

SEQ ID NO: 14585 - RNA, 19 nt, artificial
  Chemically synthesized
uugcaagaaguucaagaaa

SEQ ID NO: 14586 - RNA, 19 nt, artificial
  Chemically synthesized
caaguuggcaugaauuaaa

SEQ ID NO: 14587 - RNA, 19 nt, artificial
  Chemically synthesized
cuccagaaauguaacuucu

SEQ ID NO: 14588 - RNA, 19 nt, artificial
  Chemically synthesized
uucagggugcagagguuuu

SEQ ID NO: 14589 - RNA, 19 nt, artificial
  Chemically synthesized
acuauugcaagaaguucaa

SEQ ID NO: 14590 - RNA, 19 nt, artificial
  Chemically synthesized
agagagguggcacgcaggg

SEQ ID NO: 14591 - RNA, 19 nt, artificial
  Chemically synthesized
caaaugauccacugucauu

SEQ ID NO: 14592 - RNA, 19 nt, artificial
  Chemically synthesized
ugggcaaaaauaacuuaug

SEQ ID NO: 14593 - RNA, 19 nt, artificial
  Chemically synthesized
guuacuauugcaagaaguu

SEQ ID NO: 14594 - RNA, 19 nt, artificial
  Chemically synthesized
ugcaagaaguucaagaaaa

SEQ ID NO: 14595 - RNA, 19 nt, artificial
  Chemically synthesized
ccaaugcacugcuaaaugu

SEQ ID NO: 14596 - RNA, 19 nt, artificial
  Chemically synthesized
aggacagagggaagcugug

SEQ ID NO: 14597 - RNA, 19 nt, artificial
  Chemically synthesized
uggaucugucggcaucugu

SEQ ID NO: 14598 - RNA, 19 nt, artificial
  Chemically synthesized
cucccuccuugcuucauca

SEQ ID NO: 14599 - RNA, 19 nt, artificial
  Chemically synthesized
cgugaggagagcagagccg

SEQ ID NO: 14600 - RNA, 19 nt, artificial
  Chemically synthesized
ccacacaguagagaaauga

SEQ ID NO: 14601 - RNA, 19 nt, artificial
  Chemically synthesized
cauaggugcacuauauaaa

SEQ ID NO: 14602 - RNA, 19 nt, artificial
  Chemically synthesized
accucuuggcaugucugua

SEQ ID NO: 14603 - RNA, 19 nt, artificial
  Chemically synthesized
agagcagaaaugcuuguua

SEQ ID NO: 14604 - RNA, 19 nt, artificial
  Chemically synthesized
cccauugcauacauucauc

SEQ ID NO: 14605 - RNA, 19 nt, artificial
  Chemically synthesized
cagaagaaaacuuccuaag

SEQ ID NO: 14606 - RNA, 19 nt, artificial
  Chemically synthesized
gagguuugugucucaaaua

SEQ ID NO: 14607 - RNA, 19 nt, artificial
  Chemically synthesized
ugcaggcagagcagaaaug

SEQ ID NO: 14608 - RNA, 19 nt, artificial
  Chemically synthesized
agagaaaugaagugcauaa

SEQ ID NO: 14609 - RNA, 19 nt, artificial
  Chemically synthesized
ucugcagccuauugcaaga

SEQ ID NO: 14610 - RNA, 19 nt, artificial
  Chemically synthesized
gaguuuucaaguuggcaug

SEQ ID NO: 14611 - RNA, 19 nt, artificial
  Chemically synthesized
cuccuugcuucaucaccuc

SEQ ID NO: 14612 - RNA, 19 nt, artificial
  Chemically synthesized
gcaugguauuaaaaugucu

SEQ ID NO: 14613 - RNA, 19 nt, artificial
  Chemically synthesized
ccucuccuuuucuuucuug

SEQ ID NO: 14614 - RNA, 19 nt, artificial
  Chemically synthesized
gagggaagcugugugcagc

SEQ ID NO: 14615 - RNA, 19 nt, artificial
  Chemically synthesized
ugcucauaggugcacuaua

SEQ ID NO: 14616 - RNA, 19 nt, artificial
  Chemically synthesized
gggugcagagguuuuaagc

SEQ ID NO: 14617 - RNA, 19 nt, artificial
  Chemically synthesized
uccagaagaaaacuuccua

SEQ ID NO: 14618 - RNA, 19 nt, artificial
  Chemically synthesized
agagagguggagagaggug

SEQ ID NO: 14619 - RNA, 19 nt, artificial
  Chemically synthesized
gaaaugcuuguuaaucuga

SEQ ID NO: 14620 - RNA, 19 nt, artificial
  Chemically synthesized
accuccagaaauguaacuu

SEQ ID NO: 14621 - RNA, 19 nt, artificial
  Chemically synthesized
agcuuuauuguuccuuugu

SEQ ID NO: 14622 - RNA, 19 nt, artificial
  Chemically synthesized
auucagucagggcauuuua

SEQ ID NO: 14623 - RNA, 19 nt, artificial
  Chemically synthesized
cugaugcacugcuggaugg

SEQ ID NO: 14624 - RNA, 19 nt, artificial
  Chemically synthesized
gcuuuauuguuccuuugug

SEQ ID NO: 14625 - RNA, 19 nt, artificial
  Chemically synthesized
cuucaucaccuccagaaau

SEQ ID NO: 14626 - RNA, 19 nt, artificial
  Chemically synthesized
gaagaaaacuuccuaagcu

SEQ ID NO: 14627 - RNA, 19 nt, artificial
  Chemically synthesized
agguuacaaaguaaugcaa

SEQ ID NO: 14628 - RNA, 19 nt, artificial
  Chemically synthesized
gaaccaaacaaaaaaggga

SEQ ID NO: 14629 - RNA, 19 nt, artificial
  Chemically synthesized
aggcagagcagaaaugcuu

SEQ ID NO: 14630 - RNA, 19 nt, artificial
  Chemically synthesized
cagccuauugcaagacuuc

SEQ ID NO: 14631 - RNA, 19 nt, artificial
  Chemically synthesized
agugugaaguuuucaaaag

SEQ ID NO: 14632 - RNA, 19 nt, artificial
  Chemically synthesized
agaaaacuuccuaagcuca

SEQ ID NO: 14633 - RNA, 19 nt, artificial
  Chemically synthesized
gaaguuuucaaaaguugcu

SEQ ID NO: 14634 - RNA, 19 nt, artificial
  Chemically synthesized
cauugcauacauucaucuu

SEQ ID NO: 14635 - RNA, 19 nt, artificial
  Chemically synthesized
cugcagccuauugcaagac

SEQ ID NO: 14636 - RNA, 19 nt, artificial
  Chemically synthesized
gggaucaaaugcaaucacu

SEQ ID NO: 14637 - RNA, 19 nt, artificial
  Chemically synthesized
cuuuguggaucugucggca

SEQ ID NO: 14638 - RNA, 19 nt, artificial
  Chemically synthesized
caccauauuuugagccauc

SEQ ID NO: 14639 - RNA, 19 nt, artificial
  Chemically synthesized
ggcaugaauuaaauagccu

SEQ ID NO: 14640 - RNA, 19 nt, artificial
  Chemically synthesized
ugcagagguuuuaagcuga

SEQ ID NO: 14641 - RNA, 19 nt, artificial
  Chemically synthesized
cauuaggagaaaaugaaga

SEQ ID NO: 14642 - RNA, 19 nt, artificial
  Chemically synthesized
ucccaaagggugacaagaa

SEQ ID NO: 14643 - RNA, 19 nt, artificial
  Chemically synthesized
cacuaacuugacaaagagc

SEQ ID NO: 14644 - RNA, 19 nt, artificial
  Chemically synthesized
guagagaaaugaagugcau

SEQ ID NO: 14645 - RNA, 19 nt, artificial
  Chemically synthesized
ccuccagaaauguaacuuc

SEQ ID NO: 14646 - RNA, 19 nt, artificial
  Chemically synthesized
gacuagguacaguaauuuc

SEQ ID NO: 14647 - RNA, 19 nt, artificial
  Chemically synthesized
ugcgucaaaguagccuuua

SEQ ID NO: 14648 - RNA, 19 nt, artificial
  Chemically synthesized
acaagugugaaguuuucaa

SEQ ID NO: 14649 - RNA, 19 nt, artificial
  Chemically synthesized
gaggacauucaguuacuau

SEQ ID NO: 14650 - RNA, 19 nt, artificial
  Chemically synthesized
cuucucccaaagggugaca

SEQ ID NO: 14651 - RNA, 19 nt, artificial
  Chemically synthesized
guugggcuggagcagggcu

SEQ ID NO: 14652 - RNA, 19 nt, artificial
  Chemically synthesized
ugcaaucacuaacuugaca

SEQ ID NO: 14653 - RNA, 19 nt, artificial
  Chemically synthesized
agcaccauauuuugagcca

SEQ ID NO: 14654 - RNA, 19 nt, artificial
  Chemically synthesized
cgaaggacagagggaagcu

SEQ ID NO: 14655 - RNA, 19 nt, artificial
  Chemically synthesized
caguuacuauugcaagaag

SEQ ID NO: 14656 - RNA, 19 nt, artificial
  Chemically synthesized
cuccuuuucuuucuugcca

SEQ ID NO: 14657 - RNA, 19 nt, artificial
  Chemically synthesized
guauggcuaccuucagggu

SEQ ID NO: 14658 - RNA, 19 nt, artificial
  Chemically synthesized
gaaauguaacuucucccaa

SEQ ID NO: 14659 - RNA, 19 nt, artificial
  Chemically synthesized
guacaucccauugcauaca

SEQ ID NO: 14660 - RNA, 19 nt, artificial
  Chemically synthesized
cuuccuaagcucaggcacu

SEQ ID NO: 14661 - RNA, 19 nt, artificial
  Chemically synthesized
cucucucacucucucucua

SEQ ID NO: 14662 - RNA, 19 nt, artificial
  Chemically synthesized
gaaaacuuccuaagcucag

SEQ ID NO: 14663 - RNA, 19 nt, artificial
  Chemically synthesized
gugcagagguuuuaagcug

SEQ ID NO: 14664 - RNA, 19 nt, artificial
  Chemically synthesized
ucuuggcaugucuguacaa

SEQ ID NO: 14665 - RNA, 19 nt, artificial
  Chemically synthesized
cugucggcaucuguauggc

SEQ ID NO: 14666 - RNA, 19 nt, artificial
  Chemically synthesized
gcuaccuucagggugcaga

SEQ ID NO: 14667 - RNA, 19 nt, artificial
  Chemically synthesized
ugcucccuccuugcuucau

SEQ ID NO: 14668 - RNA, 19 nt, artificial
  Chemically synthesized
guuucagcagaauacucuu

SEQ ID NO: 14669 - RNA, 19 nt, artificial
  Chemically synthesized
gaugucaguuaccgagcug

SEQ ID NO: 14670 - RNA, 19 nt, artificial
  Chemically synthesized
gcaggaggcacuucugaag

SEQ ID NO: 14671 - RNA, 19 nt, artificial
  Chemically synthesized
gcaacugcucauaggugca

SEQ ID NO: 14672 - RNA, 19 nt, artificial
  Chemically synthesized
ccuaagcucaggcacuuac

SEQ ID NO: 14673 - RNA, 19 nt, artificial
  Chemically synthesized
gucaguuaccgagcugccu

SEQ ID NO: 14674 - RNA, 19 nt, artificial
  Chemically synthesized
cgucgauggucucguccau

SEQ ID NO: 14675 - RNA, 19 nt, artificial
  Chemically synthesized
ggugacaagaauagauguu

SEQ ID NO: 14676 - RNA, 19 nt, artificial
  Chemically synthesized
cucuuggcaugucuguaca

SEQ ID NO: 14677 - RNA, 19 nt, artificial
  Chemically synthesized
cuuaaccuauccuccacac

SEQ ID NO: 14678 - RNA, 19 nt, artificial
  Chemically synthesized
augaugguggugggccaug

SEQ ID NO: 14679 - RNA, 19 nt, artificial
  Chemically synthesized
ggaucaaaugcaaucacua

SEQ ID NO: 14680 - RNA, 19 nt, artificial
  Chemically synthesized
aaaagacuagguacaguaa

SEQ ID NO: 14681 - RNA, 19 nt, artificial
  Chemically synthesized
cuccacacaguagagaaau

SEQ ID NO: 14682 - RNA, 19 nt, artificial
  Chemically synthesized
uuccuaagcucaggcacuu

SEQ ID NO: 14683 - RNA, 19 nt, artificial
  Chemically synthesized
ccaaagggugacaagaaua

SEQ ID NO: 14684 - RNA, 19 nt, artificial
  Chemically synthesized
augucaccucuuggcaugu

SEQ ID NO: 14685 - RNA, 19 nt, artificial
  Chemically synthesized
ggcaucuguauggcuaccu

SEQ ID NO: 14686 - RNA, 19 nt, artificial
  Chemically synthesized
gcauagaaaaagguuacaa

SEQ ID NO: 14687 - RNA, 19 nt, artificial
  Chemically synthesized
ggugcagagguuuuaagcu

SEQ ID NO: 14688 - RNA, 19 nt, artificial
  Chemically synthesized
guggagagagguggcacgc

SEQ ID NO: 14689 - RNA, 19 nt, artificial
  Chemically synthesized
caagugugaaguuuucaaa

SEQ ID NO: 14690 - RNA, 19 nt, artificial
  Chemically synthesized
gcgaaggacagagggaagc

SEQ ID NO: 14691 - RNA, 19 nt, artificial
  Chemically synthesized
ucagggugcagagguuuua

SEQ ID NO: 14692 - RNA, 19 nt, artificial
  Chemically synthesized
agacucuugcauagaaaaa

SEQ ID NO: 14693 - RNA, 19 nt, artificial
  Chemically synthesized
ccaaacaaaaaagggagag

SEQ ID NO: 14694 - RNA, 19 nt, artificial
  Chemically synthesized
cacacaguagagaaaugaa

SEQ ID NO: 14695 - RNA, 19 nt, artificial
  Chemically synthesized
uggcuaccuucagggugca

SEQ ID NO: 14696 - RNA, 19 nt, artificial
  Chemically synthesized
gugaaguuuucaaaaguug

SEQ ID NO: 14697 - RNA, 19 nt, artificial
  Chemically synthesized
gcaggcagagcagaaaugc

SEQ ID NO: 14698 - RNA, 19 nt, artificial
  Chemically synthesized
cagagggaagcugugugca

SEQ ID NO: 14699 - RNA, 19 nt, artificial
  Chemically synthesized
caggaggcacuucugaagu

SEQ ID NO: 14700 - RNA, 19 nt, artificial
  Chemically synthesized
gagagagguggcacgcagg

SEQ ID NO: 14701 - RNA, 19 nt, artificial
  Chemically synthesized
uggagagagguggcacgca

SEQ ID NO: 14702 - RNA, 19 nt, artificial
  Chemically synthesized
caggcagagcagaaaugcu

SEQ ID NO: 14703 - RNA, 19 nt, artificial
  Chemically synthesized
gauccacugucauuugcaa

SEQ ID NO: 14704 - RNA, 19 nt, artificial
  Chemically synthesized
gugagguuugugucucaaa

SEQ ID NO: 14705 - RNA, 19 nt, artificial
  Chemically synthesized
gguuacaaaguaaugcaaa

SEQ ID NO: 14706 - RNA, 19 nt, artificial
  Chemically synthesized
agcagaaaugcuuguuaau

SEQ ID NO: 14707 - RNA, 19 nt, artificial
  Chemically synthesized
gcagccuauugcaagacuu

SEQ ID NO: 14708 - RNA, 19 nt, artificial
  Chemically synthesized
gagaaaugaagugcauaau

SEQ ID NO: 14709 - RNA, 19 nt, artificial
  Chemically synthesized
caucaccuccagaaaugua

SEQ ID NO: 14710 - RNA, 19 nt, artificial
  Chemically synthesized
ccgaucccgacgccuuuuc

SEQ ID NO: 14711 - RNA, 19 nt, artificial
  Chemically synthesized
gcaaucacuaacuugacaa

SEQ ID NO: 14712 - RNA, 19 nt, artificial
  Chemically synthesized
cagcagucauuuugaccag

SEQ ID NO: 14713 - RNA, 19 nt, artificial
  Chemically synthesized
cccauuacauagcacuagu

SEQ ID NO: 14714 - RNA, 19 nt, artificial
  Chemically synthesized
cugcuaaaugucaccucuu

SEQ ID NO: 14715 - RNA, 19 nt, artificial
  Chemically synthesized
gugucucaaauagcuuuau

SEQ ID NO: 14716 - RNA, 19 nt, artificial
  Chemically synthesized
ggacuucauuuaauuagug

SEQ ID NO: 14717 - RNA, 19 nt, artificial
  Chemically synthesized
gcaucuguauggcuaccuu

SEQ ID NO: 14718 - RNA, 19 nt, artificial
  Chemically synthesized
cuggcaugguauuaaaaug

SEQ ID NO: 14719 - RNA, 19 nt, artificial
  Chemically synthesized
cuuuucuuucuugccauaa

SEQ ID NO: 14720 - RNA, 19 nt, artificial
  Chemically synthesized
cuaacuugacaaagagcuu

SEQ ID NO: 14721 - RNA, 19 nt, artificial
  Chemically synthesized
gguggagagagguggcacg

SEQ ID NO: 14722 - RNA, 19 nt, artificial
  Chemically synthesized
cucccaaagggugacaaga

SEQ ID NO: 14723 - RNA, 19 nt, artificial
  Chemically synthesized
ggagagagguggcacgcag

SEQ ID NO: 14724 - RNA, 19 nt, artificial
  Chemically synthesized
ccauuacauagcacuaguu

SEQ ID NO: 14725 - RNA, 19 nt, artificial
  Chemically synthesized
caccucuuggcaugucugu

SEQ ID NO: 14726 - RNA, 19 nt, artificial
  Chemically synthesized
cacugucauuugcaauauu

SEQ ID NO: 14727 - RNA, 19 nt, artificial
  Chemically synthesized
gggugacaagaauagaugu

SEQ ID NO: 14728 - RNA, 19 nt, artificial
  Chemically synthesized
gucaaaaaggacuucauuu

SEQ ID NO: 14729 - RNA, 19 nt, artificial
  Chemically synthesized
cgugagguuugugucucaa

SEQ ID NO: 14730 - RNA, 19 nt, artificial
  Chemically synthesized
gggccauggaggaugucau

SEQ ID NO: 14731 - RNA, 19 nt, artificial
  Chemically synthesized
caccuccagaaauguaacu

SEQ ID NO: 14732 - RNA, 19 nt, artificial
  Chemically synthesized
cuucagggugcagagguuu

SEQ ID NO: 14733 - RNA, 19 nt, artificial
  Chemically synthesized
caaacaaaaaagggagaga

SEQ ID NO: 14734 - RNA, 19 nt, artificial
  Chemically synthesized
cagagcagaaaugcuuguu

SEQ ID NO: 14735 - RNA, 19 nt, artificial
  Chemically synthesized
gagagagguggagagaggu

SEQ ID NO: 14736 - RNA, 19 nt, artificial
  Chemically synthesized
ccacugucauuugcaauau

SEQ ID NO: 14737 - RNA, 19 nt, artificial
  Chemically synthesized
gaucugucggcaucuguau

SEQ ID NO: 14738 - RNA, 19 nt, artificial
  Chemically synthesized
gucggcaucuguauggcua

SEQ ID NO: 14739 - RNA, 19 nt, artificial
  Chemically synthesized
cagagguuuuaagcugacu

SEQ ID NO: 14740 - RNA, 19 nt, artificial
  Chemically synthesized
gaugcacugcuggauggua

SEQ ID NO: 14741 - RNA, 19 nt, artificial
  Chemically synthesized
gagcagaaaugcuuguuaa

SEQ ID NO: 14742 - RNA, 19 nt, artificial
  Chemically synthesized
gcucauaggugcacuauau

SEQ ID NO: 14743 - RNA, 19 nt, artificial
  Chemically synthesized
ggacagagggaagcugugu

SEQ ID NO: 14744 - RNA, 19 nt, artificial
  Chemically synthesized
cggcaucuguauggcuacc

SEQ ID NO: 14745 - RNA, 19 nt, artificial
  Chemically synthesized
gaucaaaugcaaucacuaa

SEQ ID NO: 14746 - RNA, 19 nt, artificial
  Chemically synthesized
gaauucagucagggcauuu

SEQ ID NO: 14747 - RNA, 19 nt, artificial
  Chemically synthesized
cugugucucuuaucuuuua

SEQ ID NO: 14748 - RNA, 19 nt, artificial
  Chemically synthesized
caaaugcaaucacuaacuu

SEQ ID NO: 14749 - RNA, 19 nt, artificial
  Chemically synthesized
aguuuucaaguuggcauga

SEQ ID NO: 14750 - RNA, 19 nt, artificial
  Chemically synthesized
cagauccuuguuuuucaaa

SEQ ID NO: 14751 - RNA, 19 nt, artificial
  Chemically synthesized
cugcucauaggugcacuau

SEQ ID NO: 14752 - RNA, 19 nt, artificial
  Chemically synthesized
gugcucccuccuugcuuca

SEQ ID NO: 14753 - RNA, 19 nt, artificial
  Chemically synthesized
cccucuccuuuucuuucuu

SEQ ID NO: 14754 - RNA, 19 nt, artificial
  Chemically synthesized
accaaacaaaaaagggaga

SEQ ID NO: 14755 - RNA, 19 nt, artificial
  Chemically synthesized
cuugacaaagagcuuuaaa

SEQ ID NO: 14756 - RNA, 19 nt, artificial
  Chemically synthesized
cgcgaaggacagagggaag

SEQ ID NO: 14757 - RNA, 19 nt, artificial
  Chemically synthesized
ccuucagggugcagagguu

SEQ ID NO: 14758 - RNA, 19 nt, artificial
  Chemically synthesized
guggaucugucggcaucug

SEQ ID NO: 14759 - RNA, 19 nt, artificial
  Chemically synthesized
gcaccauauuuugagccau

SEQ ID NO: 14760 - RNA, 19 nt, artificial
  Chemically synthesized
ggaucugucggcaucugua

SEQ ID NO: 14761 - RNA, 19 nt, artificial
  Chemically synthesized
gucauuaaacgaaaucgaa

SEQ ID NO: 14762 - RNA, 19 nt, artificial
  Chemically synthesized
acuugacaaagagcuuuaa

SEQ ID NO: 14763 - RNA, 19 nt, artificial
  Chemically synthesized
ggcagagcagaaaugcuug

SEQ ID NO: 14764 - RNA, 19 nt, artificial
  Chemically synthesized
ggcaugguauuaaaauguc

SEQ ID NO: 14765 - RNA, 19 nt, artificial
  Chemically synthesized
cucauaggugcacuauaua

SEQ ID NO: 14766 - RNA, 19 nt, artificial
  Chemically synthesized
uccuaagcucaggcacuua

SEQ ID NO: 14767 - RNA, 19 nt, artificial
  Chemically synthesized
gcuucaucaccuccagaaa

SEQ ID NO: 14768 - RNA, 19 nt, artificial
  Chemically synthesized
guuuucaaguuggcaugaa

SEQ ID NO: 14769 - RNA, 19 nt, artificial
  Chemically synthesized
gugugaaguuuucaaaagu

SEQ ID NO: 14770 - RNA, 19 nt, artificial
  Chemically synthesized
ccuuuucuuucuugccaua

SEQ ID NO: 14771 - RNA, 19 nt, artificial
  Chemically synthesized
gcagauccuuguuuuucaa

SEQ ID NO: 14772 - RNA, 19 nt, artificial
  Chemically synthesized
gcagagguuuuaagcugac

SEQ ID NO: 14773 - RNA, 19 nt, artificial
  Chemically synthesized
ggcaggaggcacuucugaa

SEQ ID NO: 14774 - RNA, 19 nt, artificial
  Chemically synthesized
ccagaagaaaacuuccuaa

SEQ ID NO: 14775 - RNA, 19 nt, artificial
  Chemically synthesized
caaucacuaacuugacaaa

SEQ ID NO: 14776 - RNA, 19 nt, artificial
  Chemically synthesized
cccaaagggugacaagaau

SEQ ID NO: 14777 - RNA, 19 nt, artificial
  Chemically synthesized
ggccauggaggaugucaug

SEQ ID NO: 14778 - RNA, 19 nt, artificial
  Chemically synthesized
cugcaggcagagcagaaau

SEQ ID NO: 14779 - RNA, 19 nt, artificial
  Chemically synthesized
gcagagcagaaaugcuugu

SEQ ID NO: 14780 - RNA, 19 nt, artificial
  Chemically synthesized
gagguggagagagguggca

SEQ ID NO: 14781 - RNA, 19 nt, artificial
  Chemically synthesized
gagaaaaugaagaggauaa

SEQ ID NO: 14782 - RNA, 19 nt, artificial
  Chemically synthesized
gugcuugauuucagcauau

SEQ ID NO: 14783 - RNA, 19 nt, artificial
  Chemically synthesized
aggagaaaaugaagaggau

SEQ ID NO: 14784 - RNA, 19 nt, artificial
  Chemically synthesized
ggcuaccuucagggugcag

SEQ ID NO: 14785 - RNA, 19 nt, artificial
  Chemically synthesized
ggugcacuauauaaaugua

SEQ ID NO: 14786 - RNA, 19 nt, artificial
  Chemically synthesized
gaugguggugggccaugga

SEQ ID NO: 14787 - RNA, 19 nt, artificial
  Chemically synthesized
gugggccauggaggauguc

SEQ ID NO: 14788 - RNA, 19 nt, artificial
  Chemically synthesized
ggaggacauucaguuacua

SEQ ID NO: 14789 - RNA, 19 nt, artificial
  Chemically synthesized
cccagggucgguaagguuu

SEQ ID NO: 14790 - RNA, 19 nt, artificial
  Chemically synthesized
caugggcaaaaauaacuua

SEQ ID NO: 14791 - RNA, 19 nt, artificial
  Chemically synthesized
ggugggccauggaggaugu

SEQ ID NO: 14792 - RNA, 19 nt, artificial
  Chemically synthesized
gguggugggccauggagga

SEQ ID NO: 14793 - RNA, 19 nt, artificial
  Chemically synthesized
gcaagaaguucaagaaaaa

SEQ ID NO: 14794 - RNA, 19 nt, artificial
  Chemically synthesized
cagggugcagagguuuuaa

SEQ ID NO: 14795 - RNA, 19 nt, artificial
  Chemically synthesized
cucuggcaugguauuaaaa

SEQ ID NO: 14796 - RNA, 19 nt, artificial
  Chemically synthesized
ggagaaaaugaagaggaua

SEQ ID NO: 14797 - RNA, 19 nt, artificial
  Chemically synthesized
guggugggccauggaggau

SEQ ID NO: 14798 - RNA, 19 nt, artificial
  Chemically synthesized
ccagggucgguaagguuua

SEQ ID NO: 14799 - RNA, 19 nt, artificial
  Chemically synthesized
gggcaaaaauaacuuaugu

SEQ ID NO: 14800 - RNA, 19 nt, Artificial Sequence
  Chemically synthesized
cagggucgguaagguuuau

SEQ ID NO: 14801 - RNA, 18 nt, artificial
  Chemically synthesized
gggagaaguuacauuucu

SEQ ID NO: 14802 - RNA, 18 nt, artificial
  Chemically synthesized
ccuucuuuguacagacau

SEQ ID NO: 14803 - RNA, 18 nt, artificial
  Chemically synthesized
gagggauuauagagaaaa

SEQ ID NO: 14804 - RNA, 18 nt, artificial
  Chemically synthesized
gggacauacauauauaga

SEQ ID NO: 14805 - RNA, 18 nt, artificial
  Chemically synthesized
gaugcaacaucuauucuu

SEQ ID NO: 14806 - RNA, 18 nt, artificial
  Chemically synthesized
gccagagaagaguauucu

SEQ ID NO: 14807 - RNA, 18 nt, artificial
  Chemically synthesized
gagacuagaugggacaua

SEQ ID NO: 14808 - RNA, 18 nt, artificial
  Chemically synthesized
gugcauugguauaagcaa

SEQ ID NO: 14809 - RNA, 18 nt, artificial
  Chemically synthesized
gaaguuuccuggaaaaua

SEQ ID NO: 14810 - RNA, 18 nt, artificial
  Chemically synthesized
agcuauuugagacacaaa

SEQ ID NO: 14811 - RNA, 18 nt, artificial
  Chemically synthesized
gcaucaguaugucugaau

SEQ ID NO: 14812 - RNA, 18 nt, artificial
  Chemically synthesized
ggguugugguuuuguuuu

SEQ ID NO: 14813 - RNA, 18 nt, artificial
  Chemically synthesized
gacauuuagcagugcauu

SEQ ID NO: 14814 - RNA, 18 nt, artificial
  Chemically synthesized
gacagaaguuggagcuuu

SEQ ID NO: 14815 - RNA, 18 nt, artificial
  Chemically synthesized
ggaggauagguuaagaaa

SEQ ID NO: 14816 - RNA, 18 nt, artificial
  Chemically synthesized
gcauuacuuuguaaccuu

SEQ ID NO: 14817 - RNA, 18 nt, artificial
  Chemically synthesized
gccaagaggugacauuua

SEQ ID NO: 14818 - RNA, 18 nt, artificial
  Chemically synthesized
ggagcgagaacaauuacu

SEQ ID NO: 14819 - RNA, 18 nt, artificial
  Chemically synthesized
ggagaaagcaauaaacau

SEQ ID NO: 14820 - RNA, 18 nt, artificial
  Chemically synthesized
ggauuauagagaaaaggc

SEQ ID NO: 14821 - RNA, 18 nt, artificial
  Chemically synthesized
gaccagcaguggaacaaa

SEQ ID NO: 14822 - RNA, 18 nt, artificial
  Chemically synthesized
ggugcugcuuuauauaaa

SEQ ID NO: 14823 - RNA, 18 nt, artificial
  Chemically synthesized
gcgacauggacgagacca

SEQ ID NO: 14824 - RNA, 18 nt, artificial
  Chemically synthesized
gacugaauucucuugaga

SEQ ID NO: 14825 - RNA, 18 nt, artificial
  Chemically synthesized
gcuauuugagacacaaac

SEQ ID NO: 14826 - RNA, 18 nt, artificial
  Chemically synthesized
gggcaaaguacuagcucu

SEQ ID NO: 14827 - RNA, 18 nt, artificial
  Chemically synthesized
gggacagaagucuugcaa

SEQ ID NO: 14828 - RNA, 18 nt, artificial
  Chemically synthesized
agacgaguguggaggaua

SEQ ID NO: 14829 - RNA, 18 nt, artificial
  Chemically synthesized
gcaauaggcugcagacau

SEQ ID NO: 14830 - RNA, 18 nt, artificial
  Chemically synthesized
guaggaguuugguuuaau

SEQ ID NO: 14831 - RNA, 18 nt, artificial
  Chemically synthesized
ccacaaaggaacaauaaa

SEQ ID NO: 14832 - RNA, 18 nt, artificial
  Chemically synthesized
guggaaaugugguauucu

SEQ ID NO: 14833 - RNA, 18 nt, artificial
  Chemically synthesized
ccuugucaguaucagcca

SEQ ID NO: 14834 - RNA, 18 nt, artificial
  Chemically synthesized
gcacaagggaagacgagu

SEQ ID NO: 14835 - RNA, 18 nt, artificial
  Chemically synthesized
ugaauucucuugagacua

SEQ ID NO: 14836 - RNA, 18 nt, artificial
  Chemically synthesized
agagcgacauggacgaga

SEQ ID NO: 14837 - RNA, 18 nt, artificial
  Chemically synthesized
ugagaagacuugugccaa

SEQ ID NO: 14838 - RNA, 18 nt, artificial
  Chemically synthesized
agagaagaguauucugcu

SEQ ID NO: 14839 - RNA, 18 nt, artificial
  Chemically synthesized
gaaguuuucuucuggaua

SEQ ID NO: 14840 - RNA, 18 nt, artificial
  Chemically synthesized
ggacagaaguuggagcuu

SEQ ID NO: 14841 - RNA, 18 nt, artificial
  Chemically synthesized
cagcaguggaacaaacaa

SEQ ID NO: 14842 - RNA, 18 nt, artificial
  Chemically synthesized
gacaguggaucauuugaa

SEQ ID NO: 14843 - RNA, 18 nt, artificial
  Chemically synthesized
gcacuucauuucucuacu

SEQ ID NO: 14844 - RNA, 18 nt, artificial
  Chemically synthesized
caagaugaauguaugcaa

SEQ ID NO: 14845 - RNA, 18 nt, artificial
  Chemically synthesized
gggagcgagaacaauuac

SEQ ID NO: 14846 - RNA, 18 nt, artificial
  Chemically synthesized
ggaaagggacagaagucu

SEQ ID NO: 14847 - RNA, 18 nt, artificial
  Chemically synthesized
gcggcuugugucucaucu

SEQ ID NO: 14848 - RNA, 18 nt, artificial
  Chemically synthesized
gcaagagucuuuacauac

SEQ ID NO: 14849 - RNA, 18 nt, artificial
  Chemically synthesized
agcacuaggaagagaaaa

SEQ ID NO: 14850 - RNA, 18 nt, artificial
  Chemically synthesized
caguucucagauuaacaa

SEQ ID NO: 14851 - RNA, 18 nt, artificial
  Chemically synthesized
gagacacaaaccucacga

SEQ ID NO: 14852 - RNA, 18 nt, artificial
  Chemically synthesized
gacagauccacaaaggaa

SEQ ID NO: 14853 - RNA, 18 nt, artificial
  Chemically synthesized
cuuuuucuaugcaagagu

SEQ ID NO: 14854 - RNA, 18 nt, artificial
  Chemically synthesized
gauugaauucuccaacaa

SEQ ID NO: 14855 - RNA, 18 nt, artificial
  Chemically synthesized
ggguaaaggcuacuuuga

SEQ ID NO: 14856 - RNA, 18 nt, artificial
  Chemically synthesized
ggacgagaccaucgacgu

SEQ ID NO: 14857 - RNA, 18 nt, artificial
  Chemically synthesized
gacacaaaccucacgagu

SEQ ID NO: 14858 - RNA, 18 nt, artificial
  Chemically synthesized
gcaagaaagaaaaggaga

SEQ ID NO: 14859 - RNA, 18 nt, artificial
  Chemically synthesized
cauguauuaugcacuuca

SEQ ID NO: 14860 - RNA, 18 nt, artificial
  Chemically synthesized
gaauguaugcaaugggau

SEQ ID NO: 14861 - RNA, 18 nt, artificial
  Chemically synthesized
gggauuauagagaaaagg

SEQ ID NO: 14862 - RNA, 18 nt, artificial
  Chemically synthesized
caacaucuauucuuguca

SEQ ID NO: 14863 - RNA, 18 nt, artificial
  Chemically synthesized
gagagugccuaacagaag

SEQ ID NO: 14864 - RNA, 18 nt, artificial
  Chemically synthesized
gaaaauauauggaccgua

SEQ ID NO: 14865 - RNA, 18 nt, artificial
  Chemically synthesized
cuaggaagagaaaagcua

SEQ ID NO: 14866 - RNA, 18 nt, artificial
  Chemically synthesized
ggauucagcccuccgaau

SEQ ID NO: 14867 - RNA, 18 nt, artificial
  Chemically synthesized
gucuuuacauaccacuaa

SEQ ID NO: 14868 - RNA, 18 nt, artificial
  Chemically synthesized
gcgagaacaauuacucgg

SEQ ID NO: 14869 - RNA, 18 nt, artificial
  Chemically synthesized
caucaguaugucugaauu

SEQ ID NO: 14870 - RNA, 18 nt, artificial
  Chemically synthesized
gugacauuuagcagugca

SEQ ID NO: 14871 - RNA, 18 nt, artificial
  Chemically synthesized
ccaguuuguaggaguuug

SEQ ID NO: 14872 - RNA, 18 nt, artificial
  Chemically synthesized
agguuuuacuggucaaaa

SEQ ID NO: 14873 - RNA, 18 nt, artificial
  Chemically synthesized
gguugugguuuuguuuuu

SEQ ID NO: 14874 - RNA, 18 nt, artificial
  Chemically synthesized
gagaaaaggcgucgggau

SEQ ID NO: 14875 - RNA, 18 nt, artificial
  Chemically synthesized
ggaagagaaaagcuacaa

SEQ ID NO: 14876 - RNA, 18 nt, artificial
  Chemically synthesized
agauaagagacacagcau

SEQ ID NO: 14877 - RNA, 18 nt, artificial
  Chemically synthesized
gaagguagccauacagau

SEQ ID NO: 14878 - RNA, 18 nt, artificial
  Chemically synthesized
cguccaguccucagcaga

SEQ ID NO: 14879 - RNA, 18 nt, artificial
  Chemically synthesized
gaggugacauuuagcagu

SEQ ID NO: 14880 - RNA, 18 nt, artificial
  Chemically synthesized
cugaguugagaagacuug

SEQ ID NO: 14881 - RNA, 18 nt, artificial
  Chemically synthesized
caguggaucauuugaaga

SEQ ID NO: 14882 - RNA, 18 nt, artificial
  Chemically synthesized
guaucagccacguccagu

SEQ ID NO: 14883 - RNA, 18 nt, artificial
  Chemically synthesized
guuuaucugaguugagaa

SEQ ID NO: 14884 - RNA, 18 nt, artificial
  Chemically synthesized
gagagagagugagagagu

SEQ ID NO: 14885 - RNA, 18 nt, artificial
  Chemically synthesized
gcagugcauugguauaag

SEQ ID NO: 14886 - RNA, 18 nt, artificial
  Chemically synthesized
cucuacuguguggagaaa

SEQ ID NO: 14887 - RNA, 18 nt, artificial
  Chemically synthesized
aucugaguugagaagacu

SEQ ID NO: 14888 - RNA, 18 nt, artificial
  Chemically synthesized
ggcuugugucucaucuca

SEQ ID NO: 14889 - RNA, 18 nt, artificial
  Chemically synthesized
cuucauuucucuacugug

SEQ ID NO: 14890 - RNA, 18 nt, artificial
  Chemically synthesized
cgacauggacgagaccau

SEQ ID NO: 14891 - RNA, 18 nt, artificial
  Chemically synthesized
gaucauuugaagaugcuu

SEQ ID NO: 14892 - RNA, 18 nt, artificial
  Chemically synthesized
caaaaugacugcugaaaa

SEQ ID NO: 14893 - RNA, 18 nt, artificial
  Chemically synthesized
gauuauagagaaaaggcg

SEQ ID NO: 14894 - RNA, 18 nt, artificial
  Chemically synthesized
ggcucaaaauauggugcu

SEQ ID NO: 14895 - RNA, 18 nt, artificial
  Chemically synthesized
cgagagugccuaacagaa

SEQ ID NO: 14896 - RNA, 18 nt, artificial
  Chemically synthesized
aggugaugaagcaaggag

SEQ ID NO: 14897 - RNA, 18 nt, artificial
  Chemically synthesized
cacacuuguuaccauuua

SEQ ID NO: 14898 - RNA, 18 nt, artificial
  Chemically synthesized
ugaguugagaagacuugu

SEQ ID NO: 14899 - RNA, 18 nt, artificial
  Chemically synthesized
agagaaaaggcgucggga

SEQ ID NO: 14900 - RNA, 18 nt, artificial
  Chemically synthesized
caaggaucugcaaaguua

SEQ ID NO: 14901 - RNA, 18 nt, artificial
  Chemically synthesized
gagacacagcauguauua

SEQ ID NO: 14902 - RNA, 18 nt, artificial
  Chemically synthesized
gaagagaaaagcuacaau

SEQ ID NO: 14903 - RNA, 18 nt, artificial
  Chemically synthesized
ccaugcggauucagcccu

SEQ ID NO: 14904 - RNA, 18 nt, artificial
  Chemically synthesized
acccuuugggagaaguua

SEQ ID NO: 14905 - RNA, 18 nt, artificial
  Chemically synthesized
cauuugaucccaaaacaa

SEQ ID NO: 14906 - RNA, 18 nt, artificial
  Chemically synthesized
ggccuggacuccucggau

SEQ ID NO: 14907 - RNA, 18 nt, artificial
  Chemically synthesized
cucagauuaacaagcauu

SEQ ID NO: 14908 - RNA, 18 nt, artificial
  Chemically synthesized
ggaaagagccgcuaggag

SEQ ID NO: 14909 - RNA, 18 nt, artificial
  Chemically synthesized
cccaaaacaagaugaaug

SEQ ID NO: 14910 - RNA, 18 nt, artificial
  Chemically synthesized
gacagaagucuugcaaua

SEQ ID NO: 14911 - RNA, 18 nt, artificial
  Chemically synthesized
gaggcuauuuaauucaug

SEQ ID NO: 14912 - RNA, 18 nt, artificial
  Chemically synthesized
ggaacaaacaauaaaccu

SEQ ID NO: 14913 - RNA, 18 nt, artificial
  Chemically synthesized
uccaguuuguaggaguuu

SEQ ID NO: 14914 - RNA, 18 nt, artificial
  Chemically synthesized
cucugugauuagauugaa

SEQ ID NO: 14915 - RNA, 18 nt, artificial
  Chemically synthesized
gguaacugacaucagcaa

SEQ ID NO: 14916 - RNA, 18 nt, artificial
  Chemically synthesized
ccauggacuucaugagca

SEQ ID NO: 14917 - RNA, 18 nt, artificial
  Chemically synthesized
gcugaaaccaacagguuu

SEQ ID NO: 14918 - RNA, 18 nt, artificial
  Chemically synthesized
agacacagcauguauuau

SEQ ID NO: 14919 - RNA, 18 nt, artificial
  Chemically synthesized
aaaugacaguggaucauu

SEQ ID NO: 14920 - RNA, 18 nt, artificial
  Chemically synthesized
gcuugugucucaucucag

SEQ ID NO: 14921 - RNA, 18 nt, artificial
  Chemically synthesized
gguuuuacuggucaaaau

SEQ ID NO: 14922 - RNA, 18 nt, artificial
  Chemically synthesized
gguaaaggcuacuuugac

SEQ ID NO: 14923 - RNA, 18 nt, artificial
  Chemically synthesized
aacugaauguccuccauu

SEQ ID NO: 14924 - RNA, 18 nt, artificial
  Chemically synthesized
aaaacaaggaucugcaaa

SEQ ID NO: 14925 - RNA, 18 nt, artificial
  Chemically synthesized
caacaacaucucagauua

SEQ ID NO: 14926 - RNA, 18 nt, artificial
  Chemically synthesized
gaguggaaaugugguauu

SEQ ID NO: 14927 - RNA, 18 nt, artificial
  Chemically synthesized
gggauguacauaaguuau

SEQ ID NO: 14928 - RNA, 18 nt, artificial
  Chemically synthesized
cuaaugaugcaacaucua

SEQ ID NO: 14929 - RNA, 18 nt, artificial
  Chemically synthesized
cuagaugggacauacaua

SEQ ID NO: 14930 - RNA, 18 nt, artificial
  Chemically synthesized
cgcccuugucaguaucag

SEQ ID NO: 14931 - RNA, 18 nt, artificial
  Chemically synthesized
guauucugcugaaaccaa

SEQ ID NO: 14932 - RNA, 18 nt, artificial
  Chemically synthesized
cauggacgagaccaucga

SEQ ID NO: 14933 - RNA, 18 nt, artificial
  Chemically synthesized
ggaucauuugaagaugcu

SEQ ID NO: 14934 - RNA, 18 nt, artificial
  Chemically synthesized
ucugaguugagaagacuu

SEQ ID NO: 14935 - RNA, 18 nt, artificial
  Chemically synthesized
acugaauucucuugagac

SEQ ID NO: 14936 - RNA, 18 nt, artificial
  Chemically synthesized
agaguauucugcugaaac

SEQ ID NO: 14937 - RNA, 18 nt, artificial
  Chemically synthesized
gcugcuuuauauaaaccu

SEQ ID NO: 14938 - RNA, 18 nt, artificial
  Chemically synthesized
cggauucagcccuccgaa

SEQ ID NO: 14939 - RNA, 18 nt, artificial
  Chemically synthesized
gaguugagaagacuugug

SEQ ID NO: 14940 - RNA, 18 nt, artificial
  Chemically synthesized
agcccgcccuugucagua

SEQ ID NO: 14941 - RNA, 18 nt, artificial
  Chemically synthesized
gagacgaccuccgagagc

SEQ ID NO: 14942 - RNA, 18 nt, artificial
  Chemically synthesized
ccagagaagaguauucug

SEQ ID NO: 14943 - RNA, 18 nt, artificial
  Chemically synthesized
gggaucggauaaauaaca

SEQ ID NO: 14944 - RNA, 18 nt, artificial
  Chemically synthesized
guacuagcucugugauua

SEQ ID NO: 14945 - RNA, 18 nt, artificial
  Chemically synthesized
ucuugagacuagauggga

SEQ ID NO: 14946 - RNA, 18 nt, artificial
  Chemically synthesized
ccaccucucuccaccucu

SEQ ID NO: 14947 - RNA, 18 nt, artificial
  Chemically synthesized
cagugcaucaguaugucu

SEQ ID NO: 14948 - RNA, 18 nt, artificial
  Chemically synthesized
gggaagacgaguguggag

SEQ ID NO: 14949 - RNA, 18 nt, artificial
  Chemically synthesized
cagagaagaguauucugc

SEQ ID NO: 14950 - RNA, 18 nt, artificial
  Chemically synthesized
ccugaagguagccauaca

SEQ ID NO: 14951 - RNA, 18 nt, artificial
  Chemically synthesized
ccuccauuucagagucag

SEQ ID NO: 14952 - RNA, 18 nt, artificial
  Chemically synthesized
gagcgagaacaauuacuc

SEQ ID NO: 14953 - RNA, 18 nt, artificial
  Chemically synthesized
aguugagaagacuugugc

SEQ ID NO: 14954 - RNA, 18 nt, artificial
  Chemically synthesized
ugcaagagucuuuacaua

SEQ ID NO: 14955 - RNA, 18 nt, artificial
  Chemically synthesized
cccugacugaauucucuu

SEQ ID NO: 14956 - RNA, 18 nt, artificial
  Chemically synthesized
gagaagacuugugccaac

SEQ ID NO: 14957 - RNA, 18 nt, artificial
  Chemically synthesized
aucuauucuugucacccu

SEQ ID NO: 14958 - RNA, 18 nt, artificial
  Chemically synthesized
ccagcagugcaucaguau

SEQ ID NO: 14959 - RNA, 18 nt, artificial
  Chemically synthesized
caucuauucuugucaccc

SEQ ID NO: 14960 - RNA, 18 nt, artificial
  Chemically synthesized
cuugcaauaguaacugaa

SEQ ID NO: 14961 - RNA, 18 nt, artificial
  Chemically synthesized
cuagcucugugauuagau

SEQ ID NO: 14962 - RNA, 18 nt, artificial
  Chemically synthesized
guaccauccagcagugca

SEQ ID NO: 14963 - RNA, 18 nt, artificial
  Chemically synthesized
ggaaaugugguauucucu

SEQ ID NO: 14964 - RNA, 18 nt, artificial
  Chemically synthesized
accagaggcuauuuaauu

SEQ ID NO: 14965 - RNA, 18 nt, artificial
  Chemically synthesized
aguggaucauuugaagau

SEQ ID NO: 14966 - RNA, 18 nt, artificial
  Chemically synthesized
gcauaggauuccgagagu

SEQ ID NO: 14967 - RNA, 18 nt, artificial
  Chemically synthesized
cuugcaauaggcugcaga

SEQ ID NO: 14968 - RNA, 18 nt, artificial
  Chemically synthesized
gagucagcuuaaaaccuc

SEQ ID NO: 14969 - RNA, 18 nt, artificial
  Chemically synthesized
cugacugaauucucuuga

SEQ ID NO: 14970 - RNA, 18 nt, artificial
  Chemically synthesized
cuauucuugucacccuuu

SEQ ID NO: 14971 - RNA, 18 nt, artificial
  Chemically synthesized
caucaguucucagauuaa

SEQ ID NO: 14972 - RNA, 18 nt, artificial
  Chemically synthesized
ccauuuagaaguuuccug

SEQ ID NO: 14973 - RNA, 18 nt, artificial
  Chemically synthesized
ugcauuacuuuguaaccu

SEQ ID NO: 14974 - RNA, 18 nt, artificial
  Chemically synthesized
guggaucauuugaagaug

SEQ ID NO: 14975 - RNA, 18 nt, artificial
  Chemically synthesized
ccucacgaguggaaaugu

SEQ ID NO: 14976 - RNA, 18 nt, artificial
  Chemically synthesized
gcgucgggaucggauaaa

SEQ ID NO: 14977 - RNA, 18 nt, artificial
  Chemically synthesized
gacacagcauguauuaug

SEQ ID NO: 14978 - RNA, 18 nt, artificial
  Chemically synthesized
cagaggcuauuuaauuca

SEQ ID NO: 14979 - RNA, 18 nt, artificial
  Chemically synthesized
cucuccaguuuguaggag

SEQ ID NO: 14980 - RNA, 18 nt, artificial
  Chemically synthesized
acaguuuaucugaguuga

SEQ ID NO: 14981 - RNA, 18 nt, artificial
  Chemically synthesized
caagcacgugagaguuuu

SEQ ID NO: 14982 - RNA, 18 nt, artificial
  Chemically synthesized
ccucagcagaccagcagu

SEQ ID NO: 14983 - RNA, 18 nt, artificial
  Chemically synthesized
gccaugacauccuccaug

SEQ ID NO: 14984 - RNA, 18 nt, artificial
  Chemically synthesized
cauauauagagagagagu

SEQ ID NO: 14985 - RNA, 18 nt, artificial
  Chemically synthesized
acuguguggagaaagcaa

SEQ ID NO: 14986 - RNA, 18 nt, artificial
  Chemically synthesized
ugaagaugcuucaggcaa

SEQ ID NO: 14987 - RNA, 18 nt, artificial
  Chemically synthesized
ccugagcuuaggaaguuu

SEQ ID NO: 14988 - RNA, 18 nt, artificial
  Chemically synthesized
gcaaugggauguacauaa

SEQ ID NO: 14989 - RNA, 18 nt, artificial
  Chemically synthesized
caagggaagacgagugug

SEQ ID NO: 14990 - RNA, 18 nt, artificial
  Chemically synthesized
ccaugccagagaagagua

SEQ ID NO: 14991 - RNA, 18 nt, artificial
  Chemically synthesized
gcaguugccuaccaugug

SEQ ID NO: 14992 - RNA, 18 nt, artificial
  Chemically synthesized
gaaaugugguauucucuu

SEQ ID NO: 14993 - RNA, 18 nt, artificial
  Chemically synthesized
gucaguaucagccacguc

SEQ ID NO: 14994 - RNA, 18 nt, artificial
  Chemically synthesized
gauaagagacacagcaug

SEQ ID NO: 14995 - RNA, 18 nt, artificial
  Chemically synthesized
ccuaugagcaguugccua

SEQ ID NO: 14996 - RNA, 18 nt, artificial
  Chemically synthesized
aggagacgaccuccgaga

SEQ ID NO: 14997 - RNA, 18 nt, artificial
  Chemically synthesized
caccagaggcuauuuaau

SEQ ID NO: 14998 - RNA, 18 nt, artificial
  Chemically synthesized
acuucauuucucuacugu

SEQ ID NO: 14999 - RNA, 18 nt, artificial
  Chemically synthesized
gcacccugaagguagcca

SEQ ID NO: 15000 - RNA, 18 nt, artificial
  Chemically synthesized
caguuucauuaggacuau

SEQ ID NO: 15001 - RNA, 18 nt, artificial
  Chemically synthesized
ccaacugcuuuugaaaaa

SEQ ID NO: 15002 - RNA, 18 nt, artificial
  Chemically synthesized
cagcauguauuaugcacu

SEQ ID NO: 15003 - RNA, 18 nt, artificial
  Chemically synthesized
cugcaaaguuagaaaaag

SEQ ID NO: 15004 - RNA, 18 nt, artificial
  Chemically synthesized
ccuggaaaauauauggac

SEQ ID NO: 15005 - RNA, 18 nt, artificial
  Chemically synthesized
agggaagacgagugugga

SEQ ID NO: 15006 - RNA, 18 nt, artificial
  Chemically synthesized
cucugcacccugaaggua

SEQ ID NO: 15007 - RNA, 18 nt, artificial
  Chemically synthesized
guuuguaggaguuugguu

SEQ ID NO: 15008 - RNA, 18 nt, artificial
  Chemically synthesized
gaaagaaaaggagaggga

SEQ ID NO: 15009 - RNA, 18 nt, artificial
  Chemically synthesized
gcccugacugaauucucu

SEQ ID NO: 15010 - RNA, 18 nt, artificial
  Chemically synthesized
ggagacgaccuccgagag

SEQ ID NO: 15011 - RNA, 18 nt, artificial
  Chemically synthesized
ccuuuuucuaugcaagag

SEQ ID NO: 15012 - RNA, 18 nt, artificial
  Chemically synthesized
guacagacaugccaagag

SEQ ID NO: 15013 - RNA, 18 nt, artificial
  Chemically synthesized
ucuacuguguggagaaag

SEQ ID NO: 15014 - RNA, 18 nt, artificial
  Chemically synthesized
caucucagauuauggcaa

SEQ ID NO: 15015 - RNA, 18 nt, artificial
  Chemically synthesized
gccuucuuuguacagaca

SEQ ID NO: 15016 - RNA, 18 nt, artificial
  Chemically synthesized
ugaagguagccauacaga

SEQ ID NO: 15017 - RNA, 18 nt, artificial
  Chemically synthesized
ucccaaaacaagaugaau

SEQ ID NO: 15018 - RNA, 18 nt, artificial
  Chemically synthesized
agacaugccaagagguga

SEQ ID NO: 15019 - RNA, 18 nt, artificial
  Chemically synthesized
agcucuuugucaaguuag

SEQ ID NO: 15020 - RNA, 18 nt, artificial
  Chemically synthesized
acuucaugagcauaggau

SEQ ID NO: 15021 - RNA, 18 nt, artificial
  Chemically synthesized
gaugaagcaaggagggag

SEQ ID NO: 15022 - RNA, 18 nt, artificial
  Chemically synthesized
uuuguuugguucaaggca

SEQ ID NO: 15023 - RNA, 18 nt, artificial
  Chemically synthesized
agaaaaggagagggauua

SEQ ID NO: 15024 - RNA, 18 nt, artificial
  Chemically synthesized
cuccacaacuucagaagu

SEQ ID NO: 15025 - RNA, 18 nt, artificial
  Chemically synthesized
caguaucagccacgucca

SEQ ID NO: 15026 - RNA, 18 nt, artificial
  Chemically synthesized
uguggagaaagcaauaaa

SEQ ID NO: 15027 - RNA, 18 nt, artificial
  Chemically synthesized
caauaguaacugaauguc

SEQ ID NO: 15028 - RNA, 18 nt, artificial
  Chemically synthesized
cuccuaaugaugcaacau

SEQ ID NO: 15029 - RNA, 18 nt, artificial
  Chemically synthesized
augccagagaagaguauu

SEQ ID NO: 15030 - RNA, 18 nt, artificial
  Chemically synthesized
guccaguccucagcagac

SEQ ID NO: 15031 - RNA, 18 nt, artificial
  Chemically synthesized
gccugagcuuaggaaguu

SEQ ID NO: 15032 - RNA, 18 nt, artificial
  Chemically synthesized
gcaccuaugagcaguugc

SEQ ID NO: 15033 - RNA, 18 nt, artificial
  Chemically synthesized
auauggugcugcuuuaua

SEQ ID NO: 15034 - RNA, 18 nt, artificial
  Chemically synthesized
cugacaucagcaacuuuu

SEQ ID NO: 15035 - RNA, 18 nt, artificial
  Chemically synthesized
gccgacagauccacaaag

SEQ ID NO: 15036 - RNA, 18 nt, artificial
  Chemically synthesized
agaugggacauacauaua

SEQ ID NO: 15037 - RNA, 18 nt, artificial
  Chemically synthesized
uuaucugaguugagaaga

SEQ ID NO: 15038 - RNA, 18 nt, artificial
  Chemically synthesized
gcgucagggugcugcgcc

SEQ ID NO: 15039 - RNA, 18 nt, artificial
  Chemically synthesized
gcugcagacauuuuaaua

SEQ ID NO: 15040 - RNA, 18 nt, artificial
  Chemically synthesized
gagcauaggauuccgaga

SEQ ID NO: 15041 - RNA, 18 nt, artificial
  Chemically synthesized
ccaccaucauccgcucca

SEQ ID NO: 15042 - RNA, 18 nt, artificial
  Chemically synthesized
cgcacacgcucuugccau

SEQ ID NO: 15043 - RNA, 18 nt, artificial
  Chemically synthesized
aauucucuugagacuaga

SEQ ID NO: 15044 - RNA, 18 nt, artificial
  Chemically synthesized
ccaccagaggcuauuuaa

SEQ ID NO: 15045 - RNA, 18 nt, artificial
  Chemically synthesized
gacauggacgagaccauc

SEQ ID NO: 15046 - RNA, 18 nt, artificial
  Chemically synthesized
ucagauuauggcaagaaa

SEQ ID NO: 15047 - RNA, 18 nt, artificial
  Chemically synthesized
gaggauagguuaagaaag

SEQ ID NO: 15048 - RNA, 18 nt, artificial
  Chemically synthesized
ggugaugaagcaaggagg

SEQ ID NO: 15049 - RNA, 18 nt, artificial
  Chemically synthesized
agaugaauguaugcaaug

SEQ ID NO: 15050 - RNA, 18 nt, artificial
  Chemically synthesized
ggagaaguuacauuucug

SEQ ID NO: 15051 - RNA, 18 nt, artificial
  Chemically synthesized
gcagcucgguaacugaca

SEQ ID NO: 15052 - RNA, 18 nt, artificial
  Chemically synthesized
cuuguuaccauuuagaag

SEQ ID NO: 15053 - RNA, 18 nt, artificial
  Chemically synthesized
gacuagaugggacauaca

SEQ ID NO: 15054 - RNA, 18 nt, artificial
  Chemically synthesized
ugcacuucauuucucuac

SEQ ID NO: 15055 - RNA, 18 nt, artificial
  Chemically synthesized
gaucggauaaauaacagu

SEQ ID NO: 15056 - RNA, 18 nt, artificial
  Chemically synthesized
ggugcggcuugugucuca

SEQ ID NO: 15057 - RNA, 18 nt, artificial
  Chemically synthesized
ggcucuugcggccgagca

SEQ ID NO: 15058 - RNA, 18 nt, artificial
  Chemically synthesized
ugacauuuagcagugcau

SEQ ID NO: 15059 - RNA, 18 nt, artificial
  Chemically synthesized
gaaaggaaagggacagaa

SEQ ID NO: 15060 - RNA, 18 nt, artificial
  Chemically synthesized
agcgagaacaauuacucg

SEQ ID NO: 15061 - RNA, 18 nt, artificial
  Chemically synthesized
accuuuuucuaugcaaga

SEQ ID NO: 15062 - RNA, 18 nt, artificial
  Chemically synthesized
cgaggagacgaccuccga

SEQ ID NO: 15063 - RNA, 18 nt, artificial
  Chemically synthesized
gcccgcccuugucaguau

SEQ ID NO: 15064 - RNA, 18 nt, artificial
  Chemically synthesized
gucucaucucagcacuug

SEQ ID NO: 15065 - RNA, 18 nt, artificial
  Chemically synthesized
ccaccaccaucauccgcu

SEQ ID NO: 15066 - RNA, 18 nt, artificial
  Chemically synthesized
cgaccuccgagagcgaca

SEQ ID NO: 15067 - RNA, 18 nt, artificial
  Chemically synthesized
aagagacacagcauguau

SEQ ID NO: 15068 - RNA, 18 nt, artificial
  Chemically synthesized
guaacugaauguccucca

SEQ ID NO: 15069 - RNA, 18 nt, artificial
  Chemically synthesized
ugaugcaacaucuauucu

SEQ ID NO: 15070 - RNA, 18 nt, artificial
  Chemically synthesized
aaagaaaaggagagggau

SEQ ID NO: 15071 - RNA, 18 nt, artificial
  Chemically synthesized
gugagagagucguguuuc

SEQ ID NO: 15072 - RNA, 18 nt, artificial
  Chemically synthesized
caugccagagaagaguau

SEQ ID NO: 15073 - RNA, 18 nt, artificial
  Chemically synthesized
ugcaacaucuauucuugu

SEQ ID NO: 15074 - RNA, 18 nt, artificial
  Chemically synthesized
agcagugcauugguauaa

SEQ ID NO: 15075 - RNA, 18 nt, artificial
  Chemically synthesized
cucuccacaacuucagaa

SEQ ID NO: 15076 - RNA, 18 nt, artificial
  Chemically synthesized
uacuguaccuagucuuuu

SEQ ID NO: 15077 - RNA, 18 nt, artificial
  Chemically synthesized
gauucagcccuccgaaug

SEQ ID NO: 15078 - RNA, 18 nt, artificial
  Chemically synthesized
uccuaaugaugcaacauc

SEQ ID NO: 15079 - RNA, 18 nt, artificial
  Chemically synthesized
cuucuuuguacagacaug

SEQ ID NO: 15080 - RNA, 18 nt, artificial
  Chemically synthesized
ugagcaguugccuaccau

SEQ ID NO: 15081 - RNA, 18 nt, artificial
  Chemically synthesized
caaguugaaagaucuagu

SEQ ID NO: 15082 - RNA, 18 nt, artificial
  Chemically synthesized
uguccuccauuucagagu

SEQ ID NO: 15083 - RNA, 18 nt, artificial
  Chemically synthesized
agccacguccaguccuca

SEQ ID NO: 15084 - RNA, 18 nt, artificial
  Chemically synthesized
cguaagugccugagcuua

SEQ ID NO: 15085 - RNA, 18 nt, artificial
  Chemically synthesized
agugcaccuaugagcagu

SEQ ID NO: 15086 - RNA, 18 nt, artificial
  Chemically synthesized
gccuaacagaaguugcgc

SEQ ID NO: 15087 - RNA, 18 nt, artificial
  Chemically synthesized
uaacauugcacaagggaa

SEQ ID NO: 15088 - RNA, 18 nt, artificial
  Chemically synthesized
cuuaggaaguuuucuucu

SEQ ID NO: 15089 - RNA, 18 nt, artificial
  Chemically synthesized
agcauguauuaugcacuu

SEQ ID NO: 15090 - RNA, 18 nt, artificial
  Chemically synthesized
uggagaaagcaauaaaca

SEQ ID NO: 15091 - RNA, 18 nt, artificial
  Chemically synthesized
agcagaccagcaguggaa

SEQ ID NO: 15092 - RNA, 18 nt, artificial
  Chemically synthesized
cgaguggaaaugugguau

SEQ ID NO: 15093 - RNA, 18 nt, artificial
  Chemically synthesized
cuccgagagcgacaugga

SEQ ID NO: 15094 - RNA, 18 nt, artificial
  Chemically synthesized
agcaguugccuaccaugu

SEQ ID NO: 15095 - RNA, 18 nt, artificial
  Chemically synthesized
ugaauguccuccauuuca

SEQ ID NO: 15096 - RNA, 18 nt, artificial
  Chemically synthesized
caaaugacaguggaucau

SEQ ID NO: 15097 - RNA, 18 nt, artificial
  Chemically synthesized
gcaauaguaacugaaugu

SEQ ID NO: 15098 - RNA, 18 nt, artificial
  Chemically synthesized
cucuugccauggacuuca

SEQ ID NO: 15099 - RNA, 18 nt, artificial
  Chemically synthesized
gcaaaugacaguggauca

SEQ ID NO: 15100 - RNA, 18 nt, artificial
  Chemically synthesized
caguaugucugaauuggg

SEQ ID NO: 15101 - RNA, 18 nt, artificial
  Chemically synthesized
acuucuugcaauaguaac

SEQ ID NO: 15102 - RNA, 18 nt, artificial
  Chemically synthesized
ugcacaagggaagacgag

SEQ ID NO: 15103 - RNA, 18 nt, artificial
  Chemically synthesized
ccaguccucagcagacca

SEQ ID NO: 15104 - RNA, 18 nt, artificial
  Chemically synthesized
aggcuacuuugacgcaca

SEQ ID NO: 15105 - RNA, 18 nt, artificial
  Chemically synthesized
aggugacauuuagcagug

SEQ ID NO: 15106 - RNA, 18 nt, artificial
  Chemically synthesized
gcacgugagaguuuuugu

SEQ ID NO: 15107 - RNA, 18 nt, artificial
  Chemically synthesized
auuucaucaguucucaga

SEQ ID NO: 15108 - RNA, 18 nt, artificial
  Chemically synthesized
gagcgacauggacgagac

SEQ ID NO: 15109 - RNA, 18 nt, artificial
  Chemically synthesized
cagauuaacaagcauuuc

SEQ ID NO: 15110 - RNA, 18 nt, artificial
  Chemically synthesized
agagagagugagagaguc

SEQ ID NO: 15111 - RNA, 18 nt, artificial
  Chemically synthesized
guuagugauugcauuuga

SEQ ID NO: 15112 - RNA, 18 nt, artificial
  Chemically synthesized
cuucaugagcauaggauu

SEQ ID NO: 15113 - RNA, 18 nt, artificial
  Chemically synthesized
gcaaaguacuagcucugu

SEQ ID NO: 15114 - RNA, 18 nt, artificial
  Chemically synthesized
agauccacaaaggaacaa

SEQ ID NO: 15115 - RNA, 18 nt, artificial
  Chemically synthesized
gaaagggacagaagucuu

SEQ ID NO: 15116 - RNA, 18 nt, artificial
  Chemically synthesized
aucaguaugucugaauug

SEQ ID NO: 15117 - RNA, 18 nt, artificial
  Chemically synthesized
ucuccaguuuguaggagu

SEQ ID NO: 15118 - RNA, 18 nt, artificial
  Chemically synthesized
cacguccaguccucagca

SEQ ID NO: 15119 - RNA, 18 nt, artificial
  Chemically synthesized
uucucuugagacuagaug

SEQ ID NO: 15120 - RNA, 18 nt, artificial
  Chemically synthesized
caaaauauggugcugcuu

SEQ ID NO: 15121 - RNA, 18 nt, artificial
  Chemically synthesized
ccaagaggugacauuuag

SEQ ID NO: 15122 - RNA, 18 nt, artificial
  Chemically synthesized
cacagcauguauuaugca

SEQ ID NO: 15123 - RNA, 18 nt, artificial
  Chemically synthesized
aguucucagauuaacaag

SEQ ID NO: 15124 - RNA, 18 nt, artificial
  Chemically synthesized
ccucucucuugucccucu

SEQ ID NO: 15125 - RNA, 18 nt, artificial
  Chemically synthesized
cuggaggugaugaagcaa

SEQ ID NO: 15126 - RNA, 18 nt, artificial
  Chemically synthesized
cuauuugagacacaaacc

SEQ ID NO: 15127 - RNA, 18 nt, artificial
  Chemically synthesized
gcagacauuuuaauacca

SEQ ID NO: 15128 - RNA, 18 nt, artificial
  Chemically synthesized
ugcaauaggcugcagaca

SEQ ID NO: 15129 - RNA, 18 nt, artificial
  Chemically synthesized
accauuuagaaguuuccu

SEQ ID NO: 15130 - RNA, 18 nt, artificial
  Chemically synthesized
ccgcccuugucaguauca

SEQ ID NO: 15131 - RNA, 18 nt, artificial
  Chemically synthesized
gagcuuaggaaguuuucu

SEQ ID NO: 15132 - RNA, 18 nt, artificial
  Chemically synthesized
cgcucuugccauggacuu

SEQ ID NO: 15133 - RNA, 18 nt, artificial
  Chemically synthesized
acgagaccaucgacgugg

SEQ ID NO: 15134 - RNA, 18 nt, artificial
  Chemically synthesized
ggaucggauaaauaacag

SEQ ID NO: 15135 - RNA, 18 nt, artificial
  Chemically synthesized
gaagcaaggagggagcac

SEQ ID NO: 15136 - RNA, 18 nt, artificial
  Chemically synthesized
ucaagcacgugagaguuu

SEQ ID NO: 15137 - RNA, 18 nt, artificial
  Chemically synthesized
gggaaagagccgcuagga

SEQ ID NO: 15138 - RNA, 18 nt, artificial
  Chemically synthesized
ggaccguaccauccagca

SEQ ID NO: 15139 - RNA, 18 nt, artificial
  Chemically synthesized
cacacagcuucccucugu

SEQ ID NO: 15140 - RNA, 18 nt, artificial
  Chemically synthesized
cauuuagcagugcauugg

SEQ ID NO: 15141 - RNA, 18 nt, artificial
  Chemically synthesized
cugcagacauuuuaauac

SEQ ID NO: 15142 - RNA, 18 nt, artificial
  Chemically synthesized
cugaaaucaagcacguga

SEQ ID NO: 15143 - RNA, 18 nt, artificial
  Chemically synthesized
cuuugggagaaguuacau

SEQ ID NO: 15144 - RNA, 18 nt, artificial
  Chemically synthesized
gcucgguaacugacauca

SEQ ID NO: 15145 - RNA, 18 nt, artificial
  Chemically synthesized
agagagagagugagagag

SEQ ID NO: 15146 - RNA, 18 nt, artificial
  Chemically synthesized
cucaaaauauggugcugc

SEQ ID NO: 15147 - RNA, 18 nt, artificial
  Chemically synthesized
aagauaagagacacagca

SEQ ID NO: 15148 - RNA, 18 nt, artificial
  Chemically synthesized
cgagcagaguugcggcgu

SEQ ID NO: 15149 - RNA, 18 nt, artificial
  Chemically synthesized
ccguggaaggccuggacu

SEQ ID NO: 15150 - RNA, 18 nt, artificial
  Chemically synthesized
aaaaggagagggauuaua

SEQ ID NO: 15151 - RNA, 18 nt, artificial
  Chemically synthesized
agggauuauagagaaaag

SEQ ID NO: 15152 - RNA, 18 nt, artificial
  Chemically synthesized
cagcuucccucuguccuu

SEQ ID NO: 15153 - RNA, 18 nt, artificial
  Chemically synthesized
cuugaaaacucuccaguu

SEQ ID NO: 15154 - RNA, 18 nt, artificial
  Chemically synthesized
gcagugcaucaguauguc

SEQ ID NO: 15155 - RNA, 18 nt, artificial
  Chemically synthesized
ucgggaucggauaaauaa

SEQ ID NO: 15156 - RNA, 18 nt, artificial
  Chemically synthesized
accguaccauccagcagu

SEQ ID NO: 15157 - RNA, 18 nt, artificial
  Chemically synthesized
ucuaugcaagagucuuua

SEQ ID NO: 15158 - RNA, 18 nt, artificial
  Chemically synthesized
cucucuugucccucucug

SEQ ID NO: 15159 - RNA, 18 nt, artificial
  Chemically synthesized
cagaagucuugcaauagg

SEQ ID NO: 15160 - RNA, 18 nt, artificial
  Chemically synthesized
agaagugccuccugccca

SEQ ID NO: 15161 - RNA, 18 nt, artificial
  Chemically synthesized
aguuuguaggaguuuggu

SEQ ID NO: 15162 - RNA, 18 nt, artificial
  Chemically synthesized
caguugccuaccaugugu

SEQ ID NO: 15163 - RNA, 18 nt, artificial
  Chemically synthesized
cuugaacuucuugcaaua

SEQ ID NO: 15164 - RNA, 18 nt, artificial
  Chemically synthesized
cccuccgaaugccaucca

SEQ ID NO: 15165 - RNA, 18 nt, artificial
  Chemically synthesized
uuucuaugcaagagucuu

SEQ ID NO: 15166 - RNA, 18 nt, artificial
  Chemically synthesized
cgccucuccacaacuuca

SEQ ID NO: 15167 - RNA, 18 nt, artificial
  Chemically synthesized
cgugggaaagagccgcua

SEQ ID NO: 15168 - RNA, 18 nt, artificial
  Chemically synthesized
acacaaaccucacgagug

SEQ ID NO: 15169 - RNA, 18 nt, artificial
  Chemically synthesized
guaacugacaucagcaac

SEQ ID NO: 15170 - RNA, 18 nt, artificial
  Chemically synthesized
agagucagcuuaaaaccu

SEQ ID NO: 15171 - RNA, 18 nt, artificial
  Chemically synthesized
gugucucaucucagcacu

SEQ ID NO: 15172 - RNA, 18 nt, artificial
  Chemically synthesized
ggccaugacauccuccau

SEQ ID NO: 15173 - RNA, 18 nt, artificial
  Chemically synthesized
aagagucuuuacauacca

SEQ ID NO: 15174 - RNA, 18 nt, artificial
  Chemically synthesized
uaccauguguccaccaga

SEQ ID NO: 15175 - RNA, 18 nt, artificial
  Chemically synthesized
ugcauugguauaagcaau

SEQ ID NO: 15176 - RNA, 18 nt, artificial
  Chemically synthesized
caaguuagugauugcauu

SEQ ID NO: 15177 - RNA, 18 nt, artificial
  Chemically synthesized
agcagugcaucaguaugu

SEQ ID NO: 15178 - RNA, 18 nt, artificial
  Chemically synthesized
ccuaccauguguccacca

SEQ ID NO: 15179 - RNA, 18 nt, artificial
  Chemically synthesized
gcaaggagggagcacuag

SEQ ID NO: 15180 - RNA, 18 nt, artificial
  Chemically synthesized
cuuugacgcacacgcucu

SEQ ID NO: 15181 - RNA, 18 nt, artificial
  Chemically synthesized
uucuugaacuucuugcaa

SEQ ID NO: 15182 - RNA, 18 nt, artificial
  Chemically synthesized
aggcuauuuaauucaugc

SEQ ID NO: 15183 - RNA, 18 nt, artificial
  Chemically synthesized
cucccuuuuuuguuuggu

SEQ ID NO: 15184 - RNA, 18 nt, artificial
  Chemically synthesized
ggccgagcagaguugcgg

SEQ ID NO: 15185 - RNA, 18 nt, artificial
  Chemically synthesized
agaagacuugugccaacu

SEQ ID NO: 15186 - RNA, 18 nt, artificial
  Chemically synthesized
auugcaaaugacagugga

SEQ ID NO: 15187 - RNA, 18 nt, artificial
  Chemically synthesized
gugcggcuugugucucau

SEQ ID NO: 15188 - RNA, 18 nt, artificial
  Chemically synthesized
aaggagagggauuauaga

SEQ ID NO: 15189 - RNA, 18 nt, artificial
  Chemically synthesized
gccgcuaggagcagaccg

SEQ ID NO: 15190 - RNA, 18 nt, artificial
  Chemically synthesized
agagccgcuaggagcaga

SEQ ID NO: 15191 - RNA, 18 nt, artificial
  Chemically synthesized
gcccaugcggauucagcc

SEQ ID NO: 15192 - RNA, 18 nt, artificial
  Chemically synthesized
caauaggcugcagacauu

SEQ ID NO: 15193 - RNA, 18 nt, artificial
  Chemically synthesized
cauugcacaagggaagac

SEQ ID NO: 15194 - RNA, 18 nt, artificial
  Chemically synthesized
ggccgcggccacagccau

SEQ ID NO: 15195 - RNA, 18 nt, artificial
  Chemically synthesized
ucuccaacaacaacaucu

SEQ ID NO: 15196 - RNA, 18 nt, artificial
  Chemically synthesized
gacuugugccaacugcuu

SEQ ID NO: 15197 - RNA, 18 nt, artificial
  Chemically synthesized
ugccuaaacuagugcuau

SEQ ID NO: 15198 - RNA, 18 nt, artificial
  Chemically synthesized
agaaguuacauuucugga

SEQ ID NO: 15199 - RNA, 18 nt, artificial
  Chemically synthesized
ucuauucuugucacccuu

SEQ ID NO: 15200 - RNA, 18 nt, artificial
  Chemically synthesized
agaggugacauuuagcag

SEQ ID NO: 15201 - RNA, 18 nt, artificial
  Chemically synthesized
gaagacuugugccaacug

SEQ ID NO: 15202 - RNA, 18 nt, artificial
  Chemically synthesized
acugaauguccuccauuu

SEQ ID NO: 15203 - RNA, 18 nt, artificial
  Chemically synthesized
gccuggacuccucggauc

SEQ ID NO: 15204 - RNA, 18 nt, artificial
  Chemically synthesized
uuucaucaguucucagau

SEQ ID NO: 15205 - RNA, 18 nt, artificial
  Chemically synthesized
gauuaacaagcauuucug

SEQ ID NO: 15206 - RNA, 18 nt, artificial
  Chemically synthesized
ugaaaacucuccaguuug

SEQ ID NO: 15207 - RNA, 18 nt, artificial
  Chemically synthesized
ugggauguacauaaguua

SEQ ID NO: 15208 - RNA, 18 nt, artificial
  Chemically synthesized
gcuacuuugacgcacacg

SEQ ID NO: 15209 - RNA, 18 nt, artificial
  Chemically synthesized
ugucaguaucagccacgu

SEQ ID NO: 15210 - RNA, 18 nt, artificial
  Chemically synthesized
uaugcaagagucuuuaca

SEQ ID NO: 15211 - RNA, 18 nt, artificial
  Chemically synthesized
ugaugaagcaaggaggga

SEQ ID NO: 15212 - RNA, 18 nt, artificial
  Chemically synthesized
auuauagagaaaaggcgu

SEQ ID NO: 15213 - RNA, 18 nt, artificial
  Chemically synthesized
gagagagugagagagucg

SEQ ID NO: 15214 - RNA, 18 nt, artificial
  Chemically synthesized
cacguuugcccaugcgga

SEQ ID NO: 15215 - RNA, 18 nt, artificial
  Chemically synthesized
guuugguucaaggcagcu

SEQ ID NO: 15216 - RNA, 18 nt, artificial
  Chemically synthesized
gggacagaaguuggagcu

SEQ ID NO: 15217 - RNA, 18 nt, artificial
  Chemically synthesized
ggaaguaaaaugcccuga

SEQ ID NO: 15218 - RNA, 18 nt, artificial
  Chemically synthesized
gccacguccaguccucag

SEQ ID NO: 15219 - RNA, 18 nt, artificial
  Chemically synthesized
cuuuuuuuucucucccuu

SEQ ID NO: 15220 - RNA, 18 nt, artificial
  Chemically synthesized
ccacaacuucagaagugc

SEQ ID NO: 15221 - RNA, 18 nt, artificial
  Chemically synthesized
accuagucuuuuuugcau

SEQ ID NO: 15222 - RNA, 18 nt, artificial
  Chemically synthesized
gaaguuacauuucuggag

SEQ ID NO: 15223 - RNA, 18 nt, artificial
  Chemically synthesized
cucgguaacugacaucag

SEQ ID NO: 15224 - RNA, 18 nt, artificial
  Chemically synthesized
uaguuugccuucuuugua

SEQ ID NO: 15225 - RNA, 18 nt, artificial
  Chemically synthesized
aaaccucacgaguggaaa

SEQ ID NO: 15226 - RNA, 18 nt, artificial
  Chemically synthesized
gucgccucuccacaacuu

SEQ ID NO: 15227 - RNA, 18 nt, artificial
  Chemically synthesized
cagcagugcaucaguaug

SEQ ID NO: 15228 - RNA, 18 nt, artificial
  Chemically synthesized
agagucuuuacauaccac

SEQ ID NO: 15229 - RNA, 18 nt, artificial
  Chemically synthesized
acagaagucuugcaauag

SEQ ID NO: 15230 - RNA, 18 nt, artificial
  Chemically synthesized
gacgagaccaucgacgug

SEQ ID NO: 15231 - RNA, 18 nt, artificial
  Chemically synthesized
uugccuucuuuguacaga

SEQ ID NO: 15232 - RNA, 18 nt, artificial
  Chemically synthesized
gcccuugucaguaucagc

SEQ ID NO: 15233 - RNA, 18 nt, artificial
  Chemically synthesized
gagcaguugccuaccaug

SEQ ID NO: 15234 - RNA, 18 nt, artificial
  Chemically synthesized
uuacauuucuggagguga

SEQ ID NO: 15235 - RNA, 18 nt, artificial
  Chemically synthesized
auauauggaccguaccau

SEQ ID NO: 15236 - RNA, 18 nt, artificial
  Chemically synthesized
gcgggugcggcuuguguc

SEQ ID NO: 15237 - RNA, 18 nt, artificial
  Chemically synthesized
uaagagacacagcaugua

SEQ ID NO: 15238 - RNA, 18 nt, artificial
  Chemically synthesized
gccuccaugccucagagu

SEQ ID NO: 15239 - RNA, 18 nt, artificial
  Chemically synthesized
gcacuaggaagagaaaag

SEQ ID NO: 15240 - RNA, 18 nt, artificial
  Chemically synthesized
uaucugaguugagaagac

SEQ ID NO: 15241 - RNA, 18 nt, artificial
  Chemically synthesized
gggaggaggcgggcguca

SEQ ID NO: 15242 - RNA, 18 nt, artificial
  Chemically synthesized
aaaagauaagagacacag

SEQ ID NO: 15243 - RNA, 18 nt, artificial
  Chemically synthesized
ggaggcgggcgucagggu

SEQ ID NO: 15244 - RNA, 18 nt, artificial
  Chemically synthesized
acugacaucagcaacuuu

SEQ ID NO: 15245 - RNA, 18 nt, artificial
  Chemically synthesized
gaggugaugaagcaagga

SEQ ID NO: 15246 - RNA, 18 nt, artificial
  Chemically synthesized
caacaacaacaucucaga

SEQ ID NO: 15247 - RNA, 18 nt, artificial
  Chemically synthesized
acuugugccaacugcuuu

SEQ ID NO: 15248 - RNA, 18 nt, artificial
  Chemically synthesized
cacuucauuucucuacug

SEQ ID NO: 15249 - RNA, 18 nt, artificial
  Chemically synthesized
ggucuucgccgggaugaa

SEQ ID NO: 15250 - RNA, 18 nt, artificial
  Chemically synthesized
cguuugcccaugcggauu

SEQ ID NO: 15251 - RNA, 18 nt, artificial
  Chemically synthesized
ucagccacguccaguccu

SEQ ID NO: 15252 - RNA, 18 nt, artificial
  Chemically synthesized
gaccuccgagagcgacau

SEQ ID NO: 15253 - RNA, 18 nt, artificial
  Chemically synthesized
ccaccucucucuuguccc

SEQ ID NO: 15254 - RNA, 18 nt, artificial
  Chemically synthesized
caugccaagaggugacau

SEQ ID NO: 15255 - RNA, 18 nt, artificial
  Chemically synthesized
ggcucugcucuccucacg

SEQ ID NO: 15256 - RNA, 18 nt, artificial
  Chemically synthesized
auaccaugccagagaaga

SEQ ID NO: 15257 - RNA, 18 nt, artificial
  Chemically synthesized
uauuugagacacaaaccu

SEQ ID NO: 15258 - RNA, 18 nt, artificial
  Chemically synthesized
cuuaguuugccuucuuug

SEQ ID NO: 15259 - RNA, 18 nt, artificial
  Chemically synthesized
uggacgagaccaucgacg

SEQ ID NO: 15260 - RNA, 18 nt, artificial
  Chemically synthesized
agagugccuaacagaagu

SEQ ID NO: 15261 - RNA, 18 nt, artificial
  Chemically synthesized
uagagagagagugagaga

SEQ ID NO: 15262 - RNA, 18 nt, artificial
  Chemically synthesized
acauuuagcagugcauug

SEQ ID NO: 15263 - RNA, 18 nt, artificial
  Chemically synthesized
acagcuucccucuguccu

SEQ ID NO: 15264 - RNA, 18 nt, artificial
  Chemically synthesized
gucccucucugccaccgu

SEQ ID NO: 15265 - RNA, 18 nt, artificial
  Chemically synthesized
ugggagaaguuacauuuc

SEQ ID NO: 15266 - RNA, 18 nt, artificial
  Chemically synthesized
gagggagcacuaggaaga

SEQ ID NO: 15267 - RNA, 18 nt, artificial
  Chemically synthesized
ucauuucucuacugugug

SEQ ID NO: 15268 - RNA, 18 nt, artificial
  Chemically synthesized
agcacuugcgccacccag

SEQ ID NO: 15269 - RNA, 18 nt, artificial
  Chemically synthesized
caugccaacuugaaaacu

SEQ ID NO: 15270 - RNA, 18 nt, artificial
  Chemically synthesized
cucucuccaccucucucu

SEQ ID NO: 15271 - RNA, 18 nt, artificial
  Chemically synthesized
gcacacagcuucccucug

SEQ ID NO: 15272 - RNA, 18 nt, artificial
  Chemically synthesized
cagcccuccgaaugccau

SEQ ID NO: 15273 - RNA, 18 nt, artificial
  Chemically synthesized
gcggcugcacacagcuuc

SEQ ID NO: 15274 - RNA, 18 nt, artificial
  Chemically synthesized
cauaggauuccgagagug

SEQ ID NO: 15275 - RNA, 18 nt, artificial
  Chemically synthesized
ugcaauaguaacugaaug

SEQ ID NO: 15276 - RNA, 18 nt, artificial
  Chemically synthesized
ggaggaggcgggcgucag

SEQ ID NO: 15277 - RNA, 18 nt, artificial
  Chemically synthesized
caugcggauucagcccuc

SEQ ID NO: 15278 - RNA, 18 nt, artificial
  Chemically synthesized
ccacggcucugcucuccu

SEQ ID NO: 15279 - RNA, 18 nt, artificial
  Chemically synthesized
ggauggcucaaaauaugg

SEQ ID NO: 15280 - RNA, 18 nt, artificial
  Chemically synthesized
gaugaauguaugcaaugg

SEQ ID NO: 15281 - RNA, 18 nt, artificial
  Chemically synthesized
gcuuaaaaccucugcacc

SEQ ID NO: 15282 - RNA, 18 nt, artificial
  Chemically synthesized
agacuugugccaacugcu

SEQ ID NO: 15283 - RNA, 18 nt, artificial
  Chemically synthesized
aaugacaguggaucauuu

SEQ ID NO: 15284 - RNA, 18 nt, artificial
  Chemically synthesized
gucacccuuugggagaag

SEQ ID NO: 15285 - RNA, 18 nt, artificial
  Chemically synthesized
cuugucgccucuccacaa

SEQ ID NO: 15286 - RNA, 18 nt, artificial
  Chemically synthesized
cgcucggcguccgagcuu

SEQ ID NO: 15287 - RNA, 18 nt, artificial
  Chemically synthesized
cuugucaguaucagccac

SEQ ID NO: 15288 - RNA, 18 nt, artificial
  Chemically synthesized
cuucacacuuguuaccau

SEQ ID NO: 15289 - RNA, 18 nt, artificial
  Chemically synthesized
cgagaacaauuacucggg

SEQ ID NO: 15290 - RNA, 18 nt, artificial
  Chemically synthesized
ugcaucaguaugucugaa

SEQ ID NO: 15291 - RNA, 18 nt, artificial
  Chemically synthesized
ugaauucuccaacaacaa

SEQ ID NO: 15292 - RNA, 18 nt, artificial
  Chemically synthesized
ucaguuucauuaggacua

SEQ ID NO: 15293 - RNA, 18 nt, artificial
  Chemically synthesized
ccugcgaggagacgaccu

SEQ ID NO: 15294 - RNA, 18 nt, artificial
  Chemically synthesized
ccauccagcagugcauca

SEQ ID NO: 15295 - RNA, 18 nt, artificial
  Chemically synthesized
agacacaaaccucacgag

SEQ ID NO: 15296 - RNA, 18 nt, artificial
  Chemically synthesized
gaccguaccauccagcag

SEQ ID NO: 15297 - RNA, 18 nt, artificial
  Chemically synthesized
gcugcacacagcuucccu

SEQ ID NO: 15298 - RNA, 18 nt, artificial
  Chemically synthesized
acauauauagagagagag

SEQ ID NO: 15299 - RNA, 18 nt, artificial
  Chemically synthesized
uggaggugaugaagcaag

SEQ ID NO: 15300 - RNA, 18 nt, artificial
  Chemically synthesized
ugaaguccuuuuugacua

SEQ ID NO: 15301 - RNA, 18 nt, artificial
  Chemically synthesized
auuacuguaccuagucuu

SEQ ID NO: 15302 - RNA, 18 nt, artificial
  Chemically synthesized
uguacagacaugccaaga

SEQ ID NO: 15303 - RNA, 18 nt, artificial
  Chemically synthesized
acuugaaaacucuccagu

SEQ ID NO: 15304 - RNA, 18 nt, artificial
  Chemically synthesized
gaaguaaaaugcccugac

SEQ ID NO: 15305 - RNA, 18 nt, artificial
  Chemically synthesized
cacaagggaagacgagug

SEQ ID NO: 15306 - RNA, 18 nt, artificial
  Chemically synthesized
gcuuuugaaaaacaagga

SEQ ID NO: 15307 - RNA, 18 nt, artificial
  Chemically synthesized
ugaaauuacuguaccuag

SEQ ID NO: 15308 - RNA, 18 nt, artificial
  Chemically synthesized
gcccaugccuaaacuagu

SEQ ID NO: 15309 - RNA, 18 nt, artificial
  Chemically synthesized
gaguugcggcgugggaaa

SEQ ID NO: 15310 - RNA, 18 nt, artificial
  Chemically synthesized
aaaacucuccaguuugua

SEQ ID NO: 15311 - RNA, 18 nt, artificial
  Chemically synthesized
cacaaaggaacaauaaag

SEQ ID NO: 15312 - RNA, 18 nt, artificial
  Chemically synthesized
gacuucaugagcauagga

SEQ ID NO: 15313 - RNA, 18 nt, artificial
  Chemically synthesized
caagaaagaaaaggagag

SEQ ID NO: 15314 - RNA, 18 nt, artificial
  Chemically synthesized
augcacuucauuucucua

SEQ ID NO: 15315 - RNA, 18 nt, artificial
  Chemically synthesized
caguccucagcagaccag

SEQ ID NO: 15316 - RNA, 18 nt, artificial
  Chemically synthesized
cagcaacuuuugaaaacu

SEQ ID NO: 15317 - RNA, 18 nt, artificial
  Chemically synthesized
agguagccauacagaugc

SEQ ID NO: 15318 - RNA, 18 nt, artificial
  Chemically synthesized
gagagucguguuucguaa

SEQ ID NO: 15319 - RNA, 18 nt, artificial
  Chemically synthesized
gcuccacccgcaucacug

SEQ ID NO: 15320 - RNA, 18 nt, artificial
  Chemically synthesized
guuaagaaaggaaaggga

SEQ ID NO: 15321 - RNA, 18 nt, artificial
  Chemically synthesized
ucaaguuagugauugcau

SEQ ID NO: 15322 - RNA, 18 nt, artificial
  Chemically synthesized
agcuuaggaaguuuucuu

SEQ ID NO: 15323 - RNA, 18 nt, artificial
  Chemically synthesized
gaagacgaguguggagga

SEQ ID NO: 15324 - RNA, 18 nt, artificial
  Chemically synthesized
ccaucagcccgcccuugu

SEQ ID NO: 15325 - RNA, 18 nt, artificial
  Chemically synthesized
agcacgugagaguuuuug

SEQ ID NO: 15326 - RNA, 18 nt, artificial
  Chemically synthesized
ucucagauuaacaagcau

SEQ ID NO: 15327 - RNA, 18 nt, artificial
  Chemically synthesized
cuuugucaaguuagugau

SEQ ID NO: 15328 - RNA, 18 nt, artificial
  Chemically synthesized
acaagggaagacgagugu

SEQ ID NO: 15329 - RNA, 18 nt, artificial
  Chemically synthesized
cugcuuuugaaaaacaag

SEQ ID NO: 15330 - RNA, 18 nt, artificial
  Chemically synthesized
augccaagaggugacauu

SEQ ID NO: 15331 - RNA, 18 nt, artificial
  Chemically synthesized
aaugggauguacauaagu

SEQ ID NO: 15332 - RNA, 18 nt, artificial
  Chemically synthesized
uguaggaguuugguuuaa

SEQ ID NO: 15333 - RNA, 18 nt, artificial
  Chemically synthesized
cgaguguggaggauaggu

SEQ ID NO: 15334 - RNA, 18 nt, artificial
  Chemically synthesized
gucuugcaauaggcugca

SEQ ID NO: 15335 - RNA, 18 nt, artificial
  Chemically synthesized
ggcuacuuugacgcacac

SEQ ID NO: 15336 - RNA, 18 nt, artificial
  Chemically synthesized
gugggaaagagccgcuag

SEQ ID NO: 15337 - RNA, 18 nt, artificial
  Chemically synthesized
agugauugcauuugaucc

SEQ ID NO: 15338 - RNA, 18 nt, artificial
  Chemically synthesized
ugccgacagauccacaaa

SEQ ID NO: 15339 - RNA, 18 nt, artificial
  Chemically synthesized
agcccugcuccagcccaa

SEQ ID NO: 15340 - RNA, 18 nt, artificial
  Chemically synthesized
uuguuugguucaaggcag

SEQ ID NO: 15341 - RNA, 18 nt, artificial
  Chemically synthesized
uccuccauuucagaguca

SEQ ID NO: 15342 - RNA, 18 nt, artificial
  Chemically synthesized
cucacgaguggaaaugug

SEQ ID NO: 15343 - RNA, 18 nt, artificial
  Chemically synthesized
cauccagcagugcaucag

SEQ ID NO: 15344 - RNA, 18 nt, artificial
  Chemically synthesized
ccugcgugccaccucucu

SEQ ID NO: 15345 - RNA, 18 nt, artificial
  Chemically synthesized
aggaaguuuucuucugga

SEQ ID NO: 15346 - RNA, 18 nt, artificial
  Chemically synthesized
gcaaaguuagaaaaagcu

SEQ ID NO: 15347 - RNA, 18 nt, artificial
  Chemically synthesized
uggacuucaugagcauag

SEQ ID NO: 15348 - RNA, 18 nt, artificial
  Chemically synthesized
ggcaaaguacuagcucug

SEQ ID NO: 15349 - RNA, 18 nt, artificial
  Chemically synthesized
ccaacagguuuuacuggu

SEQ ID NO: 15350 - RNA, 18 nt, artificial
  Chemically synthesized
aucccaaaacaagaugaa

SEQ ID NO: 15351 - RNA, 18 nt, artificial
  Chemically synthesized
cgcggcugcacacagcuu

SEQ ID NO: 15352 - RNA, 18 nt, artificial
  Chemically synthesized
acccugaagguagccaua

SEQ ID NO: 15353 - RNA, 18 nt, artificial
  Chemically synthesized
uccauuucagagucagcu

SEQ ID NO: 15354 - RNA, 18 nt, artificial
  Chemically synthesized
guccucagcagaccagca

SEQ ID NO: 15355 - RNA, 18 nt, artificial
  Chemically synthesized
gacgaccuccgagagcga

SEQ ID NO: 15356 - RNA, 18 nt, artificial
  Chemically synthesized
agcauaggauuccgagag

SEQ ID NO: 15357 - RNA, 18 nt, artificial
  Chemically synthesized
aacagaaguugcgcggua

SEQ ID NO: 15358 - RNA, 18 nt, artificial
  Chemically synthesized
agcaaggagggagcacua

SEQ ID NO: 15359 - RNA, 18 nt, artificial
  Chemically synthesized
guugcggcgugggaaaga

SEQ ID NO: 15360 - RNA, 18 nt, artificial
  Chemically synthesized
uguaugcaaugggaugua

SEQ ID NO: 15361 - RNA, 18 nt, artificial
  Chemically synthesized
cuacuuugacgcacacgc

SEQ ID NO: 15362 - RNA, 18 nt, artificial
  Chemically synthesized
ugaauguaugcaauggga

SEQ ID NO: 15363 - RNA, 18 nt, artificial
  Chemically synthesized
aggagggagcacuaggaa

SEQ ID NO: 15364 - RNA, 18 nt, artificial
  Chemically synthesized
cgcuccacccgcaucacu

SEQ ID NO: 15365 - RNA, 18 nt, artificial
  Chemically synthesized
ugcacacagcuucccucu

SEQ ID NO: 15366 - RNA, 18 nt, artificial
  Chemically synthesized
uaugcaaugggauguaca

SEQ ID NO: 15367 - RNA, 18 nt, artificial
  Chemically synthesized
gugccuaacagaaguugc

SEQ ID NO: 15368 - RNA, 18 nt, artificial
  Chemically synthesized
caaggcagcucgguaacu

SEQ ID NO: 15369 - RNA, 18 nt, artificial
  Chemically synthesized
cagcuuaaaaccucugca

SEQ ID NO: 15370 - RNA, 18 nt, artificial
  Chemically synthesized
aacugacaucagcaacuu

SEQ ID NO: 15371 - RNA, 18 nt, artificial
  Chemically synthesized
auauaacauugcacaagg

SEQ ID NO: 15372 - RNA, 18 nt, artificial
  Chemically synthesized
acauugcacaagggaaga

SEQ ID NO: 15373 - RNA, 18 nt, artificial
  Chemically synthesized
cucuugcggccgagcaga

SEQ ID NO: 15374 - RNA, 18 nt, artificial
  Chemically synthesized
acaacaucucagauuaug

SEQ ID NO: 15375 - RNA, 18 nt, artificial
  Chemically synthesized
ccuuugggagaaguuaca

SEQ ID NO: 15376 - RNA, 18 nt, artificial
  Chemically synthesized
uggcaagaaagaaaagga

SEQ ID NO: 15377 - RNA, 18 nt, artificial
  Chemically synthesized
uccacaacuucagaagug

SEQ ID NO: 15378 - RNA, 18 nt, artificial
  Chemically synthesized
gaaauuacuguaccuagu

SEQ ID NO: 15379 - RNA, 18 nt, artificial
  Chemically synthesized
aagaguauucugcugaaa

SEQ ID NO: 15380 - RNA, 18 nt, artificial
  Chemically synthesized
aauuacuguaccuagucu

SEQ ID NO: 15381 - RNA, 18 nt, artificial
  Chemically synthesized
ggcgucagggugcugcgc

SEQ ID NO: 15382 - RNA, 18 nt, artificial
  Chemically synthesized
aaaucaagcacgugagag

SEQ ID NO: 15383 - RNA, 18 nt, artificial
  Chemically synthesized
caauaaaccuuaccgacc

SEQ ID NO: 15384 - RNA, 18 nt, artificial
  Chemically synthesized
ggcccaccaccaucaucc

SEQ ID NO: 15385 - RNA, 18 nt, artificial
  Chemically synthesized
guggaacaaacaauaaac

SEQ ID NO: 15386 - RNA, 18 nt, artificial
  Chemically synthesized
gaagucuugcaauaggcu

SEQ ID NO: 15387 - RNA, 18 nt, artificial
  Chemically synthesized
cuaugagcaguugccuac

SEQ ID NO: 15388 - RNA, 18 nt, artificial
  Chemically synthesized
cgggugcggcuugugucu

SEQ ID NO: 15389 - RNA, 18 nt, artificial
  Chemically synthesized
aauucuccaacaacaaca

SEQ ID NO: 15390 - RNA, 18 nt, artificial
  Chemically synthesized
auaguaacugaauguccu

SEQ ID NO: 15391 - RNA, 18 nt, artificial
  Chemically synthesized
cggccaugacauccucca

SEQ ID NO: 15392 - RNA, 18 nt, artificial
  Chemically synthesized
agugccuaacagaaguug

SEQ ID NO: 15393 - RNA, 18 nt, artificial
  Chemically synthesized
uugcauuugaucccaaaa

SEQ ID NO: 15394 - RNA, 18 nt, artificial
  Chemically synthesized
cacgugagaguuuuuguu

SEQ ID NO: 15395 - RNA, 18 nt, artificial
  Chemically synthesized
cccugcgaggagacgacc

SEQ ID NO: 15396 - RNA, 18 nt, artificial
  Chemically synthesized
cggcucugcucuccucac

SEQ ID NO: 15397 - RNA, 18 nt, artificial
  Chemically synthesized
caaugggauguacauaag

SEQ ID NO: 15398 - RNA, 18 nt, artificial
  Chemically synthesized
ucaguaugucugaauugg

SEQ ID NO: 15399 - RNA, 18 nt, artificial
  Chemically synthesized
uuugggagaaguuacauu

SEQ ID NO: 15400 - RNA, 18 nt, artificial
  Chemically synthesized
ccgcagccgcagcagcca

SEQ ID NO: 15401 - RNA, 18 nt, artificial
  Chemically synthesized
cuguaccuagucuuuuuu

SEQ ID NO: 15402 - RNA, 18 nt, artificial
  Chemically synthesized
cggccuccaugccucaga

SEQ ID NO: 15403 - RNA, 18 nt, artificial
  Chemically synthesized
uauagagagagagugaga

SEQ ID NO: 15404 - RNA, 18 nt, artificial
  Chemically synthesized
accucucucuugucccuc

SEQ ID NO: 15405 - RNA, 18 nt, artificial
  Chemically synthesized
aggcagcucgguaacuga

SEQ ID NO: 15406 - RNA, 18 nt, artificial
  Chemically synthesized
cguggaaggccuggacuc

SEQ ID NO: 15407 - RNA, 18 nt, artificial
  Chemically synthesized
cucuuuuuuuucucuccc

SEQ ID NO: 15408 - RNA, 18 nt, artificial
  Chemically synthesized
gccauacagaugccgaca

SEQ ID NO: 15409 - RNA, 18 nt, artificial
  Chemically synthesized
acuagcucugugauuaga

SEQ ID NO: 15410 - RNA, 18 nt, artificial
  Chemically synthesized
guguccaccagaggcuau

SEQ ID NO: 15411 - RNA, 18 nt, artificial
  Chemically synthesized
caguuuguaggaguuugg

SEQ ID NO: 15412 - RNA, 18 nt, artificial
  Chemically synthesized
gauggcucaaaauauggu

SEQ ID NO: 15413 - RNA, 18 nt, artificial
  Chemically synthesized
ccaucauccgcuccaccc

SEQ ID NO: 15414 - RNA, 18 nt, artificial
  Chemically synthesized
acauuuauauagugcacc

SEQ ID NO: 15415 - RNA, 18 nt, artificial
  Chemically synthesized
uugggagaaguuacauuu

SEQ ID NO: 15416 - RNA, 18 nt, artificial
  Chemically synthesized
gcucuuugucaaguuagu

SEQ ID NO: 15417 - RNA, 18 nt, artificial
  Chemically synthesized
caacuugaaaacucucca

SEQ ID NO: 15418 - RNA, 18 nt, artificial
  Chemically synthesized
gcucaaaauauggugcug

SEQ ID NO: 15419 - RNA, 18 nt, artificial
  Chemically synthesized
uaucuuaguuugccuucu

SEQ ID NO: 15420 - RNA, 18 nt, artificial
  Chemically synthesized
ugucgccucuccacaacu

SEQ ID NO: 15421 - RNA, 18 nt, artificial
  Chemically synthesized
gaaaucaagcacgugaga

SEQ ID NO: 15422 - RNA, 18 nt, artificial
  Chemically synthesized
cauacagaugccgacaga

SEQ ID NO: 15423 - RNA, 18 nt, artificial
  Chemically synthesized
uguccaccagaggcuauu

SEQ ID NO: 15424 - RNA, 18 nt, artificial
  Chemically synthesized
ucugcacccugaagguag

SEQ ID NO: 15425 - RNA, 18 nt, artificial
  Chemically synthesized
cugagcuuaggaaguuuu

SEQ ID NO: 15426 - RNA, 18 nt, artificial
  Chemically synthesized
ccgccuuccaccaccugc

SEQ ID NO: 15427 - RNA, 18 nt, artificial
  Chemically synthesized
cuggaaaauauauggacc

SEQ ID NO: 15428 - RNA, 18 nt, artificial
  Chemically synthesized
ccaccgcggcugcacaca

SEQ ID NO: 15429 - RNA, 18 nt, artificial
  Chemically synthesized
ccaugacauccuccaugg

SEQ ID NO: 15430 - RNA, 18 nt, artificial
  Chemically synthesized
cgagagcgacauggacga

SEQ ID NO: 15431 - RNA, 18 nt, artificial
  Chemically synthesized
cuccgaaugccauccacg

SEQ ID NO: 15432 - RNA, 18 nt, artificial
  Chemically synthesized
cacuaggaagagaaaagc

SEQ ID NO: 15433 - RNA, 18 nt, artificial
  Chemically synthesized
uugaaaacucuccaguuu

SEQ ID NO: 15434 - RNA, 18 nt, artificial
  Chemically synthesized
ccuccgaaugccauccac

SEQ ID NO: 15435 - RNA, 18 nt, artificial
  Chemically synthesized
agaaaaggcgucgggauc

SEQ ID NO: 15436 - RNA, 18 nt, artificial
  Chemically synthesized
augccaacuugaaaacuc

SEQ ID NO: 15437 - RNA, 18 nt, artificial
  Chemically synthesized
gcagcagccaccgcggcu

SEQ ID NO: 15438 - RNA, 18 nt, artificial
  Chemically synthesized
aucuuaguuugccuucuu

SEQ ID NO: 15439 - RNA, 18 nt, artificial
  Chemically synthesized
cucggauccgcugcgggu

SEQ ID NO: 15440 - RNA, 18 nt, artificial
  Chemically synthesized
aacaucuauucuugucac

SEQ ID NO: 15441 - RNA, 18 nt, artificial
  Chemically synthesized
ugcgggugcggcuugugu

SEQ ID NO: 15442 - RNA, 18 nt, artificial
  Chemically synthesized
accugagcuccguggaag

SEQ ID NO: 15443 - RNA, 18 nt, artificial
  Chemically synthesized
aauaguaacugaaugucc

SEQ ID NO: 15444 - RNA, 18 nt, artificial
  Chemically synthesized
auuucuggaggugaugaa

SEQ ID NO: 15445 - RNA, 18 nt, artificial
  Chemically synthesized
uauauagagagagaguga

SEQ ID NO: 15446 - RNA, 18 nt, artificial
  Chemically synthesized
cugcgaggagacgaccuc

SEQ ID NO: 15447 - RNA, 18 nt, artificial
  Chemically synthesized
cuucagaagugccuccug

SEQ ID NO: 15448 - RNA, 18 nt, artificial
  Chemically synthesized
gggcgucagggugcugcg

SEQ ID NO: 15449 - RNA, 18 nt, artificial
  Chemically synthesized
aauaggcugcagacauuu

SEQ ID NO: 15450 - RNA, 18 nt, artificial
  Chemically synthesized
uccagcagugcaucagua

SEQ ID NO: 15451 - RNA, 18 nt, artificial
  Chemically synthesized
guuugccuucuuuguaca

SEQ ID NO: 15452 - RNA, 18 nt, artificial
  Chemically synthesized
ugcaccuaugagcaguug

SEQ ID NO: 15453 - RNA, 18 nt, artificial
  Chemically synthesized
ugucucaucucagcacuu

SEQ ID NO: 15454 - RNA, 18 nt, artificial
  Chemically synthesized
caccgcggcugcacacag

SEQ ID NO: 15455 - RNA, 18 nt, artificial
  Chemically synthesized
cagcucgguaacugacau

SEQ ID NO: 15456 - RNA, 18 nt, artificial
  Chemically synthesized
agugagagagucguguuu

SEQ ID NO: 15457 - RNA, 18 nt, artificial
  Chemically synthesized
cgggcgucagggugcugc

SEQ ID NO: 15458 - RNA, 18 nt, artificial
  Chemically synthesized
cuucuugcaauaguaacu

SEQ ID NO: 15459 - RNA, 18 nt, artificial
  Chemically synthesized
augcaacaucuauucuug

SEQ ID NO: 15460 - RNA, 18 nt, artificial
  Chemically synthesized
agagugagagagucgugu

SEQ ID NO: 15461 - RNA, 18 nt, artificial
  Chemically synthesized
gagucguguuucguaagu

SEQ ID NO: 15462 - RNA, 18 nt, artificial
  Chemically synthesized
uagugauugcauuugauc

SEQ ID NO: 15463 - RNA, 18 nt, artificial
  Chemically synthesized
gccuaaacuagugcuaug

SEQ ID NO: 15464 - RNA, 18 nt, artificial
  Chemically synthesized
gcgugccaccucucucca

SEQ ID NO: 15465 - RNA, 18 nt, artificial
  Chemically synthesized
acuucacacuuguuacca

SEQ ID NO: 15466 - RNA, 18 nt, artificial
  Chemically synthesized
caacuucagaagugccuc

SEQ ID NO: 15467 - RNA, 18 nt, artificial
  Chemically synthesized
gcgcggucuucgccggga

SEQ ID NO: 15468 - RNA, 18 nt, artificial
  Chemically synthesized
cucuccaccucucucuug

SEQ ID NO: 15469 - RNA, 18 nt, artificial
  Chemically synthesized
ucaaguugaaagaucuag

SEQ ID NO: 15470 - RNA, 18 nt, artificial
  Chemically synthesized
aaucaagcacgugagagu

SEQ ID NO: 15471 - RNA, 18 nt, artificial
  Chemically synthesized
auuucucuacugugugga

SEQ ID NO: 15472 - RNA, 18 nt, artificial
  Chemically synthesized
aaggaaagggacagaagu

SEQ ID NO: 15473 - RNA, 18 nt, artificial
  Chemically synthesized
cuccaguuuguaggaguu

SEQ ID NO: 15474 - RNA, 18 nt, artificial
  Chemically synthesized
accucucuccaccucucu

SEQ ID NO: 15475 - RNA, 18 nt, artificial
  Chemically synthesized
ugccagagaagaguauuc

SEQ ID NO: 15476 - RNA, 18 nt, artificial
  Chemically synthesized
uuccgagagugccuaaca

SEQ ID NO: 15477 - RNA, 18 nt, artificial
  Chemically synthesized
cagagucagcuuaaaacc

SEQ ID NO: 15478 - RNA, 18 nt, artificial
  Chemically synthesized
ggcgugggaaagagccgc

SEQ ID NO: 15479 - RNA, 18 nt, artificial
  Chemically synthesized
gauuccgagagugccuaa

SEQ ID NO: 15480 - RNA, 18 nt, artificial
  Chemically synthesized
gugcugcuuuauauaaac

SEQ ID NO: 15481 - RNA, 18 nt, artificial
  Chemically synthesized
gugcaccuaugagcaguu

SEQ ID NO: 15482 - RNA, 18 nt, artificial
  Chemically synthesized
agcccaacggccuccaug

SEQ ID NO: 15483 - RNA, 18 nt, artificial
  Chemically synthesized
gcucugcucuccucacgg

SEQ ID NO: 15484 - RNA, 18 nt, artificial
  Chemically synthesized
cccaugcggauucagccc

SEQ ID NO: 15485 - RNA, 18 nt, artificial
  Chemically synthesized
uagcucugugauuagauu

SEQ ID NO: 15486 - RNA, 18 nt, artificial
  Chemically synthesized
ugccaacuugaaaacucu

SEQ ID NO: 15487 - RNA, 18 nt, artificial
  Chemically synthesized
guaagugccugagcuuag

SEQ ID NO: 15488 - RNA, 18 nt, artificial
  Chemically synthesized
agcuuaaaaccucugcac

SEQ ID NO: 15489 - RNA, 18 nt, artificial
  Chemically synthesized
agagagugagagagucgu

SEQ ID NO: 15490 - RNA, 18 nt, artificial
  Chemically synthesized
agaaguugcgcgguaccu

SEQ ID NO: 15491 - RNA, 18 nt, artificial
  Chemically synthesized
cucuucauuuucuccuaa

SEQ ID NO: 15492 - RNA, 18 nt, artificial
  Chemically synthesized
gcccugcuccagcccaac

SEQ ID NO: 15493 - RNA, 18 nt, artificial
  Chemically synthesized
ccauguguccaccagagg

SEQ ID NO: 15494 - RNA, 18 nt, artificial
  Chemically synthesized
ugcccugacugaauucuc

SEQ ID NO: 15495 - RNA, 18 nt, artificial
  Chemically synthesized
ccgcggccacagccauca

SEQ ID NO: 15496 - RNA, 18 nt, artificial
  Chemically synthesized
gucuucgccgggaugaag

SEQ ID NO: 15497 - RNA, 18 nt, artificial
  Chemically synthesized
ccaccugcccgcagcccu

SEQ ID NO: 15498 - RNA, 18 nt, artificial
  Chemically synthesized
gugccugagcuuaggaag

SEQ ID NO: 15499 - RNA, 18 nt, artificial
  Chemically synthesized
uggaaggccuggacuccu

SEQ ID NO: 15500 - RNA, 18 nt, artificial
  Chemically synthesized
cuagugcuauguaauggg

SEQ ID NO: 15501 - RNA, 18 nt, artificial
  Chemically synthesized
ggacuccucggauccgcu

SEQ ID NO: 15502 - RNA, 18 nt, artificial
  Chemically synthesized
ucuuaguuugccuucuuu

SEQ ID NO: 15503 - RNA, 18 nt, artificial
  Chemically synthesized
uucucagauuaacaagca

SEQ ID NO: 15504 - RNA, 18 nt, artificial
  Chemically synthesized
ccucucuccaccucucuc

SEQ ID NO: 15505 - RNA, 18 nt, artificial
  Chemically synthesized
cucagcagaccagcagug

SEQ ID NO: 15506 - RNA, 18 nt, artificial
  Chemically synthesized
ucacccuuugggagaagu

SEQ ID NO: 15507 - RNA, 18 nt, artificial
  Chemically synthesized
auucucuugagacuagau

SEQ ID NO: 15508 - RNA, 18 nt, artificial
  Chemically synthesized
cuaacagaaguugcgcgg

SEQ ID NO: 15509 - RNA, 18 nt, artificial
  Chemically synthesized
agccgcuaggagcagacc

SEQ ID NO: 15510 - RNA, 18 nt, artificial
  Chemically synthesized
auggacuucaugagcaua

SEQ ID NO: 15511 - RNA, 18 nt, artificial
  Chemically synthesized
gcuucccucuguccuucg

SEQ ID NO: 15512 - RNA, 18 nt, artificial
  Chemically synthesized
ccgcugcgggugcggcuu

SEQ ID NO: 15513 - RNA, 18 nt, artificial
  Chemically synthesized
uugcacaagggaagacga

SEQ ID NO: 15514 - RNA, 18 nt, artificial
  Chemically synthesized
ugagcuccguggaaggcc

SEQ ID NO: 15515 - RNA, 18 nt, artificial
  Chemically synthesized
uccucagcagaccagcag

SEQ ID NO: 15516 - RNA, 18 nt, artificial
  Chemically synthesized
ccuccugcccacggcucu

SEQ ID NO: 15517 - RNA, 18 nt, artificial
  Chemically synthesized
aacaagcauuucugcucu

SEQ ID NO: 15518 - RNA, 18 nt, artificial
  Chemically synthesized
uccaugccucagagucaa

SEQ ID NO: 15519 - RNA, 18 nt, artificial
  Chemically synthesized
cuccauuucagagucagc

SEQ ID NO: 15520 - RNA, 18 nt, artificial
  Chemically synthesized
uauucuugucacccuuug

SEQ ID NO: 15521 - RNA, 18 nt, artificial
  Chemically synthesized
ugucacccuuugggagaa

SEQ ID NO: 15522 - RNA, 18 nt, artificial
  Chemically synthesized
uuugagacacaaaccuca

SEQ ID NO: 15523 - RNA, 18 nt, artificial
  Chemically synthesized
gagcagaguugcggcgug

SEQ ID NO: 15524 - RNA, 18 nt, artificial
  Chemically synthesized
ggcgggcgucagggugcu

SEQ ID NO: 15525 - RNA, 18 nt, artificial
  Chemically synthesized
uuuguacagacaugccaa

SEQ ID NO: 15526 - RNA, 18 nt, artificial
  Chemically synthesized
ugcggcuugugucucauc

SEQ ID NO: 15527 - RNA, 18 nt, artificial
  Chemically synthesized
gaugcuucaggcaacagg

SEQ ID NO: 15528 - RNA, 18 nt, artificial
  Chemically synthesized
ugcccacggcucugcucu

SEQ ID NO: 15529 - RNA, 18 nt, artificial
  Chemically synthesized
aguggaaaugugguauuc

SEQ ID NO: 15530 - RNA, 18 nt, artificial
  Chemically synthesized
gcauuucugcucugccug

SEQ ID NO: 15531 - RNA, 18 nt, artificial
  Chemically synthesized
ccugcuccagcccaacgg

SEQ ID NO: 15532 - RNA, 18 nt, artificial
  Chemically synthesized
agucagcuuaaaaccucu

SEQ ID NO: 15533 - RNA, 18 nt, artificial
  Chemically synthesized
acagcauguauuaugcac

SEQ ID NO: 15534 - RNA, 18 nt, artificial
  Chemically synthesized
ugcugaaaccaacagguu

SEQ ID NO: 15535 - RNA, 18 nt, artificial
  Chemically synthesized
ccuaacagaaguugcgcg

SEQ ID NO: 15536 - RNA, 18 nt, artificial
  Chemically synthesized
cauuuucuccuaaugaug

SEQ ID NO: 15537 - RNA, 18 nt, artificial
  Chemically synthesized
uucagagucagcuuaaaa

SEQ ID NO: 15538 - RNA, 18 nt, artificial
  Chemically synthesized
gagugagagagucguguu

SEQ ID NO: 15539 - RNA, 18 nt, artificial
  Chemically synthesized
augagcaguugccuacca

SEQ ID NO: 15540 - RNA, 18 nt, artificial
  Chemically synthesized
gaggcgggcgucagggug

SEQ ID NO: 15541 - RNA, 18 nt, artificial
  Chemically synthesized
gagugccuaacagaaguu

SEQ ID NO: 15542 - RNA, 18 nt, artificial
  Chemically synthesized
ccgcagcccugcuccagc

SEQ ID NO: 15543 - RNA, 18 nt, artificial
  Chemically synthesized
ucuccacaacuucagaag

SEQ ID NO: 15544 - RNA, 18 nt, artificial
  Chemically synthesized
agugccugagcuuaggaa

SEQ ID NO: 15545 - RNA, 18 nt, artificial
  Chemically synthesized
cucucccuuuuuuguuug

SEQ ID NO: 15546 - RNA, 18 nt, artificial
  Chemically synthesized
cagccaucagcccgcccu

SEQ ID NO: 15547 - RNA, 18 nt, artificial
  Chemically synthesized
guuuuaucuuaguuugcc

SEQ ID NO: 15548 - RNA, 18 nt, artificial
  Chemically synthesized
ugugucucaucucagcac

SEQ ID NO: 15549 - RNA, 18 nt, artificial
  Chemically synthesized
uagaaguuuccuggaaaa

SEQ ID NO: 15550 - RNA, 18 nt, artificial
  Chemically synthesized
auauagugcaccuaugag

SEQ ID NO: 15551 - RNA, 18 nt, artificial
  Chemically synthesized
agccaccgcggcugcaca

SEQ ID NO: 15552 - RNA, 18 nt, artificial
  Chemically synthesized
cucucucuugucccucuc

SEQ ID NO: 15553 - RNA, 18 nt, artificial
  Chemically synthesized
aaauauggugcugcuuua

SEQ ID NO: 15554 - RNA, 18 nt, artificial
  Chemically synthesized
ucucuugagacuagaugg

SEQ ID NO: 15555 - RNA, 18 nt, artificial
  Chemically synthesized
cauccgcuccacccgcau

SEQ ID NO: 15556 - RNA, 18 nt, artificial
  Chemically synthesized
agcuucccucuguccuuc

SEQ ID NO: 15557 - RNA, 18 nt, artificial
  Chemically synthesized
cuccguggaaggccugga

SEQ ID NO: 15558 - RNA, 18 nt, artificial
  Chemically synthesized
cgcugcgggugcggcuug

SEQ ID NO: 15559 - RNA, 18 nt, artificial
  Chemically synthesized
ggaaggccuggacuccuc

SEQ ID NO: 15560 - RNA, 18 nt, artificial
  Chemically synthesized
cccugcuccagcccaacg

SEQ ID NO: 15561 - RNA, 18 nt, artificial
  Chemically synthesized
cggcggccaugacauccu

SEQ ID NO: 15562 - RNA, 18 nt, artificial
  Chemically synthesized
ggcugcacacagcuuccc

SEQ ID NO: 15563 - RNA, 18 nt, artificial
  Chemically synthesized
gucaaguuagugauugca

SEQ ID NO: 15564 - RNA, 18 nt, artificial
  Chemically synthesized
agguuaagaaaggaaagg

SEQ ID NO: 15565 - RNA, 18 nt, artificial
  Chemically synthesized
uuugguucaaggcagcuc

SEQ ID NO: 15566 - RNA, 18 nt, artificial
  Chemically synthesized
cuugcggccgagcagagu

SEQ ID NO: 15567 - RNA, 18 nt, artificial
  Chemically synthesized
ccgcggcugcacacagcu

SEQ ID NO: 15568 - RNA, 18 nt, artificial
  Chemically synthesized
gagccgcuaggagcagac

SEQ ID NO: 15569 - RNA, 18 nt, artificial
  Chemically synthesized
cacgcucuugccauggac

SEQ ID NO: 15570 - RNA, 18 nt, artificial
  Chemically synthesized
gcagccaccgcggcugca

SEQ ID NO: 15571 - RNA, 18 nt, artificial
  Chemically synthesized
cagcacuugcgccaccca

SEQ ID NO: 15572 - RNA, 18 nt, artificial
  Chemically synthesized
cugccaccguccacgccg

SEQ ID NO: 15573 - RNA, 18 nt, artificial
  Chemically synthesized
gccaacuugaaaacucuc

SEQ ID NO: 15574 - RNA, 18 nt, artificial
  Chemically synthesized
aggcugcagacauuuuaa

SEQ ID NO: 15575 - RNA, 18 nt, artificial
  Chemically synthesized
uugagacuagaugggaca

SEQ ID NO: 15576 - RNA, 18 nt, artificial
  Chemically synthesized
uugcaaaugacaguggau

SEQ ID NO: 15577 - RNA, 18 nt, artificial
  Chemically synthesized
uguaccuagucuuuuuug

SEQ ID NO: 15578 - RNA, 18 nt, artificial
  Chemically synthesized
cgcgguaccugagcuccg

SEQ ID NO: 15579 - RNA, 18 nt, artificial
  Chemically synthesized
aagucuugcaauaggcug

SEQ ID NO: 15580 - RNA, 18 nt, artificial
  Chemically synthesized
aagaggugacauuuagca

SEQ ID NO: 15581 - RNA, 18 nt, artificial
  Chemically synthesized
aucaagcacgugagaguu

SEQ ID NO: 15582 - RNA, 18 nt, artificial
  Chemically synthesized
agaagucuugcaauaggc

SEQ ID NO: 15583 - RNA, 18 nt, artificial
  Chemically synthesized
gccggcucuugcggccga

SEQ ID NO: 15584 - RNA, 18 nt, artificial
  Chemically synthesized
uauggaccguaccaucca

SEQ ID NO: 15585 - RNA, 18 nt, artificial
  Chemically synthesized
aaacaaggaucugcaaag

SEQ ID NO: 15586 - RNA, 18 nt, artificial
  Chemically synthesized
uccgagagcgacauggac

SEQ ID NO: 15587 - RNA, 18 nt, artificial
  Chemically synthesized
uucauuucucuacugugu

SEQ ID NO: 15588 - RNA, 18 nt, artificial
  Chemically synthesized
aagacuugugccaacugc

SEQ ID NO: 15589 - RNA, 18 nt, artificial
  Chemically synthesized
acuuugacgcacacgcuc

SEQ ID NO: 15590 - RNA, 18 nt, artificial
  Chemically synthesized
cugcacacagcuucccuc

SEQ ID NO: 15591 - RNA, 18 nt, artificial
  Chemically synthesized
agucguguuucguaagug

SEQ ID NO: 15592 - RNA, 18 nt, artificial
  Chemically synthesized
acuguaccuagucuuuuu

SEQ ID NO: 15593 - RNA, 18 nt, artificial
  Chemically synthesized
uguguccaccagaggcua

SEQ ID NO: 15594 - RNA, 18 nt, artificial
  Chemically synthesized
uugucaaguuagugauug

SEQ ID NO: 15595 - RNA, 18 nt, artificial
  Chemically synthesized
agaaauguaacuucuccc

SEQ ID NO: 15596 - RNA, 18 nt, artificial
  Chemically synthesized
augucuguacaaagaagg

SEQ ID NO: 15597 - RNA, 18 nt, artificial
  Chemically synthesized
uuuucucuauaaucccuc

SEQ ID NO: 15598 - RNA, 18 nt, artificial
  Chemically synthesized
ucuauauauguauguccc

SEQ ID NO: 15599 - RNA, 18 nt, artificial
  Chemically synthesized
aagaauagauguugcauc

SEQ ID NO: 15600 - RNA, 18 nt, artificial
  Chemically synthesized
agaauacucuucucuggc

SEQ ID NO: 15601 - RNA, 18 nt, artificial
  Chemically synthesized
uaugucccaucuagucuc

SEQ ID NO: 15602 - RNA, 18 nt, artificial
  Chemically synthesized
uugcuuauaccaaugcac

SEQ ID NO: 15603 - RNA, 18 nt, artificial
  Chemically synthesized
uauuuuccaggaaacuuc

SEQ ID NO: 15604 - RNA, 18 nt, artificial
  Chemically synthesized
uuugugucucaaauagcu

SEQ ID NO: 15605 - RNA, 18 nt, artificial
  Chemically synthesized
auucagacauacugaugc

SEQ ID NO: 15606 - RNA, 18 nt, artificial
  Chemically synthesized
aaaacaaaaccacaaccc

SEQ ID NO: 15607 - RNA, 18 nt, artificial
  Chemically synthesized
aaugcacugcuaaauguc

SEQ ID NO: 15608 - RNA, 18 nt, artificial
  Chemically synthesized
aaagcuccaacuucuguc

SEQ ID NO: 15609 - RNA, 18 nt, artificial
  Chemically synthesized
uuucuuaaccuauccucc

SEQ ID NO: 15610 - RNA, 18 nt, artificial
  Chemically synthesized
aagguuacaaaguaaugc

SEQ ID NO: 15611 - RNA, 18 nt, artificial
  Chemically synthesized
uaaaugucaccucuuggc

SEQ ID NO: 15612 - RNA, 18 nt, artificial
  Chemically synthesized
aguaauuguucucgcucc

SEQ ID NO: 15613 - RNA, 18 nt, artificial
  Chemically synthesized
auguuuauugcuuucucc

SEQ ID NO: 15614 - RNA, 18 nt, artificial
  Chemically synthesized
gccuuuucucuauaaucc

SEQ ID NO: 15615 - RNA, 18 nt, artificial
  Chemically synthesized
uuuguuccacugcugguc

SEQ ID NO: 15616 - RNA, 18 nt, artificial
  Chemically synthesized
uuuauauaaagcagcacc

SEQ ID NO: 15617 - RNA, 18 nt, artificial
  Chemically synthesized
uggucucguccaugucgc

SEQ ID NO: 15618 - RNA, 18 nt, artificial
  Chemically synthesized
ucucaagagaauucaguc

SEQ ID NO: 15619 - RNA, 18 nt, artificial
  Chemically synthesized
guuugugucucaaauagc

SEQ ID NO: 15620 - RNA, 18 nt, artificial
  Chemically synthesized
agagcuaguacuuugccc

SEQ ID NO: 15621 - RNA, 18 nt, artificial
  Chemically synthesized
uugcaagacuucuguccc

SEQ ID NO: 15622 - RNA, 18 nt, artificial
  Chemically synthesized
uauccuccacacucgucu

SEQ ID NO: 15623 - RNA, 18 nt, artificial
  Chemically synthesized
augucugcagccuauugc

SEQ ID NO: 15624 - RNA, 18 nt, artificial
  Chemically synthesized
auuaaaccaaacuccuac

SEQ ID NO: 15625 - RNA, 18 nt, artificial
  Chemically synthesized
uuuauuguuccuuugugg

SEQ ID NO: 15626 - RNA, 18 nt, artificial
  Chemically synthesized
agaauaccacauuuccac

SEQ ID NO: 15627 - RNA, 18 nt, artificial
  Chemically synthesized
uggcugauacugacaagg

SEQ ID NO: 15628 - RNA, 18 nt, artificial
  Chemically synthesized
acucgucuucccuugugc

SEQ ID NO: 15629 - RNA, 18 nt, artificial
  Chemically synthesized
uagucucaagagaauuca

SEQ ID NO: 15630 - RNA, 18 nt, artificial
  Chemically synthesized
ucucguccaugucgcucu

SEQ ID NO: 15631 - RNA, 18 nt, artificial
  Chemically synthesized
uuggcacaagucuucuca

SEQ ID NO: 15632 - RNA, 18 nt, artificial
  Chemically synthesized
agcagaauacucuucucu

SEQ ID NO: 15633 - RNA, 18 nt, artificial
  Chemically synthesized
uauccagaagaaaacuuc

SEQ ID NO: 15634 - RNA, 18 nt, artificial
  Chemically synthesized
aagcuccaacuucugucc

SEQ ID NO: 15635 - RNA, 18 nt, artificial
  Chemically synthesized
uuguuuguuccacugcug

SEQ ID NO: 15636 - RNA, 18 nt, artificial
  Chemically synthesized
uucaaaugauccacuguc

SEQ ID NO: 15637 - RNA, 18 nt, artificial
  Chemically synthesized
aguagagaaaugaagugc

SEQ ID NO: 15638 - RNA, 18 nt, artificial
  Chemically synthesized
uugcauacauucaucuug

SEQ ID NO: 15639 - RNA, 18 nt, artificial
  Chemically synthesized
guaauuguucucgcuccc

SEQ ID NO: 15640 - RNA, 18 nt, artificial
  Chemically synthesized
agacuucugucccuuucc

SEQ ID NO: 15641 - RNA, 18 nt, artificial
  Chemically synthesized
agaugagacacaagccgc

SEQ ID NO: 15642 - RNA, 18 nt, artificial
  Chemically synthesized
guauguaaagacucuugc

SEQ ID NO: 15643 - RNA, 18 nt, artificial
  Chemically synthesized
uuuucucuuccuagugcu

SEQ ID NO: 15644 - RNA, 18 nt, artificial
  Chemically synthesized
uuguuaaucugagaacug

SEQ ID NO: 15645 - RNA, 18 nt, artificial
  Chemically synthesized
ucgugagguuugugucuc

SEQ ID NO: 15646 - RNA, 18 nt, artificial
  Chemically synthesized
uuccuuuguggaucuguc

SEQ ID NO: 15647 - RNA, 18 nt, artificial
  Chemically synthesized
acucuugcauagaaaaag

SEQ ID NO: 15648 - RNA, 18 nt, artificial
  Chemically synthesized
uuguuggagaauucaauc

SEQ ID NO: 15649 - RNA, 18 nt, artificial
  Chemically synthesized
ucaaaguagccuuuaccc

SEQ ID NO: 15650 - RNA, 18 nt, artificial
  Chemically synthesized
acgucgauggucucgucc

SEQ ID NO: 15651 - RNA, 18 nt, artificial
  Chemically synthesized
acucgugagguuuguguc

SEQ ID NO: 15652 - RNA, 18 nt, artificial
  Chemically synthesized
ucuccuuuucuuucuugc

SEQ ID NO: 15653 - RNA, 18 nt, artificial
  Chemically synthesized
ugaagugcauaauacaug

SEQ ID NO: 15654 - RNA, 18 nt, artificial
  Chemically synthesized
aucccauugcauacauuc

SEQ ID NO: 15655 - RNA, 18 nt, artificial
  Chemically synthesized
ccuuuucucuauaauccc

SEQ ID NO: 15656 - RNA, 18 nt, artificial
  Chemically synthesized
ugacaagaauagauguug

SEQ ID NO: 15657 - RNA, 18 nt, artificial
  Chemically synthesized
cuucuguuaggcacucuc

SEQ ID NO: 15658 - RNA, 18 nt, artificial
  Chemically synthesized
uacgguccauauauuuuc

SEQ ID NO: 15659 - RNA, 18 nt, artificial
  Chemically synthesized
uagcuuuucucuuccuag

SEQ ID NO: 15660 - RNA, 18 nt, artificial
  Chemically synthesized
auucggagggcugaaucc

SEQ ID NO: 15661 - RNA, 18 nt, artificial
  Chemically synthesized
uuagugguauguaaagac

SEQ ID NO: 15662 - RNA, 18 nt, artificial
  Chemically synthesized
ccgaguaauuguucucgc

SEQ ID NO: 15663 - RNA, 18 nt, artificial
  Chemically synthesized
aauucagacauacugaug

SEQ ID NO: 15664 - RNA, 18 nt, artificial
  Chemically synthesized
ugcacugcuaaaugucac

SEQ ID NO: 15665 - RNA, 18 nt, artificial
  Chemically synthesized
caaacuccuacaaacugg

SEQ ID NO: 15666 - RNA, 18 nt, artificial
  Chemically synthesized
uuuugaccaguaaaaccu

SEQ ID NO: 15667 - RNA, 18 nt, artificial
  Chemically synthesized
aaaaacaaaaccacaacc

SEQ ID NO: 15668 - RNA, 18 nt, artificial
  Chemically synthesized
aucccgacgccuuuucuc

SEQ ID NO: 15669 - RNA, 18 nt, artificial
  Chemically synthesized
uuguagcuuuucucuucc

SEQ ID NO: 15670 - RNA, 18 nt, artificial
  Chemically synthesized
augcugugucucuuaucu

SEQ ID NO: 15671 - RNA, 18 nt, artificial
  Chemically synthesized
aucuguauggcuaccuuc

SEQ ID NO: 15672 - RNA, 18 nt, artificial
  Chemically synthesized
ucugcugaggacuggacg

SEQ ID NO: 15673 - RNA, 18 nt, artificial
  Chemically synthesized
acugcuaaaugucaccuc

SEQ ID NO: 15674 - RNA, 18 nt, artificial
  Chemically synthesized
caagucuucucaacucag

SEQ ID NO: 15675 - RNA, 18 nt, artificial
  Chemically synthesized
ucuucaaaugauccacug

SEQ ID NO: 15676 - RNA, 18 nt, artificial
  Chemically synthesized
acuggacguggcugauac

SEQ ID NO: 15677 - RNA, 18 nt, artificial
  Chemically synthesized
uucucaacucagauaaac

SEQ ID NO: 15678 - RNA, 18 nt, artificial
  Chemically synthesized
acucucucacucucucuc

SEQ ID NO: 15679 - RNA, 18 nt, artificial
  Chemically synthesized
cuuauaccaaugcacugc

SEQ ID NO: 15680 - RNA, 18 nt, artificial
  Chemically synthesized
uuucuccacacaguagag

SEQ ID NO: 15681 - RNA, 18 nt, artificial
  Chemically synthesized
agucuucucaacucagau

SEQ ID NO: 15682 - RNA, 18 nt, artificial
  Chemically synthesized
ugagaugagacacaagcc

SEQ ID NO: 15683 - RNA, 18 nt, artificial
  Chemically synthesized
cacaguagagaaaugaag

SEQ ID NO: 15684 - RNA, 18 nt, artificial
  Chemically synthesized
auggucucguccaugucg

SEQ ID NO: 15685 - RNA, 18 nt, artificial
  Chemically synthesized
aagcaucuucaaaugauc

SEQ ID NO: 15686 - RNA, 18 nt, artificial
  Chemically synthesized
uuuucagcagucauuuug

SEQ ID NO: 15687 - RNA, 18 nt, artificial
  Chemically synthesized
cgccuuuucucuauaauc

SEQ ID NO: 15688 - RNA, 18 nt, artificial
  Chemically synthesized
agcaccauauuuugagcc

SEQ ID NO: 15689 - RNA, 18 nt, artificial
  Chemically synthesized
uucuguuaggcacucucg

SEQ ID NO: 15690 - RNA, 18 nt, artificial
  Chemically synthesized
cuccuugcuucaucaccu

SEQ ID NO: 15691 - RNA, 18 nt, artificial
  Chemically synthesized
uaaaugguaacaagugug

SEQ ID NO: 15692 - RNA, 18 nt, artificial
  Chemically synthesized
acaagucuucucaacuca

SEQ ID NO: 15693 - RNA, 18 nt, artificial
  Chemically synthesized
ucccgacgccuuuucucu

SEQ ID NO: 15694 - RNA, 18 nt, artificial
  Chemically synthesized
uaacuuugcagauccuug

SEQ ID NO: 15695 - RNA, 18 nt, artificial
  Chemically synthesized
uaauacaugcugugucuc

SEQ ID NO: 15696 - RNA, 18 nt, artificial
  Chemically synthesized
auuguagcuuuucucuuc

SEQ ID NO: 15697 - RNA, 18 nt, artificial
  Chemically synthesized
agggcugaauccgcaugg

SEQ ID NO: 15698 - RNA, 18 nt, artificial
  Chemically synthesized
uaacuucucccaaagggu

SEQ ID NO: 15699 - RNA, 18 nt, artificial
  Chemically synthesized
uuguuuugggaucaaaug

SEQ ID NO: 15700 - RNA, 18 nt, artificial
  Chemically synthesized
auccgaggaguccaggcc

SEQ ID NO: 15701 - RNA, 18 nt, artificial
  Chemically synthesized
aaugcuuguuaaucugag

SEQ ID NO: 15702 - RNA, 18 nt, artificial
  Chemically synthesized
cuccuagcggcucuuucc

SEQ ID NO: 15703 - RNA, 18 nt, artificial
  Chemically synthesized
cauucaucuuguuuuggg

SEQ ID NO: 15704 - RNA, 18 nt, artificial
  Chemically synthesized
uauugcaagacuucuguc

SEQ ID NO: 15705 - RNA, 18 nt, artificial
  Chemically synthesized
caugaauuaaauagccuc

SEQ ID NO: 15706 - RNA, 18 nt, artificial
  Chemically synthesized
agguuuauuguuuguucc

SEQ ID NO: 15707 - RNA, 18 nt, artificial
  Chemically synthesized
aaacuccuacaaacugga

SEQ ID NO: 15708 - RNA, 18 nt, artificial
  Chemically synthesized
uucaaucuaaucacagag

SEQ ID NO: 15709 - RNA, 18 nt, artificial
  Chemically synthesized
uugcugaugucaguuacc

SEQ ID NO: 15710 - RNA, 18 nt, artificial
  Chemically synthesized
ugcucaugaaguccaugg

SEQ ID NO: 15711 - RNA, 18 nt, artificial
  Chemically synthesized
aaaccuguugguuucagc

SEQ ID NO: 15712 - RNA, 18 nt, artificial
  Chemically synthesized
auaauacaugcugugucu

SEQ ID NO: 15713 - RNA, 18 nt, artificial
  Chemically synthesized
aaugauccacugucauuu

SEQ ID NO: 15714 - RNA, 18 nt, artificial
  Chemically synthesized
cugagaugagacacaagc

SEQ ID NO: 15715 - RNA, 18 nt, artificial
  Chemically synthesized
auuuugaccaguaaaacc

SEQ ID NO: 15716 - RNA, 18 nt, artificial
  Chemically synthesized
gucaaaguagccuuuacc

SEQ ID NO: 15717 - RNA, 18 nt, artificial
  Chemically synthesized
aauggaggacauucaguu

SEQ ID NO: 15718 - RNA, 18 nt, artificial
  Chemically synthesized
uuugcagauccuuguuuu

SEQ ID NO: 15719 - RNA, 18 nt, artificial
  Chemically synthesized
uaaucugagauguuguug

SEQ ID NO: 15720 - RNA, 18 nt, artificial
  Chemically synthesized
aauaccacauuuccacuc

SEQ ID NO: 15721 - RNA, 18 nt, artificial
  Chemically synthesized
auaacuuauguacauccc

SEQ ID NO: 15722 - RNA, 18 nt, artificial
  Chemically synthesized
uagauguugcaucauuag

SEQ ID NO: 15723 - RNA, 18 nt, artificial
  Chemically synthesized
uauguaugucccaucuag

SEQ ID NO: 15724 - RNA, 18 nt, artificial
  Chemically synthesized
cugauacugacaagggcg

SEQ ID NO: 15725 - RNA, 18 nt, artificial
  Chemically synthesized
uugguuucagcagaauac

SEQ ID NO: 15726 - RNA, 18 nt, artificial
  Chemically synthesized
ucgauggucucguccaug

SEQ ID NO: 15727 - RNA, 18 nt, artificial
  Chemically synthesized
agcaucuucaaaugaucc

SEQ ID NO: 15728 - RNA, 18 nt, artificial
  Chemically synthesized
aagucuucucaacucaga

SEQ ID NO: 15729 - RNA, 18 nt, artificial
  Chemically synthesized
gucucaagagaauucagu

SEQ ID NO: 15730 - RNA, 18 nt, artificial
  Chemically synthesized
guuucagcagaauacucu

SEQ ID NO: 15731 - RNA, 18 nt, artificial
  Chemically synthesized
agguuuauauaaagcagc

SEQ ID NO: 15732 - RNA, 18 nt, artificial
  Chemically synthesized
uucggagggcugaauccg

SEQ ID NO: 15733 - RNA, 18 nt, artificial
  Chemically synthesized
cacaagucuucucaacuc

SEQ ID NO: 15734 - RNA, 18 nt, artificial
  Chemically synthesized
uacugacaagggcgggcu

SEQ ID NO: 15735 - RNA, 18 nt, artificial
  Chemically synthesized
gcucucggaggucgucuc

SEQ ID NO: 15736 - RNA, 18 nt, artificial
  Chemically synthesized
cagaauacucuucucugg

SEQ ID NO: 15737 - RNA, 18 nt, artificial
  Chemically synthesized
uguuauuuauccgauccc

SEQ ID NO: 15738 - RNA, 18 nt, artificial
  Chemically synthesized
uaaucacagagcuaguac

SEQ ID NO: 15739 - RNA, 18 nt, artificial
  Chemically synthesized
ucccaucuagucucaaga

SEQ ID NO: 15740 - RNA, 18 nt, artificial
  Chemically synthesized
agagguggagagaggugg

SEQ ID NO: 15741 - RNA, 18 nt, artificial
  Chemically synthesized
agacauacugaugcacug

SEQ ID NO: 15742 - RNA, 18 nt, artificial
  Chemically synthesized
cuccacacucgucuuccc

SEQ ID NO: 15743 - RNA, 18 nt, artificial
  Chemically synthesized
gcagaauacucuucucug

SEQ ID NO: 15744 - RNA, 18 nt, artificial
  Chemically synthesized
uguauggcuaccuucagg

SEQ ID NO: 15745 - RNA, 18 nt, artificial
  Chemically synthesized
cugacucugaaauggagg

SEQ ID NO: 15746 - RNA, 18 nt, artificial
  Chemically synthesized
gaguaauuguucucgcuc

SEQ ID NO: 15747 - RNA, 18 nt, artificial
  Chemically synthesized
gcacaagucuucucaacu

SEQ ID NO: 15748 - RNA, 18 nt, artificial
  Chemically synthesized
uauguaaagacucuugca

SEQ ID NO: 15749 - RNA, 18 nt, artificial
  Chemically synthesized
aagagaauucagucaggg

SEQ ID NO: 15750 - RNA, 18 nt, artificial
  Chemically synthesized
guuggcacaagucuucuc

SEQ ID NO: 15751 - RNA, 18 nt, artificial
  Chemically synthesized
agggugacaagaauagau

SEQ ID NO: 15752 - RNA, 18 nt, artificial
  Chemically synthesized
auacugaugcacugcugg

SEQ ID NO: 15753 - RNA, 18 nt, artificial
  Chemically synthesized
gggugacaagaauagaug

SEQ ID NO: 15754 - RNA, 18 nt, artificial
  Chemically synthesized
uucaguuacuauugcaag

SEQ ID NO: 15755 - RNA, 18 nt, artificial
  Chemically synthesized
aucuaaucacagagcuag

SEQ ID NO: 15756 - RNA, 18 nt, artificial
  Chemically synthesized
ugcacugcuggaugguac

SEQ ID NO: 15757 - RNA, 18 nt, artificial
  Chemically synthesized
agagaauaccacauuucc

SEQ ID NO: 15758 - RNA, 18 nt, artificial
  Chemically synthesized
aauuaaauagccucuggu

SEQ ID NO: 15759 - RNA, 18 nt, artificial
  Chemically synthesized
aucuucaaaugauccacu

SEQ ID NO: 15760 - RNA, 18 nt, artificial
  Chemically synthesized
acucucggaauccuaugc

SEQ ID NO: 15761 - RNA, 18 nt, artificial
  Chemically synthesized
ucugcagccuauugcaag

SEQ ID NO: 15762 - RNA, 18 nt, artificial
  Chemically synthesized
gagguuuuaagcugacuc

SEQ ID NO: 15763 - RNA, 18 nt, artificial
  Chemically synthesized
ucaagagaauucagucag

SEQ ID NO: 15764 - RNA, 18 nt, artificial
  Chemically synthesized
aaagggugacaagaauag

SEQ ID NO: 15765 - RNA, 18 nt, artificial
  Chemically synthesized
uuaaucugagaacugaug

SEQ ID NO: 15766 - RNA, 18 nt, artificial
  Chemically synthesized
caggaaacuucuaaaugg

SEQ ID NO: 15767 - RNA, 18 nt, artificial
  Chemically synthesized
agguuacaaaguaaugca

SEQ ID NO: 15768 - RNA, 18 nt, artificial
  Chemically synthesized
caucuucaaaugauccac

SEQ ID NO: 15769 - RNA, 18 nt, artificial
  Chemically synthesized
acauuuccacucgugagg

SEQ ID NO: 15770 - RNA, 18 nt, artificial
  Chemically synthesized
uuuauccgaucccgacgc

SEQ ID NO: 15771 - RNA, 18 nt, artificial
  Chemically synthesized
cauaauacaugcuguguc

SEQ ID NO: 15772 - RNA, 18 nt, artificial
  Chemically synthesized
ugaauuaaauagccucug

SEQ ID NO: 15773 - RNA, 18 nt, artificial
  Chemically synthesized
cuccuacaaacuggagag

SEQ ID NO: 15774 - RNA, 18 nt, artificial
  Chemically synthesized
ucaacucagauaaacugu

SEQ ID NO: 15775 - RNA, 18 nt, artificial
  Chemically synthesized
aaaacucucacgugcuug

SEQ ID NO: 15776 - RNA, 18 nt, artificial
  Chemically synthesized
acugcuggucugcugagg

SEQ ID NO: 15777 - RNA, 18 nt, artificial
  Chemically synthesized
cauggaggaugucauggc

SEQ ID NO: 15778 - RNA, 18 nt, artificial
  Chemically synthesized
acucucucucuauauaug

SEQ ID NO: 15779 - RNA, 18 nt, artificial
  Chemically synthesized
uugcuuucuccacacagu

SEQ ID NO: 15780 - RNA, 18 nt, artificial
  Chemically synthesized
uugccugaagcaucuuca

SEQ ID NO: 15781 - RNA, 18 nt, artificial
  Chemically synthesized
aaacuuccuaagcucagg

SEQ ID NO: 15782 - RNA, 18 nt, artificial
  Chemically synthesized
uuauguacaucccauugc

SEQ ID NO: 15783 - RNA, 18 nt, artificial
  Chemically synthesized
cacacucgucuucccuug

SEQ ID NO: 15784 - RNA, 18 nt, artificial
  Chemically synthesized
uacucuucucuggcaugg

SEQ ID NO: 15785 - RNA, 18 nt, artificial
  Chemically synthesized
cacaugguaggcaacugc

SEQ ID NO: 15786 - RNA, 18 nt, artificial
  Chemically synthesized
aagagaauaccacauuuc

SEQ ID NO: 15787 - RNA, 18 nt, artificial
  Chemically synthesized
gacguggcugauacugac

SEQ ID NO: 15788 - RNA, 18 nt, artificial
  Chemically synthesized
caugcugugucucuuauc

SEQ ID NO: 15789 - RNA, 18 nt, artificial
  Chemically synthesized
uaggcaacugcucauagg

SEQ ID NO: 15790 - RNA, 18 nt, artificial
  Chemically synthesized
ucucggaggucgucuccu

SEQ ID NO: 15791 - RNA, 18 nt, artificial
  Chemically synthesized
auuaaauagccucuggug

SEQ ID NO: 15792 - RNA, 18 nt, artificial
  Chemically synthesized
acaguagagaaaugaagu

SEQ ID NO: 15793 - RNA, 18 nt, artificial
  Chemically synthesized
uggcuaccuucagggugc

SEQ ID NO: 15794 - RNA, 18 nt, artificial
  Chemically synthesized
auaguccuaaugaaacug

SEQ ID NO: 15795 - RNA, 18 nt, artificial
  Chemically synthesized
uuuuucaaaagcaguugg

SEQ ID NO: 15796 - RNA, 18 nt, artificial
  Chemically synthesized
agugcauaauacaugcug

SEQ ID NO: 15797 - RNA, 18 nt, artificial
  Chemically synthesized
cuuuuucuaacuuugcag

SEQ ID NO: 15798 - RNA, 18 nt, artificial
  Chemically synthesized
guccauauauuuuccagg

SEQ ID NO: 15799 - RNA, 18 nt, artificial
  Chemically synthesized
uccacacucgucuucccu

SEQ ID NO: 15800 - RNA, 18 nt, artificial
  Chemically synthesized
uaccuucagggugcagag

SEQ ID NO: 15801 - RNA, 18 nt, artificial
  Chemically synthesized
aaccaaacuccuacaaac

SEQ ID NO: 15802 - RNA, 18 nt, artificial
  Chemically synthesized
ucccucuccuuuucuuuc

SEQ ID NO: 15803 - RNA, 18 nt, artificial
  Chemically synthesized
agagaauucagucagggc

SEQ ID NO: 15804 - RNA, 18 nt, artificial
  Chemically synthesized
cucucggaggucgucucc

SEQ ID NO: 15805 - RNA, 18 nt, artificial
  Chemically synthesized
cucuugcauagaaaaagg

SEQ ID NO: 15806 - RNA, 18 nt, artificial
  Chemically synthesized
cucuuggcaugucuguac

SEQ ID NO: 15807 - RNA, 18 nt, artificial
  Chemically synthesized
cuuucuccacacaguaga

SEQ ID NO: 15808 - RNA, 18 nt, artificial
  Chemically synthesized
uugccauaaucugagaug

SEQ ID NO: 15809 - RNA, 18 nt, artificial
  Chemically synthesized
ugucuguacaaagaaggc

SEQ ID NO: 15810 - RNA, 18 nt, artificial
  Chemically synthesized
ucuguauggcuaccuuca

SEQ ID NO: 15811 - RNA, 18 nt, artificial
  Chemically synthesized
auucaucuuguuuuggga

SEQ ID NO: 15812 - RNA, 18 nt, artificial
  Chemically synthesized
ucaccucuuggcaugucu

SEQ ID NO: 15813 - RNA, 18 nt, artificial
  Chemically synthesized
cuaacuugacaaagagcu

SEQ ID NO: 15814 - RNA, 18 nt, artificial
  Chemically synthesized
auccuaugcucaugaagu

SEQ ID NO: 15815 - RNA, 18 nt, artificial
  Chemically synthesized
cucccuccuugcuucauc

SEQ ID NO: 15816 - RNA, 18 nt, artificial
  Chemically synthesized
ugccuugaaccaaacaaa

SEQ ID NO: 15817 - RNA, 18 nt, artificial
  Chemically synthesized
uaaucccucuccuuuucu

SEQ ID NO: 15818 - RNA, 18 nt, artificial
  Chemically synthesized
acuucugaaguuguggag

SEQ ID NO: 15819 - RNA, 18 nt, artificial
  Chemically synthesized
uggacguggcugauacug

SEQ ID NO: 15820 - RNA, 18 nt, artificial
  Chemically synthesized
uuuauugcuuucuccaca

SEQ ID NO: 15821 - RNA, 18 nt, artificial
  Chemically synthesized
gacauucaguuacuauug

SEQ ID NO: 15822 - RNA, 18 nt, artificial
  Chemically synthesized
auguugcaucauuaggag

SEQ ID NO: 15823 - RNA, 18 nt, artificial
  Chemically synthesized
aauacucuucucuggcau

SEQ ID NO: 15824 - RNA, 18 nt, artificial
  Chemically synthesized
gucugcugaggacuggac

SEQ ID NO: 15825 - RNA, 18 nt, artificial
  Chemically synthesized
aacuuccuaagcucaggc

SEQ ID NO: 15826 - RNA, 18 nt, artificial
  Chemically synthesized
gcaacugcucauaggugc

SEQ ID NO: 15827 - RNA, 18 nt, artificial
  Chemically synthesized
uauaaagcagcaccauau

SEQ ID NO: 15828 - RNA, 18 nt, artificial
  Chemically synthesized
aaaaguugcugaugucag

SEQ ID NO: 15829 - RNA, 18 nt, artificial
  Chemically synthesized
cuuuguggaucugucggc

SEQ ID NO: 15830 - RNA, 18 nt, artificial
  Chemically synthesized
uauauguaugucccaucu

SEQ ID NO: 15831 - RNA, 18 nt, artificial
  Chemically synthesized
ucuucucaacucagauaa

SEQ ID NO: 15832 - RNA, 18 nt, artificial
  Chemically synthesized
ggcgcagcacccugacgc

SEQ ID NO: 15833 - RNA, 18 nt, artificial
  Chemically synthesized
uauuaaaaugucugcagc

SEQ ID NO: 15834 - RNA, 18 nt, artificial
  Chemically synthesized
ucucggaauccuaugcuc

SEQ ID NO: 15835 - RNA, 18 nt, artificial
  Chemically synthesized
uggagcggaugauggugg

SEQ ID NO: 15836 - RNA, 18 nt, artificial
  Chemically synthesized
auggcaagagcgugugcg

SEQ ID NO: 15837 - RNA, 18 nt, artificial
  Chemically synthesized
ucuagucucaagagaauu

SEQ ID NO: 15838 - RNA, 18 nt, artificial
  Chemically synthesized
uuaaauagccucuggugg

SEQ ID NO: 15839 - RNA, 18 nt, artificial
  Chemically synthesized
gauggucucguccauguc

SEQ ID NO: 15840 - RNA, 18 nt, artificial
  Chemically synthesized
uuucuugccauaaucuga

SEQ ID NO: 15841 - RNA, 18 nt, artificial
  Chemically synthesized
cuuucuuaaccuauccuc

SEQ ID NO: 15842 - RNA, 18 nt, artificial
  Chemically synthesized
ccuccuugcuucaucacc

SEQ ID NO: 15843 - RNA, 18 nt, artificial
  Chemically synthesized
cauugcauacauucaucu

SEQ ID NO: 15844 - RNA, 18 nt, artificial
  Chemically synthesized
cagaaauguaacuucucc

SEQ ID NO: 15845 - RNA, 18 nt, artificial
  Chemically synthesized
ugucaguuaccgagcugc

SEQ ID NO: 15846 - RNA, 18 nt, artificial
  Chemically synthesized
cuucuaaaugguaacaag

SEQ ID NO: 15847 - RNA, 18 nt, artificial
  Chemically synthesized
uguaugucccaucuaguc

SEQ ID NO: 15848 - RNA, 18 nt, artificial
  Chemically synthesized
guagagaaaugaagugca

SEQ ID NO: 15849 - RNA, 18 nt, artificial
  Chemically synthesized
acuguuauuuauccgauc

SEQ ID NO: 15850 - RNA, 18 nt, artificial
  Chemically synthesized
ugagacacaagccgcacc

SEQ ID NO: 15851 - RNA, 18 nt, artificial
  Chemically synthesized
ugcucggccgcaagagcc

SEQ ID NO: 15852 - RNA, 18 nt, artificial
  Chemically synthesized
augcacugcuaaauguca

SEQ ID NO: 15853 - RNA, 18 nt, artificial
  Chemically synthesized
uucugucccuuuccuuuc

SEQ ID NO: 15854 - RNA, 18 nt, artificial
  Chemically synthesized
cgaguaauuguucucgcu

SEQ ID NO: 15855 - RNA, 18 nt, artificial
  Chemically synthesized
ucuugcauagaaaaaggu

SEQ ID NO: 15856 - RNA, 18 nt, artificial
  Chemically synthesized
ucggaggucgucuccucg

SEQ ID NO: 15857 - RNA, 18 nt, artificial
  Chemically synthesized
auacugacaagggcgggc

SEQ ID NO: 15858 - RNA, 18 nt, artificial
  Chemically synthesized
caagugcugagaugagac

SEQ ID NO: 15859 - RNA, 18 nt, artificial
  Chemically synthesized
agcggaugaugguggugg

SEQ ID NO: 15860 - RNA, 18 nt, artificial
  Chemically synthesized
ugucgcucucggaggucg

SEQ ID NO: 15861 - RNA, 18 nt, artificial
  Chemically synthesized
auacaugcugugucucuu

SEQ ID NO: 15862 - RNA, 18 nt, artificial
  Chemically synthesized
uggaggacauucaguuac

SEQ ID NO: 15863 - RNA, 18 nt, artificial
  Chemically synthesized
agaauagauguugcauca

SEQ ID NO: 15864 - RNA, 18 nt, artificial
  Chemically synthesized
aucccucuccuuuucuuu

SEQ ID NO: 15865 - RNA, 18 nt, artificial
  Chemically synthesized
gaaacacgacucucucac

SEQ ID NO: 15866 - RNA, 18 nt, artificial
  Chemically synthesized
auacucuucucuggcaug

SEQ ID NO: 15867 - RNA, 18 nt, artificial
  Chemically synthesized
acaagaauagauguugca

SEQ ID NO: 15868 - RNA, 18 nt, artificial
  Chemically synthesized
uuauaccaaugcacugcu

SEQ ID NO: 15869 - RNA, 18 nt, artificial
  Chemically synthesized
uucugaaguuguggagag

SEQ ID NO: 15870 - RNA, 18 nt, artificial
  Chemically synthesized
aaaagacuagguacagua

SEQ ID NO: 15871 - RNA, 18 nt, artificial
  Chemically synthesized
cauucggagggcugaauc

SEQ ID NO: 15872 - RNA, 18 nt, artificial
  Chemically synthesized
gauguugcaucauuagga

SEQ ID NO: 15873 - RNA, 18 nt, artificial
  Chemically synthesized
caugucuguacaaagaag

SEQ ID NO: 15874 - RNA, 18 nt, artificial
  Chemically synthesized
augguaggcaacugcuca

SEQ ID NO: 15875 - RNA, 18 nt, artificial
  Chemically synthesized
acuagaucuuucaacuug

SEQ ID NO: 15876 - RNA, 18 nt, artificial
  Chemically synthesized
acucugaaauggaggaca

SEQ ID NO: 15877 - RNA, 18 nt, artificial
  Chemically synthesized
ugaggacuggacguggcu

SEQ ID NO: 15878 - RNA, 18 nt, artificial
  Chemically synthesized
uaagcucaggcacuuacg

SEQ ID NO: 15879 - RNA, 18 nt, artificial
  Chemically synthesized
acugcucauaggugcacu

SEQ ID NO: 15880 - RNA, 18 nt, artificial
  Chemically synthesized
gcgcaacuucuguuaggc

SEQ ID NO: 15881 - RNA, 18 nt, artificial
  Chemically synthesized
uucccuugugcaauguua

SEQ ID NO: 15882 - RNA, 18 nt, artificial
  Chemically synthesized
agaagaaaacuuccuaag

SEQ ID NO: 15883 - RNA, 18 nt, artificial
  Chemically synthesized
aagugcauaauacaugcu

SEQ ID NO: 15884 - RNA, 18 nt, artificial
  Chemically synthesized
uguuuauugcuuucucca

SEQ ID NO: 15885 - RNA, 18 nt, artificial
  Chemically synthesized
uuccacugcuggucugcu

SEQ ID NO: 15886 - RNA, 18 nt, artificial
  Chemically synthesized
auaccacauuuccacucg

SEQ ID NO: 15887 - RNA, 18 nt, artificial
  Chemically synthesized
uccaugucgcucucggag

SEQ ID NO: 15888 - RNA, 18 nt, artificial
  Chemically synthesized
acaugguaggcaacugcu

SEQ ID NO: 15889 - RNA, 18 nt, artificial
  Chemically synthesized
ugaaauggaggacauuca

SEQ ID NO: 15890 - RNA, 18 nt, artificial
  Chemically synthesized
augauccacugucauuug

SEQ ID NO: 15891 - RNA, 18 nt, artificial
  Chemically synthesized
acauucaguuacuauugc

SEQ ID NO: 15892 - RNA, 18 nt, artificial
  Chemically synthesized
ugaaguccauggcaagag

SEQ ID NO: 15893 - RNA, 18 nt, artificial
  Chemically synthesized
ugauccacugucauuugc

SEQ ID NO: 15894 - RNA, 18 nt, artificial
  Chemically synthesized
cccaauucagacauacug

SEQ ID NO: 15895 - RNA, 18 nt, artificial
  Chemically synthesized
guuacuauugcaagaagu

SEQ ID NO: 15896 - RNA, 18 nt, artificial
  Chemically synthesized
cucgucuucccuugugca

SEQ ID NO: 15897 - RNA, 18 nt, artificial
  Chemically synthesized
uggucugcugaggacugg

SEQ ID NO: 15898 - RNA, 18 nt, artificial
  Chemically synthesized
ugugcgucaaaguagccu

SEQ ID NO: 15899 - RNA, 18 nt, artificial
  Chemically synthesized
cacugcuaaaugucaccu

SEQ ID NO: 15900 - RNA, 18 nt, artificial
  Chemically synthesized
acaaaaacucucacgugc

SEQ ID NO: 15901 - RNA, 18 nt, artificial
  Chemically synthesized
ucugagaacugaugaaau

SEQ ID NO: 15902 - RNA, 18 nt, artificial
  Chemically synthesized
gucucguccaugucgcuc

SEQ ID NO: 15903 - RNA, 18 nt, artificial
  Chemically synthesized
gaaaugcuuguuaaucug

SEQ ID NO: 15904 - RNA, 18 nt, artificial
  Chemically synthesized
gacucucucacucucucu

SEQ ID NO: 15905 - RNA, 18 nt, artificial
  Chemically synthesized
ucaaaugcaaucacuaac

SEQ ID NO: 15906 - RNA, 18 nt, artificial
  Chemically synthesized
aauccuaugcucaugaag

SEQ ID NO: 15907 - RNA, 18 nt, artificial
  Chemically synthesized
acagagcuaguacuuugc

SEQ ID NO: 15908 - RNA, 18 nt, artificial
  Chemically synthesized
uuguuccuuuguggaucu

SEQ ID NO: 15909 - RNA, 18 nt, artificial
  Chemically synthesized
aagacuucugucccuuuc

SEQ ID NO: 15910 - RNA, 18 nt, artificial
  Chemically synthesized
caauucagacauacugau

SEQ ID NO: 15911 - RNA, 18 nt, artificial
  Chemically synthesized
acuccuacaaacuggaga

SEQ ID NO: 15912 - RNA, 18 nt, artificial
  Chemically synthesized
ugcugaggacuggacgug

SEQ ID NO: 15913 - RNA, 18 nt, artificial
  Chemically synthesized
caucuagucucaagagaa

SEQ ID NO: 15914 - RNA, 18 nt, artificial
  Chemically synthesized
aagcagcaccauauuuug

SEQ ID NO: 15915 - RNA, 18 nt, artificial
  Chemically synthesized
cuaaaugucaccucuugg

SEQ ID NO: 15916 - RNA, 18 nt, artificial
  Chemically synthesized
ugcauaauacaugcugug

SEQ ID NO: 15917 - RNA, 18 nt, artificial
  Chemically synthesized
cuuguuaaucugagaacu

SEQ ID NO: 15918 - RNA, 18 nt, artificial
  Chemically synthesized
agagggacaagagagagg

SEQ ID NO: 15919 - RNA, 18 nt, artificial
  Chemically synthesized
uugcuucaucaccuccag

SEQ ID NO: 15920 - RNA, 18 nt, artificial
  Chemically synthesized
gguuugugucucaaauag

SEQ ID NO: 15921 - RNA, 18 nt, artificial
  Chemically synthesized
ugguauuaaaaugucugc

SEQ ID NO: 15922 - RNA, 18 nt, artificial
  Chemically synthesized
ugucugcagccuauugca

SEQ ID NO: 15923 - RNA, 18 nt, artificial
  Chemically synthesized
aggaaacuucuaaauggu

SEQ ID NO: 15924 - RNA, 18 nt, artificial
  Chemically synthesized
ugauacugacaagggcgg

SEQ ID NO: 15925 - RNA, 18 nt, artificial
  Chemically synthesized
agaaaacuuccuaagcuc

SEQ ID NO: 15926 - RNA, 18 nt, artificial
  Chemically synthesized
aaguccauggcaagagcg

SEQ ID NO: 15927 - RNA, 18 nt, artificial
  Chemically synthesized
ccacgucgauggucucgu

SEQ ID NO: 15928 - RNA, 18 nt, artificial
  Chemically synthesized
cuguuauuuauccgaucc

SEQ ID NO: 15929 - RNA, 18 nt, artificial
  Chemically synthesized
gugcucccuccuugcuuc

SEQ ID NO: 15930 - RNA, 18 nt, artificial
  Chemically synthesized
aaacucucacgugcuuga

SEQ ID NO: 15931 - RNA, 18 nt, artificial
  Chemically synthesized
uccuagcggcucuuuccc

SEQ ID NO: 15932 - RNA, 18 nt, artificial
  Chemically synthesized
ugcuggaugguacggucc

SEQ ID NO: 15933 - RNA, 18 nt, artificial
  Chemically synthesized
acagagggaagcugugug

SEQ ID NO: 15934 - RNA, 18 nt, artificial
  Chemically synthesized
ccaaugcacugcuaaaug

SEQ ID NO: 15935 - RNA, 18 nt, artificial
  Chemically synthesized
guauuaaaaugucugcag

SEQ ID NO: 15936 - RNA, 18 nt, artificial
  Chemically synthesized
ucacgugcuugauuucag

SEQ ID NO: 15937 - RNA, 18 nt, artificial
  Chemically synthesized
auguaacuucucccaaag

SEQ ID NO: 15938 - RNA, 18 nt, artificial
  Chemically synthesized
ugaugucaguuaccgagc

SEQ ID NO: 15939 - RNA, 18 nt, artificial
  Chemically synthesized
cucucucacucucucucu

SEQ ID NO: 15940 - RNA, 18 nt, artificial
  Chemically synthesized
gcagcaccauauuuugag

SEQ ID NO: 15941 - RNA, 18 nt, artificial
  Chemically synthesized
ugcugugucucuuaucuu

SEQ ID NO: 15942 - RNA, 18 nt, artificial
  Chemically synthesized
acgccgcaacucugcucg

SEQ ID NO: 15943 - RNA, 18 nt, artificial
  Chemically synthesized
aguccaggccuuccacgg

SEQ ID NO: 15944 - RNA, 18 nt, artificial
  Chemically synthesized
uauaaucccucuccuuuu

SEQ ID NO: 15945 - RNA, 18 nt, artificial
  Chemically synthesized
cuuuucucuauaaucccu

SEQ ID NO: 15946 - RNA, 18 nt, artificial
  Chemically synthesized
aaggacagagggaagcug

SEQ ID NO: 15947 - RNA, 18 nt, artificial
  Chemically synthesized
aacuggagaguuuucaag

SEQ ID NO: 15948 - RNA, 18 nt, artificial
  Chemically synthesized
gacauacugaugcacugc

SEQ ID NO: 15949 - RNA, 18 nt, artificial
  Chemically synthesized
uuauuuauccgaucccga

SEQ ID NO: 15950 - RNA, 18 nt, artificial
  Chemically synthesized
acugcuggaugguacggu

SEQ ID NO: 15951 - RNA, 18 nt, artificial
  Chemically synthesized
uaaagacucuugcauaga

SEQ ID NO: 15952 - RNA, 18 nt, artificial
  Chemically synthesized
cagagagggacaagagag

SEQ ID NO: 15953 - RNA, 18 nt, artificial
  Chemically synthesized
ccuauugcaagacuucug

SEQ ID NO: 15954 - RNA, 18 nt, artificial
  Chemically synthesized
ugggcaggaggcacuucu

SEQ ID NO: 15955 - RNA, 18 nt, artificial
  Chemically synthesized
accaaacuccuacaaacu

SEQ ID NO: 15956 - RNA, 18 nt, artificial
  Chemically synthesized
acacaugguaggcaacug

SEQ ID NO: 15957 - RNA, 18 nt, artificial
  Chemically synthesized
uauugcaagaaguucaag

SEQ ID NO: 15958 - RNA, 18 nt, artificial
  Chemically synthesized
uggauggcauucggaggg

SEQ ID NO: 15959 - RNA, 18 nt, artificial
  Chemically synthesized
aagacucuugcauagaaa

SEQ ID NO: 15960 - RNA, 18 nt, artificial
  Chemically synthesized
ugaaguuguggagaggcg

SEQ ID NO: 15961 - RNA, 18 nt, artificial
  Chemically synthesized
uagcggcucuuucccacg

SEQ ID NO: 15962 - RNA, 18 nt, artificial
  Chemically synthesized
cacucgugagguuugugu

SEQ ID NO: 15963 - RNA, 18 nt, artificial
  Chemically synthesized
guugcugaugucaguuac

SEQ ID NO: 15964 - RNA, 18 nt, artificial
  Chemically synthesized
agguuuuaagcugacucu

SEQ ID NO: 15965 - RNA, 18 nt, artificial
  Chemically synthesized
agugcugagaugagacac

SEQ ID NO: 15966 - RNA, 18 nt, artificial
  Chemically synthesized
auggaggaugucauggcc

SEQ ID NO: 15967 - RNA, 18 nt, artificial
  Chemically synthesized
ugguauguaaagacucuu

SEQ ID NO: 15968 - RNA, 18 nt, artificial
  Chemically synthesized
ucugguggacacauggua

SEQ ID NO: 15969 - RNA, 18 nt, artificial
  Chemically synthesized
auugcuuauaccaaugca

SEQ ID NO: 15970 - RNA, 18 nt, artificial
  Chemically synthesized
aaugcaaucacuaacuug

SEQ ID NO: 15971 - RNA, 18 nt, artificial
  Chemically synthesized
acauacugaugcacugcu

SEQ ID NO: 15972 - RNA, 18 nt, artificial
  Chemically synthesized
ugguggacacaugguagg

SEQ ID NO: 15973 - RNA, 18 nt, artificial
  Chemically synthesized
cuagugcucccuccuugc

SEQ ID NO: 15974 - RNA, 18 nt, artificial
  Chemically synthesized
agagcgugugcgucaaag

SEQ ID NO: 15975 - RNA, 18 nt, artificial
  Chemically synthesized
uugcaagaaguucaagaa

SEQ ID NO: 15976 - RNA, 18 nt, artificial
  Chemically synthesized
gcaugaauuaaauagccu

SEQ ID NO: 15977 - RNA, 18 nt, artificial
  Chemically synthesized
accaaacaaaaaagggag

SEQ ID NO: 15978 - RNA, 18 nt, artificial
  Chemically synthesized
ccgcaacucugcucggcc

SEQ ID NO: 15979 - RNA, 18 nt, artificial
  Chemically synthesized
aguuggcacaagucuucu

SEQ ID NO: 15980 - RNA, 18 nt, artificial
  Chemically synthesized
uccacugucauuugcaau

SEQ ID NO: 15981 - RNA, 18 nt, artificial
  Chemically synthesized
augagacacaagccgcac

SEQ ID NO: 15982 - RNA, 18 nt, artificial
  Chemically synthesized
ucuauaaucccucuccuu

SEQ ID NO: 15983 - RNA, 18 nt, artificial
  Chemically synthesized
cggucugcuccuagcggc

SEQ ID NO: 15984 - RNA, 18 nt, artificial
  Chemically synthesized
ucugcuccuagcggcucu

SEQ ID NO: 15985 - RNA, 18 nt, artificial
  Chemically synthesized
ggcugaauccgcaugggc

SEQ ID NO: 15986 - RNA, 18 nt, artificial
  Chemically synthesized
aaugucugcagccuauug

SEQ ID NO: 15987 - RNA, 18 nt, artificial
  Chemically synthesized
gucuucccuugugcaaug

SEQ ID NO: 15988 - RNA, 18 nt, artificial
  Chemically synthesized
auggcuguggccgcggcc

SEQ ID NO: 15989 - RNA, 18 nt, artificial
  Chemically synthesized
agauguuguuguuggaga

SEQ ID NO: 15990 - RNA, 18 nt, artificial
  Chemically synthesized
aagcaguuggcacaaguc

SEQ ID NO: 15991 - RNA, 18 nt, artificial
  Chemically synthesized
auagcacuaguuuaggca

SEQ ID NO: 15992 - RNA, 18 nt, artificial
  Chemically synthesized
uccagaaauguaacuucu

SEQ ID NO: 15993 - RNA, 18 nt, artificial
  Chemically synthesized
aagggugacaagaauaga

SEQ ID NO: 15994 - RNA, 18 nt, artificial
  Chemically synthesized
cugcuaaaugucaccucu

SEQ ID NO: 15995 - RNA, 18 nt, artificial
  Chemically synthesized
caguuggcacaagucuuc

SEQ ID NO: 15996 - RNA, 18 nt, artificial
  Chemically synthesized
aaauggaggacauucagu

SEQ ID NO: 15997 - RNA, 18 nt, artificial
  Chemically synthesized
gauccgaggaguccaggc

SEQ ID NO: 15998 - RNA, 18 nt, artificial
  Chemically synthesized
aucugagaacugaugaaa

SEQ ID NO: 15999 - RNA, 18 nt, artificial
  Chemically synthesized
cagaaaugcuuguuaauc

SEQ ID NO: 16000 - RNA, 18 nt, artificial
  Chemically synthesized
caaacuggagaguuuuca

SEQ ID NO: 16001 - RNA, 18 nt, artificial
  Chemically synthesized
uaacuuauguacauccca

SEQ ID NO: 16002 - RNA, 18 nt, artificial
  Chemically synthesized
cgugugcgucaaaguagc

SEQ ID NO: 16003 - RNA, 18 nt, artificial
  Chemically synthesized
acguggcugauacugaca

SEQ ID NO: 16004 - RNA, 18 nt, artificial
  Chemically synthesized
uguaaagacucuugcaua

SEQ ID NO: 16005 - RNA, 18 nt, artificial
  Chemically synthesized
ucccuccuugcuucauca

SEQ ID NO: 16006 - RNA, 18 nt, artificial
  Chemically synthesized
acgccuuuucucuauaau

SEQ ID NO: 16007 - RNA, 18 nt, artificial
  Chemically synthesized
cgacucucucacucucuc

SEQ ID NO: 16008 - RNA, 18 nt, artificial
  Chemically synthesized
uccgcaugggcaaacgug

SEQ ID NO: 16009 - RNA, 18 nt, artificial
  Chemically synthesized
agcugccuugaaccaaac

SEQ ID NO: 16010 - RNA, 18 nt, artificial
  Chemically synthesized
agcuccaacuucuguccc

SEQ ID NO: 16011 - RNA, 18 nt, artificial
  Chemically synthesized
ucagggcauuuuacuucc

SEQ ID NO: 16012 - RNA, 18 nt, artificial
  Chemically synthesized
cugaggacuggacguggc

SEQ ID NO: 16013 - RNA, 18 nt, artificial
  Chemically synthesized
aagggagagaaaaaaaag

SEQ ID NO: 16014 - RNA, 18 nt, artificial
  Chemically synthesized
gcacuucugaaguugugg

SEQ ID NO: 16015 - RNA, 18 nt, artificial
  Chemically synthesized
augcaaaaaagacuaggu

SEQ ID NO: 16016 - RNA, 18 nt, artificial
  Chemically synthesized
cuccagaaauguaacuuc

SEQ ID NO: 16017 - RNA, 18 nt, artificial
  Chemically synthesized
cugaugucaguuaccgag

SEQ ID NO: 16018 - RNA, 18 nt, artificial
  Chemically synthesized
uacaaagaaggcaaacua

SEQ ID NO: 16019 - RNA, 18 nt, artificial
  Chemically synthesized
uuuccacucgugagguuu

SEQ ID NO: 16020 - RNA, 18 nt, artificial
  Chemically synthesized
aaguuguggagaggcgac

SEQ ID NO: 16021 - RNA, 18 nt, artificial
  Chemically synthesized
cauacugaugcacugcug

SEQ ID NO: 16022 - RNA, 18 nt, artificial
  Chemically synthesized
gugguauguaaagacucu

SEQ ID NO: 16023 - RNA, 18 nt, artificial
  Chemically synthesized
cuauugcaagacuucugu

SEQ ID NO: 16024 - RNA, 18 nt, artificial
  Chemically synthesized
cacgucgauggucucguc

SEQ ID NO: 16025 - RNA, 18 nt, artificial
  Chemically synthesized
ucuguacaaagaaggcaa

SEQ ID NO: 16026 - RNA, 18 nt, artificial
  Chemically synthesized
gcugauacugacaagggc

SEQ ID NO: 16027 - RNA, 18 nt, artificial
  Chemically synthesized
caugguaggcaacugcuc

SEQ ID NO: 16028 - RNA, 18 nt, artificial
  Chemically synthesized
ucaccuccagaaauguaa

SEQ ID NO: 16029 - RNA, 18 nt, artificial
  Chemically synthesized
augguacgguccauauau

SEQ ID NO: 16030 - RNA, 18 nt, artificial
  Chemically synthesized
gacacaagccgcacccgc

SEQ ID NO: 16031 - RNA, 18 nt, artificial
  Chemically synthesized
uacaugcugugucucuua

SEQ ID NO: 16032 - RNA, 18 nt, artificial
  Chemically synthesized
acucugaggcauggaggc

SEQ ID NO: 16033 - RNA, 18 nt, artificial
  Chemically synthesized
cuuuucucuuccuagugc

SEQ ID NO: 16034 - RNA, 18 nt, artificial
  Chemically synthesized
gucuucucaacucagaua

SEQ ID NO: 16035 - RNA, 18 nt, artificial
  Chemically synthesized
ugacgcccgccuccuccc

SEQ ID NO: 16036 - RNA, 18 nt, artificial
  Chemically synthesized
cugugucucuuaucuuuu

SEQ ID NO: 16037 - RNA, 18 nt, artificial
  Chemically synthesized
acccugacgcccgccucc

SEQ ID NO: 16038 - RNA, 18 nt, artificial
  Chemically synthesized
aaaguugcugaugucagu

SEQ ID NO: 16039 - RNA, 18 nt, artificial
  Chemically synthesized
uccuugcuucaucaccuc

SEQ ID NO: 16040 - RNA, 18 nt, artificial
  Chemically synthesized
ucugagauguuguuguug

SEQ ID NO: 16041 - RNA, 18 nt, artificial
  Chemically synthesized
aaagcaguuggcacaagu

SEQ ID NO: 16042 - RNA, 18 nt, artificial
  Chemically synthesized
caguagagaaaugaagug

SEQ ID NO: 16043 - RNA, 18 nt, artificial
  Chemically synthesized
uucaucccggcgaagacc

SEQ ID NO: 16044 - RNA, 18 nt, artificial
  Chemically synthesized
aauccgcaugggcaaacg

SEQ ID NO: 16045 - RNA, 18 nt, artificial
  Chemically synthesized
aggacuggacguggcuga

SEQ ID NO: 16046 - RNA, 18 nt, artificial
  Chemically synthesized
augucgcucucggagguc

SEQ ID NO: 16047 - RNA, 18 nt, artificial
  Chemically synthesized
gggacaagagagaggugg

SEQ ID NO: 16048 - RNA, 18 nt, artificial
  Chemically synthesized
augucaccucuuggcaug

SEQ ID NO: 16049 - RNA, 18 nt, artificial
  Chemically synthesized
cgugaggagagcagagcc

SEQ ID NO: 16050 - RNA, 18 nt, artificial
  Chemically synthesized
ucuucucuggcaugguau

SEQ ID NO: 16051 - RNA, 18 nt, artificial
  Chemically synthesized
agguuugugucucaaaua

SEQ ID NO: 16052 - RNA, 18 nt, artificial
  Chemically synthesized
caaagaaggcaaacuaag

SEQ ID NO: 16053 - RNA, 18 nt, artificial
  Chemically synthesized
cgucgauggucucgucca

SEQ ID NO: 16054 - RNA, 18 nt, artificial
  Chemically synthesized
acuucuguuaggcacucu

SEQ ID NO: 16055 - RNA, 18 nt, artificial
  Chemically synthesized
ucucucacucucucucua

SEQ ID NO: 16056 - RNA, 18 nt, artificial
  Chemically synthesized
caaugcacugcuaaaugu

SEQ ID NO: 16057 - RNA, 18 nt, artificial
  Chemically synthesized
aggacagagggaagcugu

SEQ ID NO: 16058 - RNA, 18 nt, artificial
  Chemically synthesized
acgguggcagagagggac

SEQ ID NO: 16059 - RNA, 18 nt, artificial
  Chemically synthesized
gaaauguaacuucuccca

SEQ ID NO: 16060 - RNA, 18 nt, artificial
  Chemically synthesized
ucuuccuagugcucccuc

SEQ ID NO: 16061 - RNA, 18 nt, artificial
  Chemically synthesized
cacacaguagagaaauga

SEQ ID NO: 16062 - RNA, 18 nt, artificial
  Chemically synthesized
cuggguggcgcaagugcu

SEQ ID NO: 16063 - RNA, 18 nt, artificial
  Chemically synthesized
aguuuucaaguuggcaug

SEQ ID NO: 16064 - RNA, 18 nt, artificial
  Chemically synthesized
agagagagguggagagag

SEQ ID NO: 16065 - RNA, 18 nt, artificial
  Chemically synthesized
cagagggaagcugugugc

SEQ ID NO: 16066 - RNA, 18 nt, artificial
  Chemically synthesized
auggcauucggagggcug

SEQ ID NO: 16067 - RNA, 18 nt, artificial
  Chemically synthesized
gaagcugugugcagccgc

SEQ ID NO: 16068 - RNA, 18 nt, artificial
  Chemically synthesized
cacucucggaauccuaug

SEQ ID NO: 16069 - RNA, 18 nt, artificial
  Chemically synthesized
cauucaguuacuauugca

SEQ ID NO: 16070 - RNA, 18 nt, artificial
  Chemically synthesized
cugacgcccgccuccucc

SEQ ID NO: 16071 - RNA, 18 nt, artificial
  Chemically synthesized
gagggcugaauccgcaug

SEQ ID NO: 16072 - RNA, 18 nt, artificial
  Chemically synthesized
aggagagcagagccgugg

SEQ ID NO: 16073 - RNA, 18 nt, artificial
  Chemically synthesized
ccauauuuugagccaucc

SEQ ID NO: 16074 - RNA, 18 nt, artificial
  Chemically synthesized
ccauugcauacauucauc

SEQ ID NO: 16075 - RNA, 18 nt, artificial
  Chemically synthesized
ggugcagagguuuuaagc

SEQ ID NO: 16076 - RNA, 18 nt, artificial
  Chemically synthesized
agcaguuggcacaagucu

SEQ ID NO: 16077 - RNA, 18 nt, artificial
  Chemically synthesized
aaaugauccacugucauu

SEQ ID NO: 16078 - RNA, 18 nt, artificial
  Chemically synthesized
cuucucccaaagggugac

SEQ ID NO: 16079 - RNA, 18 nt, artificial
  Chemically synthesized
uuguggagaggcgacaag

SEQ ID NO: 16080 - RNA, 18 nt, artificial
  Chemically synthesized
aagcucggacgccgagcg

SEQ ID NO: 16081 - RNA, 18 nt, artificial
  Chemically synthesized
guggcugauacugacaag

SEQ ID NO: 16082 - RNA, 18 nt, artificial
  Chemically synthesized
augguaacaagugugaag

SEQ ID NO: 16083 - RNA, 18 nt, artificial
  Chemically synthesized
cccgaguaauuguucucg

SEQ ID NO: 16084 - RNA, 18 nt, artificial
  Chemically synthesized
uucagacauacugaugca

SEQ ID NO: 16085 - RNA, 18 nt, artificial
  Chemically synthesized
uuguuguuggagaauuca

SEQ ID NO: 16086 - RNA, 18 nt, artificial
  Chemically synthesized
uaguccuaaugaaacuga

SEQ ID NO: 16087 - RNA, 18 nt, artificial
  Chemically synthesized
aggucgucuccucgcagg

SEQ ID NO: 16088 - RNA, 18 nt, artificial
  Chemically synthesized
ugaugcacugcuggaugg

SEQ ID NO: 16089 - RNA, 18 nt, artificial
  Chemically synthesized
cucgugagguuugugucu

SEQ ID NO: 16090 - RNA, 18 nt, artificial
  Chemically synthesized
cugcuggaugguacgguc

SEQ ID NO: 16091 - RNA, 18 nt, artificial
  Chemically synthesized
agggaagcugugugcagc

SEQ ID NO: 16092 - RNA, 18 nt, artificial
  Chemically synthesized
cucucucucuauauaugu

SEQ ID NO: 16093 - RNA, 18 nt, artificial
  Chemically synthesized
cuugcuucaucaccucca

SEQ ID NO: 16094 - RNA, 18 nt, artificial
  Chemically synthesized
uagucaaaaaggacuuca

SEQ ID NO: 16095 - RNA, 18 nt, artificial
  Chemically synthesized
aagacuagguacaguaau

SEQ ID NO: 16096 - RNA, 18 nt, artificial
  Chemically synthesized
ucuuggcaugucuguaca

SEQ ID NO: 16097 - RNA, 18 nt, artificial
  Chemically synthesized
acuggagaguuuucaagu

SEQ ID NO: 16098 - RNA, 18 nt, artificial
  Chemically synthesized
gucagggcauuuuacuuc

SEQ ID NO: 16099 - RNA, 18 nt, artificial
  Chemically synthesized
cacucgucuucccuugug

SEQ ID NO: 16100 - RNA, 18 nt, artificial
  Chemically synthesized
uccuuguuuuucaaaagc

SEQ ID NO: 16101 - RNA, 18 nt, artificial
  Chemically synthesized
cuagguacaguaauuuca

SEQ ID NO: 16102 - RNA, 18 nt, artificial
  Chemically synthesized
acuaguuuaggcaugggc

SEQ ID NO: 16103 - RNA, 18 nt, artificial
  Chemically synthesized
uuucccacgccgcaacuc

SEQ ID NO: 16104 - RNA, 18 nt, artificial
  Chemically synthesized
uacaaacuggagaguuuu

SEQ ID NO: 16105 - RNA, 18 nt, artificial
  Chemically synthesized
cuuuauuguuccuuugug

SEQ ID NO: 16106 - RNA, 18 nt, artificial
  Chemically synthesized
uccuaugcucaugaaguc

SEQ ID NO: 16107 - RNA, 18 nt, artificial
  Chemically synthesized
cucuccuuuucuuucuug

SEQ ID NO: 16108 - RNA, 18 nt, artificial
  Chemically synthesized
uagagaaaugaagugcau

SEQ ID NO: 16109 - RNA, 18 nt, artificial
  Chemically synthesized
cuggucugcugaggacug

SEQ ID NO: 16110 - RNA, 18 nt, artificial
  Chemically synthesized
aguuuucaaaaguugcug

SEQ ID NO: 16111 - RNA, 18 nt, artificial
  Chemically synthesized
gcaucuguauggcuaccu

SEQ ID NO: 16112 - RNA, 18 nt, artificial
  Chemically synthesized
uuacgaaacacgacucuc

SEQ ID NO: 16113 - RNA, 18 nt, artificial
  Chemically synthesized
cagugaugcggguggagc

SEQ ID NO: 16114 - RNA, 18 nt, artificial
  Chemically synthesized
ucccuuuccuuucuuaac

SEQ ID NO: 16115 - RNA, 18 nt, artificial
  Chemically synthesized
augcaaucacuaacuuga

SEQ ID NO: 16116 - RNA, 18 nt, artificial
  Chemically synthesized
aagaaaacuuccuaagcu

SEQ ID NO: 16117 - RNA, 18 nt, artificial
  Chemically synthesized
uccuccacacucgucuuc

SEQ ID NO: 16118 - RNA, 18 nt, artificial
  Chemically synthesized
acaagggcgggcugaugg

SEQ ID NO: 16119 - RNA, 18 nt, artificial
  Chemically synthesized
caaaaacucucacgugcu

SEQ ID NO: 16120 - RNA, 18 nt, artificial
  Chemically synthesized
augcuuguuaaucugaga

SEQ ID NO: 16121 - RNA, 18 nt, artificial
  Chemically synthesized
aucacuaacuugacaaag

SEQ ID NO: 16122 - RNA, 18 nt, artificial
  Chemically synthesized
acacucgucuucccuugu

SEQ ID NO: 16123 - RNA, 18 nt, artificial
  Chemically synthesized
cuuguuuuucaaaagcag

SEQ ID NO: 16124 - RNA, 18 nt, artificial
  Chemically synthesized
aaugucaccucuuggcau

SEQ ID NO: 16125 - RNA, 18 nt, artificial
  Chemically synthesized
acuuauguacaucccauu

SEQ ID NO: 16126 - RNA, 18 nt, artificial
  Chemically synthesized
uuaaaccaaacuccuaca

SEQ ID NO: 16127 - RNA, 18 nt, artificial
  Chemically synthesized
accuauccuccacacucg

SEQ ID NO: 16128 - RNA, 18 nt, artificial
  Chemically synthesized
ugcagccuauugcaagac

SEQ ID NO: 16129 - RNA, 18 nt, artificial
  Chemically synthesized
gugugcgucaaaguagcc

SEQ ID NO: 16130 - RNA, 18 nt, artificial
  Chemically synthesized
cuagcggcucuuucccac

SEQ ID NO: 16131 - RNA, 18 nt, artificial
  Chemically synthesized
ggaucaaaugcaaucacu

SEQ ID NO: 16132 - RNA, 18 nt, artificial
  Chemically synthesized
uuuguggaucugucggca

SEQ ID NO: 16133 - RNA, 18 nt, artificial
  Chemically synthesized
uugggcuggagcagggcu

SEQ ID NO: 16134 - RNA, 18 nt, artificial
  Chemically synthesized
cugccuugaaccaaacaa

SEQ ID NO: 16135 - RNA, 18 nt, artificial
  Chemically synthesized
ugacucugaaauggagga

SEQ ID NO: 16136 - RNA, 18 nt, artificial
  Chemically synthesized
cacauuuccacucgugag

SEQ ID NO: 16137 - RNA, 18 nt, artificial
  Chemically synthesized
cugaugcacugcuggaug

SEQ ID NO: 16138 - RNA, 18 nt, artificial
  Chemically synthesized
agagagguggcacgcagg

SEQ ID NO: 16139 - RNA, 18 nt, artificial
  Chemically synthesized
uccagaagaaaacuuccu

SEQ ID NO: 16140 - RNA, 18 nt, artificial
  Chemically synthesized
agcuuuuucuaacuuugc

SEQ ID NO: 16141 - RNA, 18 nt, artificial
  Chemically synthesized
cuaugcucaugaagucca

SEQ ID NO: 16142 - RNA, 18 nt, artificial
  Chemically synthesized
cagagcuaguacuuugcc

SEQ ID NO: 16143 - RNA, 18 nt, artificial
  Chemically synthesized
accaguaaaaccuguugg

SEQ ID NO: 16144 - RNA, 18 nt, artificial
  Chemically synthesized
uucaucuuguuuugggau

SEQ ID NO: 16145 - RNA, 18 nt, artificial
  Chemically synthesized
aagcugugugcagccgcg

SEQ ID NO: 16146 - RNA, 18 nt, artificial
  Chemically synthesized
uauggcuaccuucagggu

SEQ ID NO: 16147 - RNA, 18 nt, artificial
  Chemically synthesized
agcugacucugaaaugga

SEQ ID NO: 16148 - RNA, 18 nt, artificial
  Chemically synthesized
ugcuggucugcugaggac

SEQ ID NO: 16149 - RNA, 18 nt, artificial
  Chemically synthesized
ucgcucucggaggucguc

SEQ ID NO: 16150 - RNA, 18 nt, artificial
  Chemically synthesized
cucucggaauccuaugcu

SEQ ID NO: 16151 - RNA, 18 nt, artificial
  Chemically synthesized
uaccgcgcaacuucuguu

SEQ ID NO: 16152 - RNA, 18 nt, artificial
  Chemically synthesized
uagugcucccuccuugcu

SEQ ID NO: 16153 - RNA, 18 nt, artificial
  Chemically synthesized
ucuuucccacgccgcaac

SEQ ID NO: 16154 - RNA, 18 nt, artificial
  Chemically synthesized
uacaucccauugcauaca

SEQ ID NO: 16155 - RNA, 18 nt, artificial
  Chemically synthesized
gcgugugcgucaaaguag

SEQ ID NO: 16156 - RNA, 18 nt, artificial
  Chemically synthesized
ucccauugcauacauuca

SEQ ID NO: 16157 - RNA, 18 nt, artificial
  Chemically synthesized
uuccuagugcucccuccu

SEQ ID NO: 16158 - RNA, 18 nt, artificial
  Chemically synthesized
agugaugcggguggagcg

SEQ ID NO: 16159 - RNA, 18 nt, artificial
  Chemically synthesized
agagggaagcugugugca

SEQ ID NO: 16160 - RNA, 18 nt, artificial
  Chemically synthesized
uguacaucccauugcaua

SEQ ID NO: 16161 - RNA, 18 nt, artificial
  Chemically synthesized
gcaacuucuguuaggcac

SEQ ID NO: 16162 - RNA, 18 nt, artificial
  Chemically synthesized
aguuaccgagcugccuug

SEQ ID NO: 16163 - RNA, 18 nt, artificial
  Chemically synthesized
ugcagagguuuuaagcug

SEQ ID NO: 16164 - RNA, 18 nt, artificial
  Chemically synthesized
aaguugcugaugucaguu

SEQ ID NO: 16165 - RNA, 18 nt, artificial
  Chemically synthesized
ccuugugcaauguuauau

SEQ ID NO: 16166 - RNA, 18 nt, artificial
  Chemically synthesized
ucuucccuugugcaaugu

SEQ ID NO: 16167 - RNA, 18 nt, artificial
  Chemically synthesized
ucugcucggccgcaagag

SEQ ID NO: 16168 - RNA, 18 nt, artificial
  Chemically synthesized
cauaaucugagauguugu

SEQ ID NO: 16169 - RNA, 18 nt, artificial
  Chemically synthesized
uguaacuucucccaaagg

SEQ ID NO: 16170 - RNA, 18 nt, artificial
  Chemically synthesized
uccuuuucuuucuugcca

SEQ ID NO: 16171 - RNA, 18 nt, artificial
  Chemically synthesized
cacuucugaaguugugga

SEQ ID NO: 16172 - RNA, 18 nt, artificial
  Chemically synthesized
acuagguacaguaauuuc

SEQ ID NO: 16173 - RNA, 18 nt, artificial
  Chemically synthesized
uuucagcagaauacucuu

SEQ ID NO: 16174 - RNA, 18 nt, artificial
  Chemically synthesized
agacuagguacaguaauu

SEQ ID NO: 16175 - RNA, 18 nt, artificial
  Chemically synthesized
gcgcagcacccugacgcc

SEQ ID NO: 16176 - RNA, 18 nt, artificial
  Chemically synthesized
cucucacgugcuugauuu

SEQ ID NO: 16177 - RNA, 18 nt, artificial
  Chemically synthesized
ggucgguaagguuuauug

SEQ ID NO: 16178 - RNA, 18 nt, artificial
  Chemically synthesized
ggaugaugguggugggcc

SEQ ID NO: 16179 - RNA, 18 nt, artificial
  Chemically synthesized
guuuauuguuuguuccac

SEQ ID NO: 16180 - RNA, 18 nt, artificial
  Chemically synthesized
agccuauugcaagacuuc

SEQ ID NO: 16181 - RNA, 18 nt, artificial
  Chemically synthesized
guaggcaacugcucauag

SEQ ID NO: 16182 - RNA, 18 nt, artificial
  Chemically synthesized
agacacaagccgcacccg

SEQ ID NO: 16183 - RNA, 18 nt, artificial
  Chemically synthesized
uguuguuguuggagaauu

SEQ ID NO: 16184 - RNA, 18 nt, artificial
  Chemically synthesized
aggacauucaguuacuau

SEQ ID NO: 16185 - RNA, 18 nt, artificial
  Chemically synthesized
uggaggaugucauggccg

SEQ ID NO: 16186 - RNA, 18 nt, artificial
  Chemically synthesized
caacuucuguuaggcacu

SEQ ID NO: 16187 - RNA, 18 nt, artificial
  Chemically synthesized
uuuugggaucaaaugcaa

SEQ ID NO: 16188 - RNA, 18 nt, artificial
  Chemically synthesized
aacaaaaacucucacgug

SEQ ID NO: 16189 - RNA, 18 nt, artificial
  Chemically synthesized
ggucgucuccucgcaggg

SEQ ID NO: 16190 - RNA, 18 nt, artificial
  Chemically synthesized
gugaggagagcagagccg

SEQ ID NO: 16191 - RNA, 18 nt, artificial
  Chemically synthesized
cuuauguacaucccauug

SEQ ID NO: 16192 - RNA, 18 nt, artificial
  Chemically synthesized
ccaauucagacauacuga

SEQ ID NO: 16193 - RNA, 18 nt, artificial
  Chemically synthesized
aauguaacuucucccaaa

SEQ ID NO: 16194 - RNA, 18 nt, artificial
  Chemically synthesized
uggcugcugcggcugcgg

SEQ ID NO: 16195 - RNA, 18 nt, artificial
  Chemically synthesized
aaaaaagacuagguacag

SEQ ID NO: 16196 - RNA, 18 nt, artificial
  Chemically synthesized
ucugaggcauggaggccg

SEQ ID NO: 16197 - RNA, 18 nt, artificial
  Chemically synthesized
ucucacucucucucuaua

SEQ ID NO: 16198 - RNA, 18 nt, artificial
  Chemically synthesized
gagggacaagagagaggu

SEQ ID NO: 16199 - RNA, 18 nt, artificial
  Chemically synthesized
ucaguuaccgagcugccu

SEQ ID NO: 16200 - RNA, 18 nt, artificial
  Chemically synthesized
gaguccaggccuuccacg

SEQ ID NO: 16201 - RNA, 18 nt, artificial
  Chemically synthesized
gggagagaaaaaaaagag

SEQ ID NO: 16202 - RNA, 18 nt, artificial
  Chemically synthesized
ugucggcaucuguauggc

SEQ ID NO: 16203 - RNA, 18 nt, artificial
  Chemically synthesized
ucuaaucacagagcuagu

SEQ ID NO: 16204 - RNA, 18 nt, artificial
  Chemically synthesized
auagccucugguggacac

SEQ ID NO: 16205 - RNA, 18 nt, artificial
  Chemically synthesized
ccaaacuccuacaaacug

SEQ ID NO: 16206 - RNA, 18 nt, artificial
  Chemically synthesized
accauauuuugagccauc

SEQ ID NO: 16207 - RNA, 18 nt, artificial
  Chemically synthesized
ggguggagcggaugaugg

SEQ ID NO: 16208 - RNA, 18 nt, artificial
  Chemically synthesized
ggugcacuauauaaaugu

SEQ ID NO: 16209 - RNA, 18 nt, artificial
  Chemically synthesized
aaauguaacuucucccaa

SEQ ID NO: 16210 - RNA, 18 nt, artificial
  Chemically synthesized
acuaacuugacaaagagc

SEQ ID NO: 16211 - RNA, 18 nt, artificial
  Chemically synthesized
uggagaguuuucaaguug

SEQ ID NO: 16212 - RNA, 18 nt, artificial
  Chemically synthesized
cagcaccauauuuugagc

SEQ ID NO: 16213 - RNA, 18 nt, artificial
  Chemically synthesized
agaaggcaaacuaagaua

SEQ ID NO: 16214 - RNA, 18 nt, artificial
  Chemically synthesized
aguuguggagaggcgaca

SEQ ID NO: 16215 - RNA, 18 nt, artificial
  Chemically synthesized
ucucacgugcuugauuuc

SEQ ID NO: 16216 - RNA, 18 nt, artificial
  Chemically synthesized
ucugucggcaucuguaug

SEQ ID NO: 16217 - RNA, 18 nt, artificial
  Chemically synthesized
aauagccucugguggaca

SEQ ID NO: 16218 - RNA, 18 nt, artificial
  Chemically synthesized
cuaccuucagggugcaga

SEQ ID NO: 16219 - RNA, 18 nt, artificial
  Chemically synthesized
aaaacuuccuaagcucag

SEQ ID NO: 16220 - RNA, 18 nt, artificial
  Chemically synthesized
gcaggugguggaaggcgg

SEQ ID NO: 16221 - RNA, 18 nt, artificial
  Chemically synthesized
gguccauauauuuuccag

SEQ ID NO: 16222 - RNA, 18 nt, artificial
  Chemically synthesized
ugugugcagccgcggugg

SEQ ID NO: 16223 - RNA, 18 nt, artificial
  Chemically synthesized
ccauggaggaugucaugg

SEQ ID NO: 16224 - RNA, 18 nt, artificial
  Chemically synthesized
ucguccaugucgcucucg

SEQ ID NO: 16225 - RNA, 18 nt, artificial
  Chemically synthesized
cguggauggcauucggag

SEQ ID NO: 16226 - RNA, 18 nt, artificial
  Chemically synthesized
gcuuuucucuuccuagug

SEQ ID NO: 16227 - RNA, 18 nt, artificial
  Chemically synthesized
aaacuggagaguuuucaa

SEQ ID NO: 16228 - RNA, 18 nt, artificial
  Chemically synthesized
guggauggcauucggagg

SEQ ID NO: 16229 - RNA, 18 nt, artificial
  Chemically synthesized
gaucccgacgccuuuucu

SEQ ID NO: 16230 - RNA, 18 nt, artificial
  Chemically synthesized
gaguuuucaaguuggcau

SEQ ID NO: 16231 - RNA, 18 nt, artificial
  Chemically synthesized
agccgcgguggcugcugc

SEQ ID NO: 16232 - RNA, 18 nt, artificial
  Chemically synthesized
aagaaggcaaacuaagau

SEQ ID NO: 16233 - RNA, 18 nt, artificial
  Chemically synthesized
acccgcagcggauccgag

SEQ ID NO: 16234 - RNA, 18 nt, artificial
  Chemically synthesized
gugacaagaauagauguu

SEQ ID NO: 16235 - RNA, 18 nt, artificial
  Chemically synthesized
acacaagccgcacccgca

SEQ ID NO: 16236 - RNA, 18 nt, artificial
  Chemically synthesized
cuuccacggagcucaggu

SEQ ID NO: 16237 - RNA, 18 nt, artificial
  Chemically synthesized
ggacauucaguuacuauu

SEQ ID NO: 16238 - RNA, 18 nt, artificial
  Chemically synthesized
uucaucaccuccagaaau

SEQ ID NO: 16239 - RNA, 18 nt, artificial
  Chemically synthesized
ucacucucucucuauaua

SEQ ID NO: 16240 - RNA, 18 nt, artificial
  Chemically synthesized
gaggucgucuccucgcag

SEQ ID NO: 16241 - RNA, 18 nt, artificial
  Chemically synthesized
caggaggcacuucugaag

SEQ ID NO: 16242 - RNA, 18 nt, artificial
  Chemically synthesized
cgcagcacccugacgccc

SEQ ID NO: 16243 - RNA, 18 nt, artificial
  Chemically synthesized
aaaugucugcagccuauu

SEQ ID NO: 16244 - RNA, 18 nt, artificial
  Chemically synthesized
uacugaugcacugcugga

SEQ ID NO: 16245 - RNA, 18 nt, artificial
  Chemically synthesized
uguacaaagaaggcaaac

SEQ ID NO: 16246 - RNA, 18 nt, artificial
  Chemically synthesized
caacugcucauaggugca

SEQ ID NO: 16247 - RNA, 18 nt, artificial
  Chemically synthesized
aagugcugagaugagaca

SEQ ID NO: 16248 - RNA, 18 nt, artificial
  Chemically synthesized
cugugugcagccgcggug

SEQ ID NO: 16249 - RNA, 18 nt, artificial
  Chemically synthesized
augucaguuaccgagcug

SEQ ID NO: 16250 - RNA, 18 nt, artificial
  Chemically synthesized
aaacacgacucucucacu

SEQ ID NO: 16251 - RNA, 18 nt, artificial
  Chemically synthesized
gcagcacccugacgcccg

SEQ ID NO: 16252 - RNA, 18 nt, artificial
  Chemically synthesized
aguuacuauugcaagaag

SEQ ID NO: 16253 - RNA, 18 nt, artificial
  Chemically synthesized
caagaauagauguugcau

SEQ ID NO: 16254 - RNA, 18 nt, artificial
  Chemically synthesized
acacgacucucucacucu

SEQ ID NO: 16255 - RNA, 18 nt, artificial
  Chemically synthesized
acuuacgaaacacgacuc

SEQ ID NO: 16256 - RNA, 18 nt, artificial
  Chemically synthesized
gaucaaaugcaaucacua

SEQ ID NO: 16257 - RNA, 18 nt, artificial
  Chemically synthesized
cauagcacuaguuuaggc

SEQ ID NO: 16258 - RNA, 18 nt, artificial
  Chemically synthesized
uggagagagguggcacgc

SEQ ID NO: 16259 - RNA, 18 nt, artificial
  Chemically synthesized
ugguaacaagugugaagu

SEQ ID NO: 16260 - RNA, 18 nt, artificial
  Chemically synthesized
gaggcacuucugaaguug

SEQ ID NO: 16261 - RNA, 18 nt, artificial
  Chemically synthesized
ucccggcgaagaccgcgc

SEQ ID NO: 16262 - RNA, 18 nt, artificial
  Chemically synthesized
caagagagagguggagag

SEQ ID NO: 16263 - RNA, 18 nt, artificial
  Chemically synthesized
cuagaucuuucaacuuga

SEQ ID NO: 16264 - RNA, 18 nt, artificial
  Chemically synthesized
acucucacgugcuugauu

SEQ ID NO: 16265 - RNA, 18 nt, artificial
  Chemically synthesized
uccacacaguagagaaau

SEQ ID NO: 16266 - RNA, 18 nt, artificial
  Chemically synthesized
acuucugucccuuuccuu

SEQ ID NO: 16267 - RNA, 18 nt, artificial
  Chemically synthesized
aacuccuacaaacuggag

SEQ ID NO: 16268 - RNA, 18 nt, artificial
  Chemically synthesized
agagagguggagagaggu

SEQ ID NO: 16269 - RNA, 18 nt, artificial
  Chemically synthesized
gaauacucuucucuggca

SEQ ID NO: 16270 - RNA, 18 nt, artificial
  Chemically synthesized
uguuaggcacucucggaa

SEQ ID NO: 16271 - RNA, 18 nt, artificial
  Chemically synthesized
gguuuuaagcugacucug

SEQ ID NO: 16272 - RNA, 18 nt, artificial
  Chemically synthesized
gcggcucuuucccacgcc

SEQ ID NO: 16273 - RNA, 18 nt, artificial
  Chemically synthesized
uuaggcacucucggaauc

SEQ ID NO: 16274 - RNA, 18 nt, artificial
  Chemically synthesized
guuuauauaaagcagcac

SEQ ID NO: 16275 - RNA, 18 nt, artificial
  Chemically synthesized
aacugcucauaggugcac

SEQ ID NO: 16276 - RNA, 18 nt, artificial
  Chemically synthesized
cauggaggccguugggcu

SEQ ID NO: 16277 - RNA, 18 nt, artificial
  Chemically synthesized
ccgugaggagagcagagc

SEQ ID NO: 16278 - RNA, 18 nt, artificial
  Chemically synthesized
gggcugaauccgcauggg

SEQ ID NO: 16279 - RNA, 18 nt, artificial
  Chemically synthesized
aaucuaaucacagagcua

SEQ ID NO: 16280 - RNA, 18 nt, artificial
  Chemically synthesized
agaguuuucaaguuggca

SEQ ID NO: 16281 - RNA, 18 nt, artificial
  Chemically synthesized
cuaagcucaggcacuuac

SEQ ID NO: 16282 - RNA, 18 nt, artificial
  Chemically synthesized
gugcagagguuuuaagcu

SEQ ID NO: 16283 - RNA, 18 nt, artificial
  Chemically synthesized
acgacucucucacucucu

SEQ ID NO: 16284 - RNA, 18 nt, artificial
  Chemically synthesized
agguaccgcgcaacuucu

SEQ ID NO: 16285 - RNA, 18 nt, artificial
  Chemically synthesized
uuaggagaaaaugaagag

SEQ ID NO: 16286 - RNA, 18 nt, artificial
  Chemically synthesized
guugggcuggagcagggc

SEQ ID NO: 16287 - RNA, 18 nt, artificial
  Chemically synthesized
ccucugguggacacaugg

SEQ ID NO: 16288 - RNA, 18 nt, artificial
  Chemically synthesized
gagaauucagucagggca

SEQ ID NO: 16289 - RNA, 18 nt, artificial
  Chemically synthesized
ugauggcuguggccgcgg

SEQ ID NO: 16290 - RNA, 18 nt, artificial
  Chemically synthesized
cuucaucccggcgaagac

SEQ ID NO: 16291 - RNA, 18 nt, artificial
  Chemically synthesized
agggcugcgggcaggugg

SEQ ID NO: 16292 - RNA, 18 nt, artificial
  Chemically synthesized
cuuccuaagcucaggcac

SEQ ID NO: 16293 - RNA, 18 nt, artificial
  Chemically synthesized
aggaguccaggccuucca

SEQ ID NO: 16294 - RNA, 18 nt, artificial
  Chemically synthesized
cccauuacauagcacuag

SEQ ID NO: 16295 - RNA, 18 nt, artificial
  Chemically synthesized
agcggauccgaggagucc

SEQ ID NO: 16296 - RNA, 18 nt, artificial
  Chemically synthesized
aaagaaggcaaacuaaga

SEQ ID NO: 16297 - RNA, 18 nt, artificial
  Chemically synthesized
ugcuuguuaaucugagaa

SEQ ID NO: 16298 - RNA, 18 nt, artificial
  Chemically synthesized
gagagagguggagagagg

SEQ ID NO: 16299 - RNA, 18 nt, artificial
  Chemically synthesized
cacugcuggucugcugag

SEQ ID NO: 16300 - RNA, 18 nt, artificial
  Chemically synthesized
acuucucccaaaggguga

SEQ ID NO: 16301 - RNA, 18 nt, artificial
  Chemically synthesized
aucuagucucaagagaau

SEQ ID NO: 16302 - RNA, 18 nt, artificial
  Chemically synthesized
ccgcgcaacuucuguuag

SEQ ID NO: 16303 - RNA, 18 nt, artificial
  Chemically synthesized
ggucugcuccuagcggcu

SEQ ID NO: 16304 - RNA, 18 nt, artificial
  Chemically synthesized
uaugcucaugaaguccau

SEQ ID NO: 16305 - RNA, 18 nt, artificial
  Chemically synthesized
cgaaggacagagggaagc

SEQ ID NO: 16306 - RNA, 18 nt, artificial
  Chemically synthesized
aagccgcacccgcagcgg

SEQ ID NO: 16307 - RNA, 18 nt, artificial
  Chemically synthesized
ucgucuucccuugugcaa

SEQ ID NO: 16308 - RNA, 18 nt, artificial
  Chemically synthesized
ggccuuccacggagcuca

SEQ ID NO: 16309 - RNA, 18 nt, artificial
  Chemically synthesized
cugcuggucugcugagga

SEQ ID NO: 16310 - RNA, 18 nt, artificial
  Chemically synthesized
agagccgugggcaggagg

SEQ ID NO: 16311 - RNA, 18 nt, artificial
  Chemically synthesized
agagcagaaaugcuuguu

SEQ ID NO: 16312 - RNA, 18 nt, artificial
  Chemically synthesized
uugacucugaggcaugga

SEQ ID NO: 16313 - RNA, 18 nt, artificial
  Chemically synthesized
gcugacucugaaauggag

SEQ ID NO: 16314 - RNA, 18 nt, artificial
  Chemically synthesized
caaagggugacaagaaua

SEQ ID NO: 16315 - RNA, 18 nt, artificial
  Chemically synthesized
uucucccaaagggugaca

SEQ ID NO: 16316 - RNA, 18 nt, artificial
  Chemically synthesized
ugagguuugugucucaaa

SEQ ID NO: 16317 - RNA, 18 nt, artificial
  Chemically synthesized
cacgccgcaacucugcuc

SEQ ID NO: 16318 - RNA, 18 nt, artificial
  Chemically synthesized
agcacccugacgcccgcc

SEQ ID NO: 16319 - RNA, 18 nt, artificial
  Chemically synthesized
uuggcaugucuguacaaa

SEQ ID NO: 16320 - RNA, 18 nt, artificial
  Chemically synthesized
gaugagacacaagccgca

SEQ ID NO: 16321 - RNA, 18 nt, artificial
  Chemically synthesized
ccuguugccugaagcauc

SEQ ID NO: 16322 - RNA, 18 nt, artificial
  Chemically synthesized
agagcagagccgugggca

SEQ ID NO: 16323 - RNA, 18 nt, artificial
  Chemically synthesized
gaauaccacauuuccacu

SEQ ID NO: 16324 - RNA, 18 nt, artificial
  Chemically synthesized
caggcagagcagaaaugc

SEQ ID NO: 16325 - RNA, 18 nt, artificial
  Chemically synthesized
ccguugggcuggagcagg

SEQ ID NO: 16326 - RNA, 18 nt, artificial
  Chemically synthesized
agagguuuuaagcugacu

SEQ ID NO: 16327 - RNA, 18 nt, artificial
  Chemically synthesized
gugcauaauacaugcugu

SEQ ID NO: 16328 - RNA, 18 nt, artificial
  Chemically synthesized
aaccuguugguuucagca

SEQ ID NO: 16329 - RNA, 18 nt, artificial
  Chemically synthesized
cgcgcaacuucuguuagg

SEQ ID NO: 16330 - RNA, 18 nt, artificial
  Chemically synthesized
caucauuaggagaaaaug

SEQ ID NO: 16331 - RNA, 18 nt, artificial
  Chemically synthesized
uuuuaagcugacucugaa

SEQ ID NO: 16332 - RNA, 18 nt, artificial
  Chemically synthesized
aacacgacucucucacuc

SEQ ID NO: 16333 - RNA, 18 nt, artificial
  Chemically synthesized
ugguaggcaacugcucau

SEQ ID NO: 16334 - RNA, 18 nt, artificial
  Chemically synthesized
cacccugacgcccgccuc

SEQ ID NO: 16335 - RNA, 18 nt, artificial
  Chemically synthesized
aacuucuguuaggcacuc

SEQ ID NO: 16336 - RNA, 18 nt, artificial
  Chemically synthesized
gcuggagcagggcugcgg

SEQ ID NO: 16337 - RNA, 18 nt, artificial
  Chemically synthesized
cuucugaaguuguggaga

SEQ ID NO: 16338 - RNA, 18 nt, artificial
  Chemically synthesized
uuccuaagcucaggcacu

SEQ ID NO: 16339 - RNA, 18 nt, artificial
  Chemically synthesized
caaacaaaaaagggagag

SEQ ID NO: 16340 - RNA, 18 nt, artificial
  Chemically synthesized
agggcgggcugauggcug

SEQ ID NO: 16341 - RNA, 18 nt, artificial
  Chemically synthesized
ggcaaacuaagauaaaac

SEQ ID NO: 16342 - RNA, 18 nt, artificial
  Chemically synthesized
gugcugagaugagacaca

SEQ ID NO: 16343 - RNA, 18 nt, artificial
  Chemically synthesized
uuuuccaggaaacuucua

SEQ ID NO: 16344 - RNA, 18 nt, artificial
  Chemically synthesized
cucauaggugcacuauau

SEQ ID NO: 16345 - RNA, 18 nt, artificial
  Chemically synthesized
ugugcagccgcgguggcu

SEQ ID NO: 16346 - RNA, 18 nt, artificial
  Chemically synthesized
gagagggacaagagagag

SEQ ID NO: 16347 - RNA, 18 nt, artificial
  Chemically synthesized
uaaagcagcaccauauuu

SEQ ID NO: 16348 - RNA, 18 nt, artificial
  Chemically synthesized
ccaucuagucucaagaga

SEQ ID NO: 16349 - RNA, 18 nt, artificial
  Chemically synthesized
augcggguggagcggaug

SEQ ID NO: 16350 - RNA, 18 nt, artificial
  Chemically synthesized
gaaggacagagggaagcu

SEQ ID NO: 16351 - RNA, 18 nt, artificial
  Chemically synthesized
uccaggccuuccacggag

SEQ ID NO: 16352 - RNA, 18 nt, artificial
  Chemically synthesized
caagccgcacccgcagcg

SEQ ID NO: 16353 - RNA, 18 nt, artificial
  Chemically synthesized
gaggaguccaggccuucc

SEQ ID NO: 16354 - RNA, 18 nt, artificial
  Chemically synthesized
cguugggcuggagcaggg

SEQ ID NO: 16355 - RNA, 18 nt, artificial
  Chemically synthesized
aggaugucauggccgccg

SEQ ID NO: 16356 - RNA, 18 nt, artificial
  Chemically synthesized
gggaagcugugugcagcc

SEQ ID NO: 16357 - RNA, 18 nt, artificial
  Chemically synthesized
ugcaaucacuaacuugac

SEQ ID NO: 16358 - RNA, 18 nt, artificial
  Chemically synthesized
ccuuuccuuucuuaaccu

SEQ ID NO: 16359 - RNA, 18 nt, artificial
  Chemically synthesized
gagcugccuugaaccaaa

SEQ ID NO: 16360 - RNA, 18 nt, artificial
  Chemically synthesized
acucugcucggccgcaag

SEQ ID NO: 16361 - RNA, 18 nt, artificial
  Chemically synthesized
agcugugugcagccgcgg

SEQ ID NO: 16362 - RNA, 18 nt, artificial
  Chemically synthesized
gucugcuccuagcggcuc

SEQ ID NO: 16363 - RNA, 18 nt, artificial
  Chemically synthesized
guccauggcaagagcgug

SEQ ID NO: 16364 - RNA, 18 nt, artificial
  Chemically synthesized
ugcagccgcgguggcugc

SEQ ID NO: 16365 - RNA, 18 nt, artificial
  Chemically synthesized
uggguggcgcaagugcug

SEQ ID NO: 16366 - RNA, 18 nt, artificial
  Chemically synthesized
cggcguggacgguggcag

SEQ ID NO: 16367 - RNA, 18 nt, artificial
  Chemically synthesized
gagaguuuucaaguuggc

SEQ ID NO: 16368 - RNA, 18 nt, artificial
  Chemically synthesized
uuaaaaugucugcagccu

SEQ ID NO: 16369 - RNA, 18 nt, artificial
  Chemically synthesized
ugucccaucuagucucaa

SEQ ID NO: 16370 - RNA, 18 nt, artificial
  Chemically synthesized
auccacugucauuugcaa

SEQ ID NO: 16371 - RNA, 18 nt, artificial
  Chemically synthesized
caaaaaagacuagguaca

SEQ ID NO: 16372 - RNA, 18 nt, artificial
  Chemically synthesized
cggagcucagguaccgcg

SEQ ID NO: 16373 - RNA, 18 nt, artificial
  Chemically synthesized
cagccuauugcaagacuu

SEQ ID NO: 16374 - RNA, 18 nt, artificial
  Chemically synthesized
ugcuaaaugucaccucuu

SEQ ID NO: 16375 - RNA, 18 nt, artificial
  Chemically synthesized
aacucucacgugcuugau

SEQ ID NO: 16376 - RNA, 18 nt, artificial
  Chemically synthesized
gccuauugcaagacuucu

SEQ ID NO: 16377 - RNA, 18 nt, artificial
  Chemically synthesized
ucggccgcaagagccggc

SEQ ID NO: 16378 - RNA, 18 nt, artificial
  Chemically synthesized
uggaugguacgguccaua

SEQ ID NO: 16379 - RNA, 18 nt, artificial
  Chemically synthesized
cuuugcagauccuuguuu

SEQ ID NO: 16380 - RNA, 18 nt, artificial
  Chemically synthesized
guccaugucgcucucgga

SEQ ID NO: 16381 - RNA, 18 nt, artificial
  Chemically synthesized
acacaguagagaaaugaa

SEQ ID NO: 16382 - RNA, 18 nt, artificial
  Chemically synthesized
gcaguuggcacaagucuu

SEQ ID NO: 16383 - RNA, 18 nt, artificial
  Chemically synthesized
gagcgugugcgucaaagu

SEQ ID NO: 16384 - RNA, 18 nt, artificial
  Chemically synthesized
gagggaagcugugugcag

SEQ ID NO: 16385 - RNA, 18 nt, artificial
  Chemically synthesized
cacuuacgaaacacgacu

SEQ ID NO: 16386 - RNA, 18 nt, artificial
  Chemically synthesized
aaaaagacuagguacagu

SEQ ID NO: 16387 - RNA, 18 nt, artificial
  Chemically synthesized
uagccucugguggacaca

SEQ ID NO: 16388 - RNA, 18 nt, artificial
  Chemically synthesized
caaucacuaacuugacaa

SEQ ID NO: 16389 - RNA, 18 nt, artificial
  Chemically synthesized
cauuuuaauaccaugcca

SEQ ID NO: 16390 - RNA, 18 nt, artificial
  Chemically synthesized
ucccuuuuuuguuugguu

SEQ ID NO: 16391 - RNA, 18 nt, artificial
  Chemically synthesized
aagcucuuugucaaguua

SEQ ID NO: 16392 - RNA, 18 nt, artificial
  Chemically synthesized
cgugccaccucucuccac

SEQ ID NO: 16393 - RNA, 18 nt, artificial
  Chemically synthesized
uggaucauuugaagaugc

SEQ ID NO: 16394 - RNA, 18 nt, artificial
  Chemically synthesized
acuucagaagugccuccu

SEQ ID NO: 16395 - RNA, 18 nt, artificial
  Chemically synthesized
gcuuaggaaguuuucuuc

SEQ ID NO: 16396 - RNA, 18 nt, artificial
  Chemically synthesized
ucuugucacccuuuggga

SEQ ID NO: 16397 - RNA, 18 nt, artificial
  Chemically synthesized
ugccugagcuuaggaagu

SEQ ID NO: 16398 - RNA, 18 nt, artificial
  Chemically synthesized
aagguagccauacagaug

SEQ ID NO: 16399 - RNA, 18 nt, artificial
  Chemically synthesized
cugcgugccaccucucuc

SEQ ID NO: 16400 - RNA, 18 nt, artificial
  Chemically synthesized
gaaaaggcgucgggaucg

SEQ ID NO: 16401 - RNA, 18 nt, artificial
  Chemically synthesized
aaaaugcccugacugaau

SEQ ID NO: 16402 - RNA, 18 nt, artificial
  Chemically synthesized
auggacgagaccaucgac

SEQ ID NO: 16403 - RNA, 18 nt, artificial
  Chemically synthesized
ucuuugucaaguuaguga

SEQ ID NO: 16404 - RNA, 18 nt, artificial
  Chemically synthesized
agcauuucugcucugccu

SEQ ID NO: 16405 - RNA, 18 nt, artificial
  Chemically synthesized
acuagugcuauguaaugg

SEQ ID NO: 16406 - RNA, 18 nt, artificial
  Chemically synthesized
uuuagcagugcauuggua

SEQ ID NO: 16407 - RNA, 18 nt, artificial
  Chemically synthesized
accucugcacccugaagg

SEQ ID NO: 16408 - RNA, 18 nt, artificial
  Chemically synthesized
acaucuauucuugucacc

SEQ ID NO: 16409 - RNA, 18 nt, artificial
  Chemically synthesized
uacauuucuggaggugau

SEQ ID NO: 16410 - RNA, 18 nt, artificial
  Chemically synthesized
cuggucaaaaugacugcu

SEQ ID NO: 16411 - RNA, 18 nt, artificial
  Chemically synthesized
uagccauacagaugccga

SEQ ID NO: 16412 - RNA, 18 nt, artificial
  Chemically synthesized
aacuagugcuauguaaug

SEQ ID NO: 16413 - RNA, 18 nt, artificial
  Chemically synthesized
augacauccuccauggcc

SEQ ID NO: 16414 - RNA, 18 nt, artificial
  Chemically synthesized
gccaccucucuccaccuc

SEQ ID NO: 16415 - RNA, 18 nt, artificial
  Chemically synthesized
acagaaguuggagcuuuu

SEQ ID NO: 16416 - RNA, 18 nt, artificial
  Chemically synthesized
aauguaugcaaugggaug

SEQ ID NO: 16417 - RNA, 18 nt, artificial
  Chemically synthesized
cuuaaaaccucugcaccc

SEQ ID NO: 16418 - RNA, 18 nt, artificial
  Chemically synthesized
aaauuacuguaccuaguc

SEQ ID NO: 16419 - RNA, 18 nt, artificial
  Chemically synthesized
gugccaccucucuccacc

SEQ ID NO: 16420 - RNA, 18 nt, artificial
  Chemically synthesized
acagacaugccaagaggu

SEQ ID NO: 16421 - RNA, 18 nt, artificial
  Chemically synthesized
cuccauggcccaccacca

SEQ ID NO: 16422 - RNA, 18 nt, artificial
  Chemically synthesized
auacagaugccgacagau

SEQ ID NO: 16423 - RNA, 18 nt, artificial
  Chemically synthesized
acacagcuucccucuguc

SEQ ID NO: 16424 - RNA, 18 nt, artificial
  Chemically synthesized
auauugcaaaugacagug

SEQ ID NO: 16425 - RNA, 18 nt, artificial
  Chemically synthesized
guguggaggauagguuaa

SEQ ID NO: 16426 - RNA, 18 nt, artificial
  Chemically synthesized
uaccauccagcagugcau

SEQ ID NO: 16427 - RNA, 18 nt, artificial
  Chemically synthesized
aguuacauuucuggaggu

SEQ ID NO: 16428 - RNA, 18 nt, artificial
  Chemically synthesized
ucucucccuuuuuuguuu

SEQ ID NO: 16429 - RNA, 18 nt, artificial
  Chemically synthesized
cgagaccaucgacguggg

SEQ ID NO: 16430 - RNA, 18 nt, artificial
  Chemically synthesized
caagcauuucugcucugc

SEQ ID NO: 16431 - RNA, 18 nt, artificial
  Chemically synthesized
uuaacaagcauuucugcu

SEQ ID NO: 16432 - RNA, 18 nt, artificial
  Chemically synthesized
uuuucuaugcaagagucu

SEQ ID NO: 16433 - RNA, 18 nt, artificial
  Chemically synthesized
gacauuuuaauaccaugc

SEQ ID NO: 16434 - RNA, 18 nt, artificial
  Chemically synthesized
uaccauuuagaaguuucc

SEQ ID NO: 16435 - RNA, 18 nt, artificial
  Chemically synthesized
caugacauccuccauggc

SEQ ID NO: 16436 - RNA, 18 nt, artificial
  Chemically synthesized
cccugcgugccaccucuc

SEQ ID NO: 16437 - RNA, 18 nt, artificial
  Chemically synthesized
ugaaaacuucacacuugu

SEQ ID NO: 16438 - RNA, 18 nt, artificial
  Chemically synthesized
aaaugcccugacugaauu

SEQ ID NO: 16439 - RNA, 18 nt, artificial
  Chemically synthesized
cacagcuucccucugucc

SEQ ID NO: 16440 - RNA, 18 nt, artificial
  Chemically synthesized
uaacugaauguccuccau

SEQ ID NO: 16441 - RNA, 18 nt, artificial
  Chemically synthesized
uugaacuucuugcaauag

SEQ ID NO: 16442 - RNA, 18 nt, artificial
  Chemically synthesized
uaacaagcauuucugcuc

SEQ ID NO: 16443 - RNA, 18 nt, artificial
  Chemically synthesized
ugaagcaaggagggagca

SEQ ID NO: 16444 - RNA, 18 nt, artificial
  Chemically synthesized
uuaugcacuucauuucuc

SEQ ID NO: 16445 - RNA, 18 nt, artificial
  Chemically synthesized
uaaagcucuuugucaagu

SEQ ID NO: 16446 - RNA, 18 nt, artificial
  Chemically synthesized
aaaccucugcacccugaa

SEQ ID NO: 16447 - RNA, 18 nt, artificial
  Chemically synthesized
auagugcaccuaugagca

SEQ ID NO: 16448 - RNA, 18 nt, artificial
  Chemically synthesized
uuacuguaccuagucuuu

SEQ ID NO: 16449 - RNA, 18 nt, artificial
  Chemically synthesized
cagaugccgacagaucca

SEQ ID NO: 16450 - RNA, 18 nt, artificial
  Chemically synthesized
uugagacacaaaccucac

SEQ ID NO: 16451 - RNA, 18 nt, artificial
  Chemically synthesized
caccucucuccaccucuc

SEQ ID NO: 16452 - RNA, 18 nt, artificial
  Chemically synthesized
acaaaggaacaauaaagc

SEQ ID NO: 16453 - RNA, 18 nt, artificial
  Chemically synthesized
uugcauuacuuuguaacc

SEQ ID NO: 16454 - RNA, 18 nt, artificial
  Chemically synthesized
uagugcaccuaugagcag

SEQ ID NO: 16455 - RNA, 18 nt, artificial
  Chemically synthesized
uacagaugccgacagauc

SEQ ID NO: 16456 - RNA, 18 nt, artificial
  Chemically synthesized
aagcauuucugcucugcc

SEQ ID NO: 16457 - RNA, 18 nt, artificial
  Chemically synthesized
cuuuugaaaacuucacac

SEQ ID NO: 16458 - RNA, 18 nt, artificial
  Chemically synthesized
aagaaagaaaaggagagg

SEQ ID NO: 16459 - RNA, 18 nt, artificial
  Chemically synthesized
ugagcuuaggaaguuuuc

SEQ ID NO: 16460 - RNA, 18 nt, artificial
  Chemically synthesized
auggcucaaaauauggug

SEQ ID NO: 16461 - RNA, 18 nt, artificial
  Chemically synthesized
uucaugccaacuugaaaa

SEQ ID NO: 16462 - RNA, 18 nt, artificial
  Chemically synthesized
uauauagugcaccuauga

SEQ ID NO: 16463 - RNA, 18 nt, artificial
  Chemically synthesized
gguagccauacagaugcc

SEQ ID NO: 16464 - RNA, 18 nt, artificial
  Chemically synthesized
uacagacaugccaagagg

SEQ ID NO: 16465 - RNA, 18 nt, artificial
  Chemically synthesized
uucucucccuuuuuuguu

SEQ ID NO: 16466 - RNA, 18 nt, artificial
  Chemically synthesized
uuucuggaggugaugaag

SEQ ID NO: 16467 - RNA, 18 nt, artificial
  Chemically synthesized
uggcucaaaauauggugc

SEQ ID NO: 16468 - RNA, 18 nt, artificial
  Chemically synthesized
uugaaaacuucacacuug

SEQ ID NO: 16469 - RNA, 18 nt, artificial
  Chemically synthesized
uugaaaaacaaggaucug

SEQ ID NO: 16470 - RNA, 18 nt, artificial
  Chemically synthesized
uaaaaugcccugacugaa

SEQ ID NO: 16471 - RNA, 18 nt, artificial
  Chemically synthesized
uucagaagugccuccugc

SEQ ID NO: 16472 - RNA, 18 nt, artificial
  Chemically synthesized
cauggcccaccaccauca

SEQ ID NO: 16473 - RNA, 18 nt, artificial
  Chemically synthesized
aaguuacauuucuggagg

SEQ ID NO: 16474 - RNA, 18 nt, artificial
  Chemically synthesized
gucagcuuaaaaccucug

SEQ ID NO: 16475 - RNA, 18 nt, artificial
  Chemically synthesized
auaugcugaaaucaagca

SEQ ID NO: 16476 - RNA, 18 nt, artificial
  Chemically synthesized
acaugccaagaggugaca

SEQ ID NO: 16477 - RNA, 18 nt, artificial
  Chemically synthesized
auuucugcucugccugca

SEQ ID NO: 16478 - RNA, 18 nt, artificial
  Chemically synthesized
gacauccuccauggccca

SEQ ID NO: 16479 - RNA, 18 nt, artificial
  Chemically synthesized
acaagcauuucugcucug

SEQ ID NO: 16480 - RNA, 18 nt, artificial
  Chemically synthesized
uuaggaaguuuucuucug

SEQ ID NO: 16481 - RNA, 18 nt, artificial
  Chemically synthesized
cuucccucuguccuucgc

SEQ ID NO: 16482 - RNA, 18 nt, artificial
  Chemically synthesized
auucuugucacccuuugg

SEQ ID NO: 16483 - RNA, 18 nt, artificial
  Chemically synthesized
ugccaccucucuccaccu

SEQ ID NO: 16484 - RNA, 18 nt, artificial
  Chemically synthesized
uaguaacugaauguccuc

SEQ ID NO: 16485 - RNA, 18 nt, artificial
  Chemically synthesized
uuuuucuaugcaagaguc

SEQ ID NO: 16486 - RNA, 18 nt, artificial
  Chemically synthesized
uccauggcccaccaccau

SEQ ID NO: 16487 - RNA, 18 nt, artificial
  Chemically synthesized
aaccucugcacccugaag

SEQ ID NO: 16488 - RNA, 18 nt, artificial
  Chemically synthesized
aaaccuuaccgacccugg

SEQ ID NO: 16489 - RNA, 18 nt, artificial
  Chemically synthesized
auuaacaagcauuucugc

SEQ ID NO: 16490 - RNA, 18 nt, artificial
  Chemically synthesized
acauccuccauggcccac

SEQ ID NO: 16491 - RNA, 18 nt, artificial
  Chemically synthesized
uuuuaauaccaugccaga

SEQ ID NO: 16492 - RNA, 18 nt, artificial
  Chemically synthesized
cugcacccugaagguagc

SEQ ID NO: 16493 - RNA, 18 nt, artificial
  Chemically synthesized
uauggcaagaaagaaaag

SEQ ID NO: 16494 - RNA, 18 nt, artificial
  Chemically synthesized
uccuccauggcccaccac

SEQ ID NO: 16495 - RNA, 18 nt, artificial
  Chemically synthesized
aaccuuaccgacccuggg

SEQ ID NO: 16496 - RNA, 18 nt, artificial
  Chemically synthesized
uauccucuucauuuucuc

SEQ ID NO: 16497 - RNA, 18 nt, artificial
  Chemically synthesized
uuaaaaccucugcacccu

SEQ ID NO: 16498 - RNA, 18 nt, artificial
  Chemically synthesized
ucaugccaacuugaaaac

SEQ ID NO: 16499 - RNA, 18 nt, artificial
  Chemically synthesized
auccuccauggcccacca

SEQ ID NO: 16500 - RNA, 18 nt, artificial
  Chemically synthesized
ucucccuuuuuuguuugg

SEQ ID NO: 16501 - RNA, 18 nt, artificial
  Chemically synthesized
uaaaccuuaccgacccug

SEQ ID NO: 16502 - RNA, 18 nt, artificial
  Chemically synthesized
uuaaagcucuuugucaag

SEQ ID NO: 16503 - RNA, 18 nt, artificial
  Chemically synthesized
auccucuucauuuucucc

SEQ ID NO: 16504 - RNA, 18 nt, artificial
  Chemically synthesized
auaaaccuuaccgacccu

SEQ ID NO: 16505 - RNA, 18 nt, artificial
  Chemically synthesized
uggcaugguauuaaaaug

SEQ ID NO: 16506 - RNA, 18 nt, artificial
  Chemically synthesized
aaccaaacaaaaaaggga

SEQ ID NO: 16507 - RNA, 18 nt, artificial
  Chemically synthesized
uaacuugacaaagagcuu

SEQ ID NO: 16508 - RNA, 18 nt, artificial
  Chemically synthesized
guggagagagguggcacg

SEQ ID NO: 16509 - RNA, 18 nt, artificial
  Chemically synthesized
gcaucuucaaaugaucca

SEQ ID NO: 16510 - RNA, 18 nt, artificial
  Chemically synthesized
aggaggcacuucugaagu

SEQ ID NO: 16511 - RNA, 18 nt, artificial
  Chemically synthesized
gaagaaaacuuccuaagc

SEQ ID NO: 16512 - RNA, 18 nt, artificial
  Chemically synthesized
ucccaaagggugacaaga

SEQ ID NO: 16513 - RNA, 18 nt, artificial
  Chemically synthesized
acuuccuaagcucaggca

SEQ ID NO: 16514 - RNA, 18 nt, artificial
  Chemically synthesized
caucuguauggcuaccuu

SEQ ID NO: 16515 - RNA, 18 nt, artificial
  Chemically synthesized
gagagagguggcacgcag

SEQ ID NO: 16516 - RNA, 18 nt, artificial
  Chemically synthesized
cgaucccgacgccuuuuc

SEQ ID NO: 16517 - RNA, 18 nt, artificial
  Chemically synthesized
auucagucagggcauuuu

SEQ ID NO: 16518 - RNA, 18 nt, artificial
  Chemically synthesized
gucgauggucucguccau

SEQ ID NO: 16519 - RNA, 18 nt, artificial
  Chemically synthesized
ucacuaacuugacaaaga

SEQ ID NO: 16520 - RNA, 18 nt, artificial
  Chemically synthesized
aggcagagcagaaaugcu

SEQ ID NO: 16521 - RNA, 18 nt, artificial
  Chemically synthesized
ccauuacauagcacuagu

SEQ ID NO: 16522 - RNA, 18 nt, artificial
  Chemically synthesized
uaccaaugcacugcuaaa

SEQ ID NO: 16523 - RNA, 18 nt, artificial
  Chemically synthesized
ccuucagggugcagaggu

SEQ ID NO: 16524 - RNA, 18 nt, artificial
  Chemically synthesized
ggugacaagaauagaugu

SEQ ID NO: 16525 - RNA, 18 nt, artificial
  Chemically synthesized
aucaccuccagaaaugua

SEQ ID NO: 16526 - RNA, 18 nt, artificial
  Chemically synthesized
agcagucauuuugaccag

SEQ ID NO: 16527 - RNA, 18 nt, artificial
  Chemically synthesized
ucggcaucuguauggcua

SEQ ID NO: 16528 - RNA, 18 nt, artificial
  Chemically synthesized
cauuacauagcacuaguu

SEQ ID NO: 16529 - RNA, 18 nt, artificial
  Chemically synthesized
ggccauggaggaugucau

SEQ ID NO: 16530 - RNA, 18 nt, artificial
  Chemically synthesized
gagguggagagagguggc

SEQ ID NO: 16531 - RNA, 18 nt, artificial
  Chemically synthesized
aaaagcuccaacuucugu

SEQ ID NO: 16532 - RNA, 18 nt, artificial
  Chemically synthesized
caucccauugcauacauu

SEQ ID NO: 16533 - RNA, 18 nt, artificial
  Chemically synthesized
gggugcagagguuuuaag

SEQ ID NO: 16534 - RNA, 18 nt, artificial
  Chemically synthesized
gacuagguacaguaauuu

SEQ ID NO: 16535 - RNA, 18 nt, artificial
  Chemically synthesized
gguggagagagguggcac

SEQ ID NO: 16536 - RNA, 18 nt, artificial
  Chemically synthesized
accucuuggcaugucugu

SEQ ID NO: 16537 - RNA, 18 nt, artificial
  Chemically synthesized
ugguggugggccauggag

SEQ ID NO: 16538 - RNA, 18 nt, artificial
  Chemically synthesized
aucugucggcaucuguau

SEQ ID NO: 16539 - RNA, 18 nt, artificial
  Chemically synthesized
gacagagggaagcugugu

SEQ ID NO: 16540 - RNA, 18 nt, artificial
  Chemically synthesized
cacugucauuugcaauau

SEQ ID NO: 16541 - RNA, 18 nt, artificial
  Chemically synthesized
uuaaccuauccuccacac

SEQ ID NO: 16542 - RNA, 18 nt, artificial
  Chemically synthesized
augcacugcuggauggua

SEQ ID NO: 16543 - RNA, 18 nt, artificial
  Chemically synthesized
accuccagaaauguaacu

SEQ ID NO: 16544 - RNA, 18 nt, artificial
  Chemically synthesized
aaacaaaaaagggagaga

SEQ ID NO: 16545 - RNA, 18 nt, artificial
  Chemically synthesized
cccacgucgauggucucg

SEQ ID NO: 16546 - RNA, 18 nt, artificial
  Chemically synthesized
gcagagcagaaaugcuug

SEQ ID NO: 16547 - RNA, 18 nt, artificial
  Chemically synthesized
agcagaaaugcuuguuaa

SEQ ID NO: 16548 - RNA, 18 nt, artificial
  Chemically synthesized
agacucuugcauagaaaa

SEQ ID NO: 16549 - RNA, 18 nt, artificial
  Chemically synthesized
gcaugguauuaaaauguc

SEQ ID NO: 16550 - RNA, 18 nt, artificial
  Chemically synthesized
ggaaacuucuaaauggua

SEQ ID NO: 16551 - RNA, 18 nt, artificial
  Chemically synthesized
gccauggaggaugucaug

SEQ ID NO: 16552 - RNA, 18 nt, artificial
  Chemically synthesized
gagagguggcacgcaggg

SEQ ID NO: 16553 - RNA, 18 nt, artificial
  Chemically synthesized
acaagugugaaguuuuca

SEQ ID NO: 16554 - RNA, 18 nt, artificial
  Chemically synthesized
aauucagucagggcauuu

SEQ ID NO: 16555 - RNA, 18 nt, artificial
  Chemically synthesized
ggacagagggaagcugug

SEQ ID NO: 16556 - RNA, 18 nt, artificial
  Chemically synthesized
auggaggacauucaguua

SEQ ID NO: 16557 - RNA, 18 nt, artificial
  Chemically synthesized
cuauugcaagaaguucaa

SEQ ID NO: 16558 - RNA, 18 nt, artificial
  Chemically synthesized
gagcagaaaugcuuguua

SEQ ID NO: 16559 - RNA, 18 nt, artificial
  Chemically synthesized
ugcucccuccuugcuuca

SEQ ID NO: 16560 - RNA, 18 nt, artificial
  Chemically synthesized
gagaaaugaagugcauaa

SEQ ID NO: 16561 - RNA, 18 nt, artificial
  Chemically synthesized
acuugacaaagagcuuua

SEQ ID NO: 16562 - RNA, 18 nt, artificial
  Chemically synthesized
uucagggugcagagguuu

SEQ ID NO: 16563 - RNA, 18 nt, artificial
  Chemically synthesized
ugcucauaggugcacuau

SEQ ID NO: 16564 - RNA, 18 nt, artificial
  Chemically synthesized
aaagacuagguacaguaa

SEQ ID NO: 16565 - RNA, 18 nt, artificial
  Chemically synthesized
uggaucugucggcaucug

SEQ ID NO: 16566 - RNA, 18 nt, artificial
  Chemically synthesized
gugagguuugugucucaa

SEQ ID NO: 16567 - RNA, 18 nt, artificial
  Chemically synthesized
gagagguggagagaggug

SEQ ID NO: 16568 - RNA, 18 nt, artificial
  Chemically synthesized
gcuuuauuguuccuuugu

SEQ ID NO: 16569 - RNA, 18 nt, artificial
  Chemically synthesized
gguuacaaaguaaugcaa

SEQ ID NO: 16570 - RNA, 18 nt, artificial
  Chemically synthesized
cugcucauaggugcacua

SEQ ID NO: 16571 - RNA, 18 nt, artificial
  Chemically synthesized
gaucugucggcaucugua

SEQ ID NO: 16572 - RNA, 18 nt, artificial
  Chemically synthesized
ggcagagcagaaaugcuu

SEQ ID NO: 16573 - RNA, 18 nt, artificial
  Chemically synthesized
gugugaaguuuucaaaag

SEQ ID NO: 16574 - RNA, 18 nt, artificial
  Chemically synthesized
ccucuccuuuucuuucuu

SEQ ID NO: 16575 - RNA, 18 nt, artificial
  Chemically synthesized
gaaaacuuccuaagcuca

SEQ ID NO: 16576 - RNA, 18 nt, artificial
  Chemically synthesized
caccauauuuugagccau

SEQ ID NO: 16577 - RNA, 18 nt, artificial
  Chemically synthesized
uuuucaaguuggcaugaa

SEQ ID NO: 16578 - RNA, 18 nt, artificial
  Chemically synthesized
ucauaggugcacuauaua

SEQ ID NO: 16579 - RNA, 18 nt, artificial
  Chemically synthesized
ggcaucuguauggcuacc

SEQ ID NO: 16580 - RNA, 18 nt, artificial
  Chemically synthesized
ccucuuggcaugucugua

SEQ ID NO: 16581 - RNA, 18 nt, artificial
  Chemically synthesized
aacaaaaaagggagagaa

SEQ ID NO: 16582 - RNA, 18 nt, artificial
  Chemically synthesized
cuucaucaccuccagaaa

SEQ ID NO: 16583 - RNA, 18 nt, artificial
  Chemically synthesized
gcaccauauuuugagcca

SEQ ID NO: 16584 - RNA, 18 nt, artificial
  Chemically synthesized
caagugugaaguuuucaa

SEQ ID NO: 16585 - RNA, 18 nt, artificial
  Chemically synthesized
cagauccuuguuuuucaa

SEQ ID NO: 16586 - RNA, 18 nt, artificial
  Chemically synthesized
uucagucagggcauuuua

SEQ ID NO: 16587 - RNA, 18 nt, artificial
  Chemically synthesized
gcaggaggcacuucugaa

SEQ ID NO: 16588 - RNA, 18 nt, artificial
  Chemically synthesized
ugaugguggugggccaug

SEQ ID NO: 16589 - RNA, 18 nt, artificial
  Chemically synthesized
ccuccagaaauguaacuu

SEQ ID NO: 16590 - RNA, 18 nt, artificial
  Chemically synthesized
cagagguuuuaagcugac

SEQ ID NO: 16591 - RNA, 18 nt, artificial
  Chemically synthesized
ugcuugauuucagcauau

SEQ ID NO: 16592 - RNA, 18 nt, artificial
  Chemically synthesized
ugucaccucuuggcaugu

SEQ ID NO: 16593 - RNA, 18 nt, artificial
  Chemically synthesized
ugcaggcagagcagaaau

SEQ ID NO: 16594 - RNA, 18 nt, artificial
  Chemically synthesized
ugggccauggaggauguc

SEQ ID NO: 16595 - RNA, 18 nt, artificial
  Chemically synthesized
cagagcagaaaugcuugu

SEQ ID NO: 16596 - RNA, 18 nt, artificial
  Chemically synthesized
cagaagaaaacuuccuaa

SEQ ID NO: 16597 - RNA, 18 nt, artificial
  Chemically synthesized
gcgaaggacagagggaag

SEQ ID NO: 16598 - RNA, 18 nt, artificial
  Chemically synthesized
ccaaagggugacaagaau

SEQ ID NO: 16599 - RNA, 18 nt, artificial
  Chemically synthesized
agguggagagagguggca

SEQ ID NO: 16600 - RNA, 18 nt, artificial
  Chemically synthesized
gaggacauucaguuacua

SEQ ID NO: 16601 - RNA, 18 nt, artificial
  Chemically synthesized
gacucuugcauagaaaaa

SEQ ID NO: 16602 - RNA, 18 nt, artificial
  Chemically synthesized
augguggugggccaugga

SEQ ID NO: 16603 - RNA, 18 nt, artificial
  Chemically synthesized
cuucagggugcagagguu

SEQ ID NO: 16604 - RNA, 18 nt, artificial
  Chemically synthesized
ccagggucgguaagguuu

SEQ ID NO: 16605 - RNA, 18 nt, artificial
  Chemically synthesized
gcagaaaugcuuguuaau

SEQ ID NO: 16606 - RNA, 18 nt, artificial
  Chemically synthesized
gugggccauggaggaugu

SEQ ID NO: 16607 - RNA, 18 nt, artificial
  Chemically synthesized
ucuggcaugguauuaaaa

SEQ ID NO: 16608 - RNA, 18 nt, artificial
  Chemically synthesized
gcuaccuucagggugcag

SEQ ID NO: 16609 - RNA, 18 nt, artificial
  Chemically synthesized
cuuuucuuucuugccaua

SEQ ID NO: 16610 - RNA, 18 nt, artificial
  Chemically synthesized
guggugggccauggagga

SEQ ID NO: 16611 - RNA, 18 nt, artificial
  Chemically synthesized
cccagggucgguaagguu

SEQ ID NO: 16612 - RNA, 18 nt, artificial
  Chemically synthesized
gagaaaaugaagaggaua

SEQ ID NO: 16613 - RNA, 18 nt, artificial
  Chemically synthesized
agggugcagagguuuuaa

SEQ ID NO: 16614 - RNA, 18 nt, artificial
  Chemically synthesized
guuuucaaguuggcauga

SEQ ID NO: 16615 - RNA, 18 nt, artificial
  Chemically synthesized
uggugggccauggaggau

SEQ ID NO: 16616 - RNA, 18 nt, artificial
  Chemically synthesized
ccaaacaaaaaagggaga

SEQ ID NO: 16617 - RNA, 18 nt, artificial
  Chemically synthesized
cagggucgguaagguuua

SEQ ID NO: 16618 - RNA, 18 nt, artificial
  Chemically synthesized
cuugacaaagagcuuuaa

SEQ ID NO: 16619 - RNA, 18 nt, artificial
  Chemically synthesized
ggagaaaaugaagaggau

SEQ ID NO: 16620 - RNA, 18 nt, Artificial Sequence
  Chemically synthesized
agggucgguaagguuuau

SEQ ID NO: 16621 - RNA, 19 nt, artificial
  Chemically synthesized
ggauuaauuugcaucugaa

SEQ ID NO: 16622 - RNA, 19 nt, artificial
  Chemically synthesized
gaguguaguuuacagaaaa

SEQ ID NO: 16623 - RNA, 19 nt, artificial
  Chemically synthesized
ggugcagccacaaaacuua

SEQ ID NO: 16624 - RNA, 19 nt, artificial
  Chemically synthesized
ggcgcauccugccagaaca

SEQ ID NO: 16625 - RNA, 19 nt, artificial
  Chemically synthesized
caguugugcuccugaagaa

SEQ ID NO: 16626 - RNA, 19 nt, artificial
  Chemically synthesized
guuggagaagggaaguuga

SEQ ID NO: 16627 - RNA, 19 nt, artificial
  Chemically synthesized
ggagcuuccugaguggaga

SEQ ID NO: 16628 - RNA, 19 nt, artificial
  Chemically synthesized
ggagcauguguaacaucaa

SEQ ID NO: 16629 - RNA, 19 nt, artificial
  Chemically synthesized
agccuauggcagaaaaaau

SEQ ID NO: 16630 - RNA, 19 nt, artificial
  Chemically synthesized
agaguguaguuuacagaaa

SEQ ID NO: 16631 - RNA, 19 nt, artificial
  Chemically synthesized
gacccaacugcgagaucaa

SEQ ID NO: 16632 - RNA, 19 nt, artificial
  Chemically synthesized
ggcggguccaccaguuuga

SEQ ID NO: 16633 - RNA, 19 nt, artificial
  Chemically synthesized
ccgcaguugugcuccugaa

SEQ ID NO: 16634 - RNA, 19 nt, artificial
  Chemically synthesized
gcaucaugcaugucaaaca

SEQ ID NO: 16635 - RNA, 19 nt, artificial
  Chemically synthesized
ggcugcuggacgaguacaa

SEQ ID NO: 16636 - RNA, 19 nt, artificial
  Chemically synthesized
ggcagacccacacccagua

SEQ ID NO: 16637 - RNA, 19 nt, artificial
  Chemically synthesized
ggagcagauuuuugcaaua

SEQ ID NO: 16638 - RNA, 19 nt, artificial
  Chemically synthesized
agaagaugcuccagcaaca

SEQ ID NO: 16639 - RNA, 19 nt, artificial
  Chemically synthesized
ggaaacaagugaaagcaua

SEQ ID NO: 16640 - RNA, 19 nt, artificial
  Chemically synthesized
ggguggagugggaccaacu

SEQ ID NO: 16641 - RNA, 19 nt, artificial
  Chemically synthesized
ggcggcaccugcaaagaca

SEQ ID NO: 16642 - RNA, 19 nt, artificial
  Chemically synthesized
ccgcaagcccagcagcaaa

SEQ ID NO: 16643 - RNA, 19 nt, artificial
  Chemically synthesized
cggauuaauuugcaucuga

SEQ ID NO: 16644 - RNA, 19 nt, artificial
  Chemically synthesized
caagcaugcuugugaaaau

SEQ ID NO: 16645 - RNA, 19 nt, artificial
  Chemically synthesized
ggcgcaacugcgagaccga

SEQ ID NO: 16646 - RNA, 19 nt, artificial
  Chemically synthesized
aggagaagcugcauccaga

SEQ ID NO: 16647 - RNA, 19 nt, artificial
  Chemically synthesized
cacaaaacuuacagaugca

SEQ ID NO: 16648 - RNA, 19 nt, artificial
  Chemically synthesized
gggacaucacggaucauau

SEQ ID NO: 16649 - RNA, 19 nt, artificial
  Chemically synthesized
gagugugcguccaacccau

SEQ ID NO: 16650 - RNA, 19 nt, artificial
  Chemically synthesized
ggacccaacugcgagauca

SEQ ID NO: 16651 - RNA, 19 nt, artificial
  Chemically synthesized
gggauccacugugagaaca

SEQ ID NO: 16652 - RNA, 19 nt, artificial
  Chemically synthesized
gcagaaaaaaugucuguaa

SEQ ID NO: 16653 - RNA, 19 nt, artificial
  Chemically synthesized
gcuccaacugcgacaccaa

SEQ ID NO: 16654 - RNA, 19 nt, artificial
  Chemically synthesized
ggacgucagacuuggcuca

SEQ ID NO: 16655 - RNA, 19 nt, artificial
  Chemically synthesized
gcagcgagaacauugauga

SEQ ID NO: 16656 - RNA, 19 nt, artificial
  Chemically synthesized
cuuuguuucagguucagua

SEQ ID NO: 16657 - RNA, 19 nt, artificial
  Chemically synthesized
ggcaagcccugcaagaaug

SEQ ID NO: 16658 - RNA, 19 nt, artificial
  Chemically synthesized
guuucagguucaguauuau

SEQ ID NO: 16659 - RNA, 19 nt, artificial
  Chemically synthesized
gcgggauccacugugagaa

SEQ ID NO: 16660 - RNA, 19 nt, artificial
  Chemically synthesized
cucggaguguguaugccaa

SEQ ID NO: 16661 - RNA, 19 nt, artificial
  Chemically synthesized
agggcaagaagguccgcaa

SEQ ID NO: 16662 - RNA, 19 nt, artificial
  Chemically synthesized
agcaggugcagccacaaaa

SEQ ID NO: 16663 - RNA, 19 nt, artificial
  Chemically synthesized
uggacaagaucaaugaguu

SEQ ID NO: 16664 - RNA, 19 nt, artificial
  Chemically synthesized
ggagaagggaaguugaacg

SEQ ID NO: 16665 - RNA, 19 nt, artificial
  Chemically synthesized
gccaccacugcgagaccaa

SEQ ID NO: 16666 - RNA, 19 nt, artificial
  Chemically synthesized
gcgagaccaacaucaacga

SEQ ID NO: 16667 - RNA, 19 nt, artificial
  Chemically synthesized
gggagugcaggcaauccga

SEQ ID NO: 16668 - RNA, 19 nt, artificial
  Chemically synthesized
acaccaacguggucuucaa

SEQ ID NO: 16669 - RNA, 19 nt, artificial
  Chemically synthesized
ggcagaccugugaggucga

SEQ ID NO: 16670 - RNA, 19 nt, artificial
  Chemically synthesized
cgaagaagaugcuccagca

SEQ ID NO: 16671 - RNA, 19 nt, artificial
  Chemically synthesized
gagugugaauccaacccuu

SEQ ID NO: 16672 - RNA, 19 nt, artificial
  Chemically synthesized
ccaccaguuugaaugguca

SEQ ID NO: 16673 - RNA, 19 nt, artificial
  Chemically synthesized
ggcacauugagcugugcaa

SEQ ID NO: 16674 - RNA, 19 nt, artificial
  Chemically synthesized
ccgccuuugugcuucuguu

SEQ ID NO: 16675 - RNA, 19 nt, artificial
  Chemically synthesized
gcagcuacgagaccgccaa

SEQ ID NO: 16676 - RNA, 19 nt, artificial
  Chemically synthesized
gccgcgugcugcacaccaa

SEQ ID NO: 16677 - RNA, 19 nt, artificial
  Chemically synthesized
ggccuuugagacuggccca

SEQ ID NO: 16678 - RNA, 19 nt, artificial
  Chemically synthesized
ggagugggaccaacuguga

SEQ ID NO: 16679 - RNA, 19 nt, artificial
  Chemically synthesized
cccaagauguugauuuuua

SEQ ID NO: 16680 - RNA, 19 nt, artificial
  Chemically synthesized
ccuuugugcuucuguucuu

SEQ ID NO: 16681 - RNA, 19 nt, artificial
  Chemically synthesized
ggucaaugcgaguggcugu

SEQ ID NO: 16682 - RNA, 19 nt, artificial
  Chemically synthesized
gucaaugagugcaacagca

SEQ ID NO: 16683 - RNA, 19 nt, artificial
  Chemically synthesized
gcuggaaguacuucaguga

SEQ ID NO: 16684 - RNA, 19 nt, artificial
  Chemically synthesized
aguauagccuauggcagaa

SEQ ID NO: 16685 - RNA, 19 nt, artificial
  Chemically synthesized
cacugcgagaccaacauca

SEQ ID NO: 16686 - RNA, 19 nt, artificial
  Chemically synthesized
gaccuggagaccaagaagu

SEQ ID NO: 16687 - RNA, 19 nt, artificial
  Chemically synthesized
gugagaacaacacgccuga

SEQ ID NO: 16688 - RNA, 19 nt, artificial
  Chemically synthesized
gggaaguugaacgagcaua

SEQ ID NO: 16689 - RNA, 19 nt, artificial
  Chemically synthesized
gcgagaucgacgucaacga

SEQ ID NO: 16690 - RNA, 19 nt, artificial
  Chemically synthesized
gcgagaacauugaugacug

SEQ ID NO: 16691 - RNA, 19 nt, artificial
  Chemically synthesized
gugacaucaacaacaauga

SEQ ID NO: 16692 - RNA, 19 nt, artificial
  Chemically synthesized
gagaaaacaagcaaguucu

SEQ ID NO: 16693 - RNA, 19 nt, artificial
  Chemically synthesized
gugugugcacggaagggua

SEQ ID NO: 16694 - RNA, 19 nt, artificial
  Chemically synthesized
ggcaauccgaggacuauga

SEQ ID NO: 16695 - RNA, 19 nt, artificial
  Chemically synthesized
gcgccagccugcacaacca

SEQ ID NO: 16696 - RNA, 19 nt, artificial
  Chemically synthesized
ccaugguaccaaucaugaa

SEQ ID NO: 16697 - RNA, 19 nt, artificial
  Chemically synthesized
ccaacugugacaucaacaa

SEQ ID NO: 16698 - RNA, 19 nt, artificial
  Chemically synthesized
ggaccuggagaccaagaag

SEQ ID NO: 16699 - RNA, 19 nt, artificial
  Chemically synthesized
cgagaacauugaugacugu

SEQ ID NO: 16700 - RNA, 19 nt, artificial
  Chemically synthesized
gccaguacgauguggacga

SEQ ID NO: 16701 - RNA, 19 nt, artificial
  Chemically synthesized
ggcggugacugcucccuca

SEQ ID NO: 16702 - RNA, 19 nt, artificial
  Chemically synthesized
acugcgagaccaacaucaa

SEQ ID NO: 16703 - RNA, 19 nt, artificial
  Chemically synthesized
aggcaucaugcaugucaaa

SEQ ID NO: 16704 - RNA, 19 nt, artificial
  Chemically synthesized
gccuccuucuacugcgagu

SEQ ID NO: 16705 - RNA, 19 nt, artificial
  Chemically synthesized
ggugugcacugugagauca

SEQ ID NO: 16706 - RNA, 19 nt, artificial
  Chemically synthesized
gucccaagauguugauuuu

SEQ ID NO: 16707 - RNA, 19 nt, artificial
  Chemically synthesized
caacaacaaugagugugaa

SEQ ID NO: 16708 - RNA, 19 nt, artificial
  Chemically synthesized
caccaguuugaauggucaa

SEQ ID NO: 16709 - RNA, 19 nt, artificial
  Chemically synthesized
ucagguucaguauuaugua

SEQ ID NO: 16710 - RNA, 19 nt, artificial
  Chemically synthesized
gggugcugcugucccgcaa

SEQ ID NO: 16711 - RNA, 19 nt, artificial
  Chemically synthesized
gucccaacugccagaccaa

SEQ ID NO: 16712 - RNA, 19 nt, artificial
  Chemically synthesized
gccugcacaaccagacaga

SEQ ID NO: 16713 - RNA, 19 nt, artificial
  Chemically synthesized
gccuggacaagaucaauga

SEQ ID NO: 16714 - RNA, 19 nt, artificial
  Chemically synthesized
gccagaccaacaucaacga

SEQ ID NO: 16715 - RNA, 19 nt, artificial
  Chemically synthesized
cagccacaaaacuuacaga

SEQ ID NO: 16716 - RNA, 19 nt, artificial
  Chemically synthesized
cguguuuuguaggagacuu

SEQ ID NO: 16717 - RNA, 19 nt, artificial
  Chemically synthesized
agaccaacaucaacgagug

SEQ ID NO: 16718 - RNA, 19 nt, artificial
  Chemically synthesized
guaacaucaacaucgauga

SEQ ID NO: 16719 - RNA, 19 nt, artificial
  Chemically synthesized
gggcgccacgugugagaau

SEQ ID NO: 16720 - RNA, 19 nt, artificial
  Chemically synthesized
gcaccugucuggacaagau

SEQ ID NO: 16721 - RNA, 19 nt, artificial
  Chemically synthesized
cacugugacagccagugca

SEQ ID NO: 16722 - RNA, 19 nt, artificial
  Chemically synthesized
gggugaacugcucugagga

SEQ ID NO: 16723 - RNA, 19 nt, artificial
  Chemically synthesized
gcugcgaguccgucaucaa

SEQ ID NO: 16724 - RNA, 19 nt, artificial
  Chemically synthesized
ccggaggccuucaaguaaa

SEQ ID NO: 16725 - RNA, 19 nt, artificial
  Chemically synthesized
gaugguuucuugcaagcau

SEQ ID NO: 16726 - RNA, 19 nt, artificial
  Chemically synthesized
gugaaaauguguucucgga

SEQ ID NO: 16727 - RNA, 19 nt, artificial
  Chemically synthesized
ggcagaaaaaaugucugua

SEQ ID NO: 16728 - RNA, 19 nt, artificial
  Chemically synthesized
caccacugcgagaccaaca

SEQ ID NO: 16729 - RNA, 19 nt, artificial
  Chemically synthesized
augauguuggagaagggaa

SEQ ID NO: 16730 - RNA, 19 nt, artificial
  Chemically synthesized
cacccaugguaccaaucau

SEQ ID NO: 16731 - RNA, 19 nt, artificial
  Chemically synthesized
gcauguguaacaucaacau

SEQ ID NO: 16732 - RNA, 19 nt, artificial
  Chemically synthesized
gcagauuuuugcaauacca

SEQ ID NO: 16733 - RNA, 19 nt, artificial
  Chemically synthesized
ccaaguauagccuauggca

SEQ ID NO: 16734 - RNA, 19 nt, artificial
  Chemically synthesized
ccgccaaggugcugcugga

SEQ ID NO: 16735 - RNA, 19 nt, artificial
  Chemically synthesized
cgggcaacagcgaggaaga

SEQ ID NO: 16736 - RNA, 19 nt, artificial
  Chemically synthesized
accuggagaccaagaaguu

SEQ ID NO: 16737 - RNA, 19 nt, artificial
  Chemically synthesized
gccugucugaggucaauga

SEQ ID NO: 16738 - RNA, 19 nt, artificial
  Chemically synthesized
ggcaagggcagaccuguga

SEQ ID NO: 16739 - RNA, 19 nt, artificial
  Chemically synthesized
ggagccuuuuuaaaacaca

SEQ ID NO: 16740 - RNA, 19 nt, artificial
  Chemically synthesized
ccuuccgcacgcggauuaa

SEQ ID NO: 16741 - RNA, 19 nt, artificial
  Chemically synthesized
acugugacaucaacaacaa

SEQ ID NO: 16742 - RNA, 19 nt, artificial
  Chemically synthesized
gugggcggguccaccaguu

SEQ ID NO: 16743 - RNA, 19 nt, artificial
  Chemically synthesized
ggcgugaacaccuacaacu

SEQ ID NO: 16744 - RNA, 19 nt, artificial
  Chemically synthesized
guuugaauggucaaugcga

SEQ ID NO: 16745 - RNA, 19 nt, artificial
  Chemically synthesized
gagaccaacaucaacgagu

SEQ ID NO: 16746 - RNA, 19 nt, artificial
  Chemically synthesized
caucaugcaugucaaacau

SEQ ID NO: 16747 - RNA, 19 nt, artificial
  Chemically synthesized
guucuuggucccuccagaa

SEQ ID NO: 16748 - RNA, 19 nt, artificial
  Chemically synthesized
aggaccuggagaccaagaa

SEQ ID NO: 16749 - RNA, 19 nt, artificial
  Chemically synthesized
gcaguugugcuccugaaga

SEQ ID NO: 16750 - RNA, 19 nt, artificial
  Chemically synthesized
gcgagaccgacaucgacga

SEQ ID NO: 16751 - RNA, 19 nt, artificial
  Chemically synthesized
acgucaacgccguagauga

SEQ ID NO: 16752 - RNA, 19 nt, artificial
  Chemically synthesized
gcacaaggugucuuccaga

SEQ ID NO: 16753 - RNA, 19 nt, artificial
  Chemically synthesized
cugaggucaaugagugcaa

SEQ ID NO: 16754 - RNA, 19 nt, artificial
  Chemically synthesized
gacggacccaacacuuaca

SEQ ID NO: 16755 - RNA, 19 nt, artificial
  Chemically synthesized
guguucucggaguguguau

SEQ ID NO: 16756 - RNA, 19 nt, artificial
  Chemically synthesized
uaggcaucaugcaugucaa

SEQ ID NO: 16757 - RNA, 19 nt, artificial
  Chemically synthesized
uggacaagaucgauggcua

SEQ ID NO: 16758 - RNA, 19 nt, artificial
  Chemically synthesized
ggucccaacugccagacca

SEQ ID NO: 16759 - RNA, 19 nt, artificial
  Chemically synthesized
agcugcauccagaggcaaa

SEQ ID NO: 16760 - RNA, 19 nt, artificial
  Chemically synthesized
ggaggaagaagucccagga

SEQ ID NO: 16761 - RNA, 19 nt, artificial
  Chemically synthesized
gccagugccugcccuucga

SEQ ID NO: 16762 - RNA, 19 nt, artificial
  Chemically synthesized
gacccuggguggaguggga

SEQ ID NO: 16763 - RNA, 19 nt, artificial
  Chemically synthesized
ccgucaucuccgacuucau

SEQ ID NO: 16764 - RNA, 19 nt, artificial
  Chemically synthesized
cagguucaguauuauguag

SEQ ID NO: 16765 - RNA, 19 nt, artificial
  Chemically synthesized
uguguaacaucaacaucga

SEQ ID NO: 16766 - RNA, 19 nt, artificial
  Chemically synthesized
ggguccaccaguuugaaug

SEQ ID NO: 16767 - RNA, 19 nt, artificial
  Chemically synthesized
ggacaagaucaaugaguuc

SEQ ID NO: 16768 - RNA, 19 nt, artificial
  Chemically synthesized
aggcaagcccugcaagaau

SEQ ID NO: 16769 - RNA, 19 nt, artificial
  Chemically synthesized
gcggguccaccaguuugaa

SEQ ID NO: 16770 - RNA, 19 nt, artificial
  Chemically synthesized
ggcuggacugugcggagca

SEQ ID NO: 16771 - RNA, 19 nt, artificial
  Chemically synthesized
ggcgccacgugugagaaug

SEQ ID NO: 16772 - RNA, 19 nt, artificial
  Chemically synthesized
cagcaaacauccagcagca

SEQ ID NO: 16773 - RNA, 19 nt, artificial
  Chemically synthesized
ggcgggaccugccacaaca

SEQ ID NO: 16774 - RNA, 19 nt, artificial
  Chemically synthesized
gcaacagcgcggagugcga

SEQ ID NO: 16775 - RNA, 19 nt, artificial
  Chemically synthesized
cugugacaucaacaacaau

SEQ ID NO: 16776 - RNA, 19 nt, artificial
  Chemically synthesized
ucugcagccugcagugcaa

SEQ ID NO: 16777 - RNA, 19 nt, artificial
  Chemically synthesized
ggaggaccucaucaacuca

SEQ ID NO: 16778 - RNA, 19 nt, artificial
  Chemically synthesized
ccaccagcaugcaguccca

SEQ ID NO: 16779 - RNA, 19 nt, artificial
  Chemically synthesized
ggcggcaaaugcuggcaga

SEQ ID NO: 16780 - RNA, 19 nt, artificial
  Chemically synthesized
agaacugugaggaaaauau

SEQ ID NO: 16781 - RNA, 19 nt, artificial
  Chemically synthesized
gaaaauguguucucggagu

SEQ ID NO: 16782 - RNA, 19 nt, artificial
  Chemically synthesized
gcaacugccugcugcccua

SEQ ID NO: 16783 - RNA, 19 nt, artificial
  Chemically synthesized
gcggcaccugcaaagacau

SEQ ID NO: 16784 - RNA, 19 nt, artificial
  Chemically synthesized
cgcggauuaauuugcaucu

SEQ ID NO: 16785 - RNA, 19 nt, artificial
  Chemically synthesized
agaaccugcagccagcaaa

SEQ ID NO: 16786 - RNA, 19 nt, artificial
  Chemically synthesized
cgggcaccugucuggacaa

SEQ ID NO: 16787 - RNA, 19 nt, artificial
  Chemically synthesized
acugcucccucaacuucaa

SEQ ID NO: 16788 - RNA, 19 nt, artificial
  Chemically synthesized
gugugcacugugagaucaa

SEQ ID NO: 16789 - RNA, 19 nt, artificial
  Chemically synthesized
cccagcaggugcagccaca

SEQ ID NO: 16790 - RNA, 19 nt, artificial
  Chemically synthesized
ccgugaccgcagcccaguu

SEQ ID NO: 16791 - RNA, 19 nt, artificial
  Chemically synthesized
ggcuccaacugcgacacca

SEQ ID NO: 16792 - RNA, 19 nt, artificial
  Chemically synthesized
gcgggcaagugcaucaaca

SEQ ID NO: 16793 - RNA, 19 nt, artificial
  Chemically synthesized
agccacaaaacuuacagau

SEQ ID NO: 16794 - RNA, 19 nt, artificial
  Chemically synthesized
aguucugagagccaggguu

SEQ ID NO: 16795 - RNA, 19 nt, artificial
  Chemically synthesized
agaccugugaggucgacau

SEQ ID NO: 16796 - RNA, 19 nt, artificial
  Chemically synthesized
gugucuuccagauccugau

SEQ ID NO: 16797 - RNA, 19 nt, artificial
  Chemically synthesized
aggugcagccacaaaacuu

SEQ ID NO: 16798 - RNA, 19 nt, artificial
  Chemically synthesized
gagccuuuuuaaaacacau

SEQ ID NO: 16799 - RNA, 19 nt, artificial
  Chemically synthesized
gugagaucaacguggacga

SEQ ID NO: 16800 - RNA, 19 nt, artificial
  Chemically synthesized
ggaaacaacugcaagaacg

SEQ ID NO: 16801 - RNA, 19 nt, artificial
  Chemically synthesized
uagccuauggcagaaaaaa

SEQ ID NO: 16802 - RNA, 19 nt, artificial
  Chemically synthesized
cuuggucccuccagaacca

SEQ ID NO: 16803 - RNA, 19 nt, artificial
  Chemically synthesized
aguucuuggucccuccaga

SEQ ID NO: 16804 - RNA, 19 nt, artificial
  Chemically synthesized
cccugaagaacgcuucaga

SEQ ID NO: 16805 - RNA, 19 nt, artificial
  Chemically synthesized
gccacaaaacuuacagaug

SEQ ID NO: 16806 - RNA, 19 nt, artificial
  Chemically synthesized
ggucaacacagacgagugu

SEQ ID NO: 16807 - RNA, 19 nt, artificial
  Chemically synthesized
uccagauccugauccggaa

SEQ ID NO: 16808 - RNA, 19 nt, artificial
  Chemically synthesized
acugcagcgagaacauuga

SEQ ID NO: 16809 - RNA, 19 nt, artificial
  Chemically synthesized
uuggagaagggaaguugaa

SEQ ID NO: 16810 - RNA, 19 nt, artificial
  Chemically synthesized
ugcucacgcugacggagua

SEQ ID NO: 16811 - RNA, 19 nt, artificial
  Chemically synthesized
ggugagaccugccugaaug

SEQ ID NO: 16812 - RNA, 19 nt, artificial
  Chemically synthesized
ggaaguugaacgagcauag

SEQ ID NO: 16813 - RNA, 19 nt, artificial
  Chemically synthesized
gucuaccuggagauugaca

SEQ ID NO: 16814 - RNA, 19 nt, artificial
  Chemically synthesized
uggacaggucaguacugua

SEQ ID NO: 16815 - RNA, 19 nt, artificial
  Chemically synthesized
cgccggagcagcugcgcaa

SEQ ID NO: 16816 - RNA, 19 nt, artificial
  Chemically synthesized
cggaguguguaugccaaga

SEQ ID NO: 16817 - RNA, 19 nt, artificial
  Chemically synthesized
auagccuauggcagaaaaa

SEQ ID NO: 16818 - RNA, 19 nt, artificial
  Chemically synthesized
aagugaucuacaugaggaa

SEQ ID NO: 16819 - RNA, 19 nt, artificial
  Chemically synthesized
cagccugcacaaccagaca

SEQ ID NO: 16820 - RNA, 19 nt, artificial
  Chemically synthesized
ccagaacugugaggaaaau

SEQ ID NO: 16821 - RNA, 19 nt, artificial
  Chemically synthesized
aggacugcagcgagaacau

SEQ ID NO: 16822 - RNA, 19 nt, artificial
  Chemically synthesized
gcagccugcagugcaacaa

SEQ ID NO: 16823 - RNA, 19 nt, artificial
  Chemically synthesized
guauagccuauggcagaaa

SEQ ID NO: 16824 - RNA, 19 nt, artificial
  Chemically synthesized
ggcggcuacuccugcaagu

SEQ ID NO: 16825 - RNA, 19 nt, artificial
  Chemically synthesized
cagugcuggaaguacuuca

SEQ ID NO: 16826 - RNA, 19 nt, artificial
  Chemically synthesized
gcaacugcgagaccgacau

SEQ ID NO: 16827 - RNA, 19 nt, artificial
  Chemically synthesized
agaggcaaacggaggcaaa

SEQ ID NO: 16828 - RNA, 19 nt, artificial
  Chemically synthesized
gcccugucccagaugauga

SEQ ID NO: 16829 - RNA, 19 nt, artificial
  Chemically synthesized
ggcaaagcuggcucaccuu

SEQ ID NO: 16830 - RNA, 19 nt, artificial
  Chemically synthesized
agugccagcugaugccaaa

SEQ ID NO: 16831 - RNA, 19 nt, artificial
  Chemically synthesized
gaggucaaugagugcaaca

SEQ ID NO: 16832 - RNA, 19 nt, artificial
  Chemically synthesized
gacugcucccucaacuuca

SEQ ID NO: 16833 - RNA, 19 nt, artificial
  Chemically synthesized
gaguggacaggucaguacu

SEQ ID NO: 16834 - RNA, 19 nt, artificial
  Chemically synthesized
cccgcugcacaguagccuu

SEQ ID NO: 16835 - RNA, 19 nt, artificial
  Chemically synthesized
acugugacagccagugcaa

SEQ ID NO: 16836 - RNA, 19 nt, artificial
  Chemically synthesized
acaaugagugugaauccaa

SEQ ID NO: 16837 - RNA, 19 nt, artificial
  Chemically synthesized
ggcaccugcaaagacauga

SEQ ID NO: 16838 - RNA, 19 nt, artificial
  Chemically synthesized
gccgcugccuggacaagau

SEQ ID NO: 16839 - RNA, 19 nt, artificial
  Chemically synthesized
ggucuucaagcgugacgca

SEQ ID NO: 16840 - RNA, 19 nt, artificial
  Chemically synthesized
ggaacuguagaugauguau

SEQ ID NO: 16841 - RNA, 19 nt, artificial
  Chemically synthesized
aaggcaagcccugcaagaa

SEQ ID NO: 16842 - RNA, 19 nt, artificial
  Chemically synthesized
gcgagguggacaucgauga

SEQ ID NO: 16843 - RNA, 19 nt, artificial
  Chemically synthesized
ccugcaagaauggugccaa

SEQ ID NO: 16844 - RNA, 19 nt, artificial
  Chemically synthesized
ccaaggugcugcuggacca

SEQ ID NO: 16845 - RNA, 19 nt, artificial
  Chemically synthesized
cggacuaccugggcggcua

SEQ ID NO: 16846 - RNA, 19 nt, artificial
  Chemically synthesized
gaacuguagaugauguauu

SEQ ID NO: 16847 - RNA, 19 nt, artificial
  Chemically synthesized
cccagaugaugagcuacca

SEQ ID NO: 16848 - RNA, 19 nt, artificial
  Chemically synthesized
ggaaaauaucgacgauugu

SEQ ID NO: 16849 - RNA, 19 nt, artificial
  Chemically synthesized
gugcacccaugguaccaau

SEQ ID NO: 16850 - RNA, 19 nt, artificial
  Chemically synthesized
gugaggacugcagcgagaa

SEQ ID NO: 16851 - RNA, 19 nt, artificial
  Chemically synthesized
gccuauggcagaaaaaaug

SEQ ID NO: 16852 - RNA, 19 nt, artificial
  Chemically synthesized
gaagaagaugcuccagcaa

SEQ ID NO: 16853 - RNA, 19 nt, artificial
  Chemically synthesized
cagugagggacgucagacu

SEQ ID NO: 16854 - RNA, 19 nt, artificial
  Chemically synthesized
cagggugugcacugugaga

SEQ ID NO: 16855 - RNA, 19 nt, artificial
  Chemically synthesized
cagcaggugcagccacaaa

SEQ ID NO: 16856 - RNA, 19 nt, artificial
  Chemically synthesized
ggcugcaaaggcaagcccu

SEQ ID NO: 16857 - RNA, 19 nt, artificial
  Chemically synthesized
cacaaggugucuuccagau

SEQ ID NO: 16858 - RNA, 19 nt, artificial
  Chemically synthesized
gggugugcacugugagauc

SEQ ID NO: 16859 - RNA, 19 nt, artificial
  Chemically synthesized
agcauguguaacaucaaca

SEQ ID NO: 16860 - RNA, 19 nt, artificial
  Chemically synthesized
gaguuccagugcaucugca

SEQ ID NO: 16861 - RNA, 19 nt, artificial
  Chemically synthesized
gcuuccuuucccaagccuu

SEQ ID NO: 16862 - RNA, 19 nt, artificial
  Chemically synthesized
aggcagacgugcagccacu

SEQ ID NO: 16863 - RNA, 19 nt, artificial
  Chemically synthesized
uagaguguaguuuacagaa

SEQ ID NO: 16864 - RNA, 19 nt, artificial
  Chemically synthesized
gcacuuucugugaggagga

SEQ ID NO: 16865 - RNA, 19 nt, artificial
  Chemically synthesized
ccgugcagagugagaccgu

SEQ ID NO: 16866 - RNA, 19 nt, artificial
  Chemically synthesized
ggcgugagcucagcagcca

SEQ ID NO: 16867 - RNA, 19 nt, artificial
  Chemically synthesized
gccugcagugcaacaacca

SEQ ID NO: 16868 - RNA, 19 nt, artificial
  Chemically synthesized
cuugaaauguaggcaucau

SEQ ID NO: 16869 - RNA, 19 nt, artificial
  Chemically synthesized
ggcaguggacucagcagca

SEQ ID NO: 16870 - RNA, 19 nt, artificial
  Chemically synthesized
ggcaggaugucaacgagug

SEQ ID NO: 16871 - RNA, 19 nt, artificial
  Chemically synthesized
gcugccuggacaagaucaa

SEQ ID NO: 16872 - RNA, 19 nt, artificial
  Chemically synthesized
cugucugaggucaaugagu

SEQ ID NO: 16873 - RNA, 19 nt, artificial
  Chemically synthesized
gaggacugcagcgagaaca

SEQ ID NO: 16874 - RNA, 19 nt, artificial
  Chemically synthesized
gaaacaagugaaagcauau

SEQ ID NO: 16875 - RNA, 19 nt, artificial
  Chemically synthesized
ggcuccuucgagugccagu

SEQ ID NO: 16876 - RNA, 19 nt, artificial
  Chemically synthesized
uggaagaacugcacgcagu

SEQ ID NO: 16877 - RNA, 19 nt, artificial
  Chemically synthesized
accugaacguggcggccaa

SEQ ID NO: 16878 - RNA, 19 nt, artificial
  Chemically synthesized
ugauguuggagaagggaag

SEQ ID NO: 16879 - RNA, 19 nt, artificial
  Chemically synthesized
gcacguguauugacgacgu

SEQ ID NO: 16880 - RNA, 19 nt, artificial
  Chemically synthesized
cagagagcuccugcuucaa

SEQ ID NO: 16881 - RNA, 19 nt, artificial
  Chemically synthesized
gcgacaccaacccugucaa

SEQ ID NO: 16882 - RNA, 19 nt, artificial
  Chemically synthesized
ggcuaccugggcagccuca

SEQ ID NO: 16883 - RNA, 19 nt, artificial
  Chemically synthesized
ccgucaucaauggcugcaa

SEQ ID NO: 16884 - RNA, 19 nt, artificial
  Chemically synthesized
gagauugacaaccggcagu

SEQ ID NO: 16885 - RNA, 19 nt, artificial
  Chemically synthesized
gcugcacaguagccuugcu

SEQ ID NO: 16886 - RNA, 19 nt, artificial
  Chemically synthesized
ucuaccuggagauugacaa

SEQ ID NO: 16887 - RNA, 19 nt, artificial
  Chemically synthesized
gcaggcaauccgaggacua

SEQ ID NO: 16888 - RNA, 19 nt, artificial
  Chemically synthesized
gugcccucauggacgacaa

SEQ ID NO: 16889 - RNA, 19 nt, artificial
  Chemically synthesized
gccagugagggacgucaga

SEQ ID NO: 16890 - RNA, 19 nt, artificial
  Chemically synthesized
caauaccaaguauagccua

SEQ ID NO: 16891 - RNA, 19 nt, artificial
  Chemically synthesized
cugcaagaacggcggcaaa

SEQ ID NO: 16892 - RNA, 19 nt, artificial
  Chemically synthesized
gugucaugccagugaggga

SEQ ID NO: 16893 - RNA, 19 nt, artificial
  Chemically synthesized
ggccaccacugcgagacca

SEQ ID NO: 16894 - RNA, 19 nt, artificial
  Chemically synthesized
caugguaccaaucaugaau

SEQ ID NO: 16895 - RNA, 19 nt, artificial
  Chemically synthesized
cguugguuauacaaguucu

SEQ ID NO: 16896 - RNA, 19 nt, artificial
  Chemically synthesized
gaccagaggagccuuuuua

SEQ ID NO: 16897 - RNA, 19 nt, artificial
  Chemically synthesized
gauccacugugagaacaac

SEQ ID NO: 16898 - RNA, 19 nt, artificial
  Chemically synthesized
gugaggucgacaucaacga

SEQ ID NO: 16899 - RNA, 19 nt, artificial
  Chemically synthesized
gauguuggagaagggaagu

SEQ ID NO: 16900 - RNA, 19 nt, artificial
  Chemically synthesized
gacugcagcgagaacauug

SEQ ID NO: 16901 - RNA, 19 nt, artificial
  Chemically synthesized
agggcuucaaagugucuga

SEQ ID NO: 16902 - RNA, 19 nt, artificial
  Chemically synthesized
agaacugcacgcagucucu

SEQ ID NO: 16903 - RNA, 19 nt, artificial
  Chemically synthesized
acaagaucaaugaguucca

SEQ ID NO: 16904 - RNA, 19 nt, artificial
  Chemically synthesized
agguucaguauuauguagu

SEQ ID NO: 16905 - RNA, 19 nt, artificial
  Chemically synthesized
cccagguuccgaagaagau

SEQ ID NO: 16906 - RNA, 19 nt, artificial
  Chemically synthesized
caauccgaggacuaugaga

SEQ ID NO: 16907 - RNA, 19 nt, artificial
  Chemically synthesized
gggcaagaagguccgcaag

SEQ ID NO: 16908 - RNA, 19 nt, artificial
  Chemically synthesized
aagggaaguugaacgagca

SEQ ID NO: 16909 - RNA, 19 nt, artificial
  Chemically synthesized
ggagaagcugcauccagag

SEQ ID NO: 16910 - RNA, 19 nt, artificial
  Chemically synthesized
ccaacauccaggacaacau

SEQ ID NO: 16911 - RNA, 19 nt, artificial
  Chemically synthesized
gggccgccgccgugaacaa

SEQ ID NO: 16912 - RNA, 19 nt, artificial
  Chemically synthesized
agugaaagcauauggguua

SEQ ID NO: 16913 - RNA, 19 nt, artificial
  Chemically synthesized
cagaccaacaucaacgagu

SEQ ID NO: 16914 - RNA, 19 nt, artificial
  Chemically synthesized
ggcacuugccugggucaca

SEQ ID NO: 16915 - RNA, 19 nt, artificial
  Chemically synthesized
gcaagcaugcuugugaaaa

SEQ ID NO: 16916 - RNA, 19 nt, artificial
  Chemically synthesized
ggugacugcucccucaacu

SEQ ID NO: 16917 - RNA, 19 nt, artificial
  Chemically synthesized
cgugcagagugagaccgug

SEQ ID NO: 16918 - RNA, 19 nt, artificial
  Chemically synthesized
guuucuugcaagcaugcuu

SEQ ID NO: 16919 - RNA, 19 nt, artificial
  Chemically synthesized
ggcagcuacgagaccgcca

SEQ ID NO: 16920 - RNA, 19 nt, artificial
  Chemically synthesized
ggcugugucugccgacgca

SEQ ID NO: 16921 - RNA, 19 nt, artificial
  Chemically synthesized
uauagccuauggcagaaaa

SEQ ID NO: 16922 - RNA, 19 nt, artificial
  Chemically synthesized
guggacgagugcucaccca

SEQ ID NO: 16923 - RNA, 19 nt, artificial
  Chemically synthesized
gauccggaaccgagccaca

SEQ ID NO: 16924 - RNA, 19 nt, artificial
  Chemically synthesized
cggaggcauccuacccuuu

SEQ ID NO: 16925 - RNA, 19 nt, artificial
  Chemically synthesized
ccagcaugcagucccagau

SEQ ID NO: 16926 - RNA, 19 nt, artificial
  Chemically synthesized
gccgcaguugugcuccuga

SEQ ID NO: 16927 - RNA, 19 nt, artificial
  Chemically synthesized
cuggguggagugggaccaa

SEQ ID NO: 16928 - RNA, 19 nt, artificial
  Chemically synthesized
ggugucuuccagauccuga

SEQ ID NO: 16929 - RNA, 19 nt, artificial
  Chemically synthesized
caauguggaugccgcaguu

SEQ ID NO: 16930 - RNA, 19 nt, artificial
  Chemically synthesized
gcaacagcuccuuccacuu

SEQ ID NO: 16931 - RNA, 19 nt, artificial
  Chemically synthesized
gccagaaccuugugcacug

SEQ ID NO: 16932 - RNA, 19 nt, artificial
  Chemically synthesized
gcucugaggagaucgacga

SEQ ID NO: 16933 - RNA, 19 nt, artificial
  Chemically synthesized
ccuguaacgagggcuccaa

SEQ ID NO: 16934 - RNA, 19 nt, artificial
  Chemically synthesized
caaugagugugaauccaac

SEQ ID NO: 16935 - RNA, 19 nt, artificial
  Chemically synthesized
gcucccucaacuucaauga

SEQ ID NO: 16936 - RNA, 19 nt, artificial
  Chemically synthesized
ccugcagcauggcauggua

SEQ ID NO: 16937 - RNA, 19 nt, artificial
  Chemically synthesized
agaucaaugaguuccagug

SEQ ID NO: 16938 - RNA, 19 nt, artificial
  Chemically synthesized
accagaggagccuuuuuaa

SEQ ID NO: 16939 - RNA, 19 nt, artificial
  Chemically synthesized
ccagcaggugcagccacaa

SEQ ID NO: 16940 - RNA, 19 nt, artificial
  Chemically synthesized
cccucauggacgacaacca

SEQ ID NO: 16941 - RNA, 19 nt, artificial
  Chemically synthesized
cgcagcugcacuucaugua

SEQ ID NO: 16942 - RNA, 19 nt, artificial
  Chemically synthesized
uacagaugcagcagcagaa

SEQ ID NO: 16943 - RNA, 19 nt, artificial
  Chemically synthesized
ccacaaaacuuacagaugc

SEQ ID NO: 16944 - RNA, 19 nt, artificial
  Chemically synthesized
cagauuuuugcaauaccaa

SEQ ID NO: 16945 - RNA, 19 nt, artificial
  Chemically synthesized
gggcggguccaccaguuug

SEQ ID NO: 16946 - RNA, 19 nt, artificial
  Chemically synthesized
ggucugcugugccaccuca

SEQ ID NO: 16947 - RNA, 19 nt, artificial
  Chemically synthesized
cugagaaaacaagcaaguu

SEQ ID NO: 16948 - RNA, 19 nt, artificial
  Chemically synthesized
cccgcggguucaucugcaa

SEQ ID NO: 16949 - RNA, 19 nt, artificial
  Chemically synthesized
ggugcugcuggaccacuuu

SEQ ID NO: 16950 - RNA, 19 nt, artificial
  Chemically synthesized
aaucuuuguuucagguuca

SEQ ID NO: 16951 - RNA, 19 nt, artificial
  Chemically synthesized
agaccaagaaguuccgguu

SEQ ID NO: 16952 - RNA, 19 nt, artificial
  Chemically synthesized
gaagcugcauccagaggca

SEQ ID NO: 16953 - RNA, 19 nt, artificial
  Chemically synthesized
accgcagcccaguuccuga

SEQ ID NO: 16954 - RNA, 19 nt, artificial
  Chemically synthesized
cgccagaguggacagguca

SEQ ID NO: 16955 - RNA, 19 nt, artificial
  Chemically synthesized
ggcuacacaggcagcuacu

SEQ ID NO: 16956 - RNA, 19 nt, artificial
  Chemically synthesized
ggaagaacugcacgcaguc

SEQ ID NO: 16957 - RNA, 19 nt, artificial
  Chemically synthesized
accuggacgaccagacaga

SEQ ID NO: 16958 - RNA, 19 nt, artificial
  Chemically synthesized
ggcugcggcuccuacaggu

SEQ ID NO: 16959 - RNA, 19 nt, artificial
  Chemically synthesized
cgugcggaaggccagugca

SEQ ID NO: 16960 - RNA, 19 nt, artificial
  Chemically synthesized
agcgcaugcaucacgacau

SEQ ID NO: 16961 - RNA, 19 nt, artificial
  Chemically synthesized
aggucaacacagacgagug

SEQ ID NO: 16962 - RNA, 19 nt, artificial
  Chemically synthesized
cugcaaagacaugaccagu

SEQ ID NO: 16963 - RNA, 19 nt, artificial
  Chemically synthesized
ggcaucugugccaguacga

SEQ ID NO: 16964 - RNA, 19 nt, artificial
  Chemically synthesized
gcgaggucaacacagacga

SEQ ID NO: 16965 - RNA, 19 nt, artificial
  Chemically synthesized
cgcaacugcgagaccgaca

SEQ ID NO: 16966 - RNA, 19 nt, artificial
  Chemically synthesized
auccacugugagaacaaca

SEQ ID NO: 16967 - RNA, 19 nt, artificial
  Chemically synthesized
agaacaacagggaggagac

SEQ ID NO: 16968 - RNA, 19 nt, artificial
  Chemically synthesized
gccucuucgacggcuuuga

SEQ ID NO: 16969 - RNA, 19 nt, artificial
  Chemically synthesized
cagaggagccuuuuuaaaa

SEQ ID NO: 16970 - RNA, 19 nt, artificial
  Chemically synthesized
augccaacauccaggacaa

SEQ ID NO: 16971 - RNA, 19 nt, artificial
  Chemically synthesized
cagaaacacugccuuuuua

SEQ ID NO: 16972 - RNA, 19 nt, artificial
  Chemically synthesized
agggugagguugacgccga

SEQ ID NO: 16973 - RNA, 19 nt, artificial
  Chemically synthesized
gcuggacugugcggagcau

SEQ ID NO: 16974 - RNA, 19 nt, artificial
  Chemically synthesized
guucuugaaauguaggcau

SEQ ID NO: 16975 - RNA, 19 nt, artificial
  Chemically synthesized
ccugcaagaacggcggcaa

SEQ ID NO: 16976 - RNA, 19 nt, artificial
  Chemically synthesized
agugggaccaacugugaca

SEQ ID NO: 16977 - RNA, 19 nt, artificial
  Chemically synthesized
cacgcggauuaauuugcau

SEQ ID NO: 16978 - RNA, 19 nt, artificial
  Chemically synthesized
gaguguguaugccaagagu

SEQ ID NO: 16979 - RNA, 19 nt, artificial
  Chemically synthesized
ccggcuacagugggcgcaa

SEQ ID NO: 16980 - RNA, 19 nt, artificial
  Chemically synthesized
cgagccaggcagacgugca

SEQ ID NO: 16981 - RNA, 19 nt, artificial
  Chemically synthesized
ccugcacagacggcaucaa

SEQ ID NO: 16982 - RNA, 19 nt, artificial
  Chemically synthesized
gugaggaccugguggacga

SEQ ID NO: 16983 - RNA, 19 nt, artificial
  Chemically synthesized
gccgucaucuccgacuuca

SEQ ID NO: 16984 - RNA, 19 nt, artificial
  Chemically synthesized
gggcagaccugugaggucg

SEQ ID NO: 16985 - RNA, 19 nt, artificial
  Chemically synthesized
cguccaacccaugucugaa

SEQ ID NO: 16986 - RNA, 19 nt, artificial
  Chemically synthesized
ccuguuaggagaagcugca

SEQ ID NO: 16987 - RNA, 19 nt, artificial
  Chemically synthesized
ggaccggccuuuacugcga

SEQ ID NO: 16988 - RNA, 19 nt, artificial
  Chemically synthesized
aggaccucaucaacucaca

SEQ ID NO: 16989 - RNA, 19 nt, artificial
  Chemically synthesized
ccagagccgggcacauuga

SEQ ID NO: 16990 - RNA, 19 nt, artificial
  Chemically synthesized
gugugcacugcgaggucaa

SEQ ID NO: 16991 - RNA, 19 nt, artificial
  Chemically synthesized
cggccagaacugugaggaa

SEQ ID NO: 16992 - RNA, 19 nt, artificial
  Chemically synthesized
gagagccgagccaggcaga

SEQ ID NO: 16993 - RNA, 19 nt, artificial
  Chemically synthesized
ccaccgacguggccgcauu

SEQ ID NO: 16994 - RNA, 19 nt, artificial
  Chemically synthesized
gcggcauggugccgaacca

SEQ ID NO: 16995 - RNA, 19 nt, artificial
  Chemically synthesized
cagaguggacaggucagua

SEQ ID NO: 16996 - RNA, 19 nt, artificial
  Chemically synthesized
guugaacgagcauagucca

SEQ ID NO: 16997 - RNA, 19 nt, artificial
  Chemically synthesized
aaguauagccuauggcaga

SEQ ID NO: 16998 - RNA, 19 nt, artificial
  Chemically synthesized
ugcuggaggaccucaucaa

SEQ ID NO: 16999 - RNA, 19 nt, artificial
  Chemically synthesized
ggcuacagugggcgcaacu

SEQ ID NO: 17000 - RNA, 19 nt, artificial
  Chemically synthesized
agcgggauccacugugaga

SEQ ID NO: 17001 - RNA, 19 nt, artificial
  Chemically synthesized
ggugugcacugcgagguca

SEQ ID NO: 17002 - RNA, 19 nt, artificial
  Chemically synthesized
cugcagcgagaacauugau

SEQ ID NO: 17003 - RNA, 19 nt, artificial
  Chemically synthesized
gcuacaacugcgugugugu

SEQ ID NO: 17004 - RNA, 19 nt, artificial
  Chemically synthesized
caucugaaauaggaaacaa

SEQ ID NO: 17005 - RNA, 19 nt, artificial
  Chemically synthesized
gcaacaaggucugcagccu

SEQ ID NO: 17006 - RNA, 19 nt, artificial
  Chemically synthesized
ccaacugcgagaucaaccu

SEQ ID NO: 17007 - RNA, 19 nt, artificial
  Chemically synthesized
gcaccuuggcgugagcuca

SEQ ID NO: 17008 - RNA, 19 nt, artificial
  Chemically synthesized
ugucaaugagugcgacuca

SEQ ID NO: 17009 - RNA, 19 nt, artificial
  Chemically synthesized
gacugcguggacagcuaca

SEQ ID NO: 17010 - RNA, 19 nt, artificial
  Chemically synthesized
gaaccagggcacguguauu

SEQ ID NO: 17011 - RNA, 19 nt, artificial
  Chemically synthesized
guacgauguggacgagugu

SEQ ID NO: 17012 - RNA, 19 nt, artificial
  Chemically synthesized
ucaucuccgacuucaucua

SEQ ID NO: 17013 - RNA, 19 nt, artificial
  Chemically synthesized
cccaacugccagaccaaca

SEQ ID NO: 17014 - RNA, 19 nt, artificial
  Chemically synthesized
cagaacugugaggaaaaua

SEQ ID NO: 17015 - RNA, 19 nt, artificial
  Chemically synthesized
cgagugugcguccaaccca

SEQ ID NO: 17016 - RNA, 19 nt, artificial
  Chemically synthesized
cucagggugugcacuguga

SEQ ID NO: 17017 - RNA, 19 nt, artificial
  Chemically synthesized
gccucgcugggcagccuca

SEQ ID NO: 17018 - RNA, 19 nt, artificial
  Chemically synthesized
aguauuauguaguuguucg

SEQ ID NO: 17019 - RNA, 19 nt, artificial
  Chemically synthesized
ccaacccugucaauggcaa

SEQ ID NO: 17020 - RNA, 19 nt, artificial
  Chemically synthesized
ggcucuugugccacauccu

SEQ ID NO: 17021 - RNA, 19 nt, artificial
  Chemically synthesized
cgucccaagauguugauuu

SEQ ID NO: 17022 - RNA, 19 nt, artificial
  Chemically synthesized
gaggaccuggagaccaaga

SEQ ID NO: 17023 - RNA, 19 nt, artificial
  Chemically synthesized
ccgccaagcgccugcugga

SEQ ID NO: 17024 - RNA, 19 nt, artificial
  Chemically synthesized
ugggcaucgggcaccugaa

SEQ ID NO: 17025 - RNA, 19 nt, artificial
  Chemically synthesized
ggaugaaaagauucuucug

SEQ ID NO: 17026 - RNA, 19 nt, artificial
  Chemically synthesized
ccuucgagugccagugucu

SEQ ID NO: 17027 - RNA, 19 nt, artificial
  Chemically synthesized
gcgugaacaccuacaacug

SEQ ID NO: 17028 - RNA, 19 nt, artificial
  Chemically synthesized
guguaacaucaacaucgau

SEQ ID NO: 17029 - RNA, 19 nt, artificial
  Chemically synthesized
ggccacugugacagccagu

SEQ ID NO: 17030 - RNA, 19 nt, artificial
  Chemically synthesized
agggcgccagccugcacaa

SEQ ID NO: 17031 - RNA, 19 nt, artificial
  Chemically synthesized
cuuaaugaaugagucuguu

SEQ ID NO: 17032 - RNA, 19 nt, artificial
  Chemically synthesized
ccggcgugcagggcaagaa

SEQ ID NO: 17033 - RNA, 19 nt, artificial
  Chemically synthesized
gcgagaccgccuugcaccu

SEQ ID NO: 17034 - RNA, 19 nt, artificial
  Chemically synthesized
cuuucugugaggaggacau

SEQ ID NO: 17035 - RNA, 19 nt, artificial
  Chemically synthesized
aggucgacaucaacgagug

SEQ ID NO: 17036 - RNA, 19 nt, artificial
  Chemically synthesized
cgcugggcagccucaacau

SEQ ID NO: 17037 - RNA, 19 nt, artificial
  Chemically synthesized
ccugagggcuucaaagugu

SEQ ID NO: 17038 - RNA, 19 nt, artificial
  Chemically synthesized
cggguccaccaguuugaau

SEQ ID NO: 17039 - RNA, 19 nt, artificial
  Chemically synthesized
caggaaacaacugcaagaa

SEQ ID NO: 17040 - RNA, 19 nt, artificial
  Chemically synthesized
ccaacugccagaaccuugu

SEQ ID NO: 17041 - RNA, 19 nt, artificial
  Chemically synthesized
ugcagagugagaccgugga

SEQ ID NO: 17042 - RNA, 19 nt, artificial
  Chemically synthesized
guucccugagggcuucaaa

SEQ ID NO: 17043 - RNA, 19 nt, artificial
  Chemically synthesized
gugaacugcucugaggaga

SEQ ID NO: 17044 - RNA, 19 nt, artificial
  Chemically synthesized
gggaguuccagugcaucug

SEQ ID NO: 17045 - RNA, 19 nt, artificial
  Chemically synthesized
caaacauccagcagcagca

SEQ ID NO: 17046 - RNA, 19 nt, artificial
  Chemically synthesized
gcuacgagaccgccaaggu

SEQ ID NO: 17047 - RNA, 19 nt, artificial
  Chemically synthesized
gcauccagaggcaaacgga

SEQ ID NO: 17048 - RNA, 19 nt, artificial
  Chemically synthesized
agaagucccaggacggcaa

SEQ ID NO: 17049 - RNA, 19 nt, artificial
  Chemically synthesized
gcgugcagcgcgucaauga

SEQ ID NO: 17050 - RNA, 19 nt, artificial
  Chemically synthesized
ugcgcagcgacaagguguu

SEQ ID NO: 17051 - RNA, 19 nt, artificial
  Chemically synthesized
cacguguauugacgacguu

SEQ ID NO: 17052 - RNA, 19 nt, artificial
  Chemically synthesized
ggcuggcaagggcagaccu

SEQ ID NO: 17053 - RNA, 19 nt, artificial
  Chemically synthesized
cugcgaguccgucaucaau

SEQ ID NO: 17054 - RNA, 19 nt, artificial
  Chemically synthesized
accucagccugcacagugu

SEQ ID NO: 17055 - RNA, 19 nt, artificial
  Chemically synthesized
gccaggguuuuccuacgua

SEQ ID NO: 17056 - RNA, 19 nt, artificial
  Chemically synthesized
ccgacgucaacgccguaga

SEQ ID NO: 17057 - RNA, 19 nt, artificial
  Chemically synthesized
uggacgacaaccagaauga

SEQ ID NO: 17058 - RNA, 19 nt, artificial
  Chemically synthesized
uccgcacgcggauuaauuu

SEQ ID NO: 17059 - RNA, 19 nt, artificial
  Chemically synthesized
cggaggcaaagcuggcuca

SEQ ID NO: 17060 - RNA, 19 nt, artificial
  Chemically synthesized
cggugagaccugccugaau

SEQ ID NO: 17061 - RNA, 19 nt, artificial
  Chemically synthesized
cauguguuuuagaugguuu

SEQ ID NO: 17062 - RNA, 19 nt, artificial
  Chemically synthesized
gucugcagccugcagugca

SEQ ID NO: 17063 - RNA, 19 nt, artificial
  Chemically synthesized
ucaacaacaaugaguguga

SEQ ID NO: 17064 - RNA, 19 nt, artificial
  Chemically synthesized
ccaucgucuaccuggagau

SEQ ID NO: 17065 - RNA, 19 nt, artificial
  Chemically synthesized
ggcuacuccugcaagugcg

SEQ ID NO: 17066 - RNA, 19 nt, artificial
  Chemically synthesized
gguggcugcgcagcgacaa

SEQ ID NO: 17067 - RNA, 19 nt, artificial
  Chemically synthesized
gggucacacacggaggcau

SEQ ID NO: 17068 - RNA, 19 nt, artificial
  Chemically synthesized
gccggguacaagugcaacu

SEQ ID NO: 17069 - RNA, 19 nt, artificial
  Chemically synthesized
gcgcggagugcgaguggga

SEQ ID NO: 17070 - RNA, 19 nt, artificial
  Chemically synthesized
gccagccugcacaaccaga

SEQ ID NO: 17071 - RNA, 19 nt, artificial
  Chemically synthesized
gcaccugcguggacggcau

SEQ ID NO: 17072 - RNA, 19 nt, artificial
  Chemically synthesized
cucaccuggugcagaccca

SEQ ID NO: 17073 - RNA, 19 nt, artificial
  Chemically synthesized
gcaugauggcacgacgcca

SEQ ID NO: 17074 - RNA, 19 nt, artificial
  Chemically synthesized
gcaacagcgaggaagagga

SEQ ID NO: 17075 - RNA, 19 nt, artificial
  Chemically synthesized
aggaaaauaucgacgauug

SEQ ID NO: 17076 - RNA, 19 nt, artificial
  Chemically synthesized
gacaucaacaacaaugagu

SEQ ID NO: 17077 - RNA, 19 nt, artificial
  Chemically synthesized
ggacgcacugcgaggugga

SEQ ID NO: 17078 - RNA, 19 nt, artificial
  Chemically synthesized
ggaggacaucaacgagugu

SEQ ID NO: 17079 - RNA, 19 nt, artificial
  Chemically synthesized
gcaggugcagccacaaaac

SEQ ID NO: 17080 - RNA, 19 nt, artificial
  Chemically synthesized
caggcaauccgaggacuau

SEQ ID NO: 17081 - RNA, 19 nt, artificial
  Chemically synthesized
ccugguggacgagugcuca

SEQ ID NO: 17082 - RNA, 19 nt, artificial
  Chemically synthesized
acguggucuucaagcguga

SEQ ID NO: 17083 - RNA, 19 nt, artificial
  Chemically synthesized
gcccguggcacccagaacu

SEQ ID NO: 17084 - RNA, 19 nt, artificial
  Chemically synthesized
cuccuucuacugcgagugu

SEQ ID NO: 17085 - RNA, 19 nt, artificial
  Chemically synthesized
gaucgauggcuacgagugu

SEQ ID NO: 17086 - RNA, 19 nt, artificial
  Chemically synthesized
gauuuuugcaauaccaagu

SEQ ID NO: 17087 - RNA, 19 nt, artificial
  Chemically synthesized
gagaucgacgucaacgagu

SEQ ID NO: 17088 - RNA, 19 nt, artificial
  Chemically synthesized
ccuucuacugcgagugucc

SEQ ID NO: 17089 - RNA, 19 nt, artificial
  Chemically synthesized
agaucaaccuggaugacug

SEQ ID NO: 17090 - RNA, 19 nt, artificial
  Chemically synthesized
agaucgacgucaacgagug

SEQ ID NO: 17091 - RNA, 19 nt, artificial
  Chemically synthesized
gcggagcauguacccgaga

SEQ ID NO: 17092 - RNA, 19 nt, artificial
  Chemically synthesized
cgggagggcagcuacgaga

SEQ ID NO: 17093 - RNA, 19 nt, artificial
  Chemically synthesized
ucuccgacuucaucuacca

SEQ ID NO: 17094 - RNA, 19 nt, artificial
  Chemically synthesized
guguuuuguaggagacuug

SEQ ID NO: 17095 - RNA, 19 nt, artificial
  Chemically synthesized
ggcuacacagggagcaugu

SEQ ID NO: 17096 - RNA, 19 nt, artificial
  Chemically synthesized
ggcaccugucuggacaaga

SEQ ID NO: 17097 - RNA, 19 nt, artificial
  Chemically synthesized
gaggaaaauaucgacgauu

SEQ ID NO: 17098 - RNA, 19 nt, artificial
  Chemically synthesized
ugguggugguggugcugau

SEQ ID NO: 17099 - RNA, 19 nt, artificial
  Chemically synthesized
acugcgagaucaaccugga

SEQ ID NO: 17100 - RNA, 19 nt, artificial
  Chemically synthesized
gacuccucgcccugcaaga

SEQ ID NO: 17101 - RNA, 19 nt, artificial
  Chemically synthesized
guggagugggaccaacugu

SEQ ID NO: 17102 - RNA, 19 nt, artificial
  Chemically synthesized
auguguucucggagugugu

SEQ ID NO: 17103 - RNA, 19 nt, artificial
  Chemically synthesized
ccaccugccuggaccagau

SEQ ID NO: 17104 - RNA, 19 nt, artificial
  Chemically synthesized
agccgagccaggcagacgu

SEQ ID NO: 17105 - RNA, 19 nt, artificial
  Chemically synthesized
cgaccagaggagccuuuuu

SEQ ID NO: 17106 - RNA, 19 nt, artificial
  Chemically synthesized
gugcggagcauguacccga

SEQ ID NO: 17107 - RNA, 19 nt, artificial
  Chemically synthesized
gcguccaacccaugucuga

SEQ ID NO: 17108 - RNA, 19 nt, artificial
  Chemically synthesized
aacugugacaucaacaaca

SEQ ID NO: 17109 - RNA, 19 nt, artificial
  Chemically synthesized
cacgugugagaaugacgcu

SEQ ID NO: 17110 - RNA, 19 nt, artificial
  Chemically synthesized
gaggagccuuuuuaaaaca

SEQ ID NO: 17111 - RNA, 19 nt, artificial
  Chemically synthesized
gcgugcagggcaagaaggu

SEQ ID NO: 17112 - RNA, 19 nt, artificial
  Chemically synthesized
ucaacgagugcgucucgaa

SEQ ID NO: 17113 - RNA, 19 nt, artificial
  Chemically synthesized
cccaugguaccaaucauga

SEQ ID NO: 17114 - RNA, 19 nt, artificial
  Chemically synthesized
gcaaaugcuggcagaccca

SEQ ID NO: 17115 - RNA, 19 nt, artificial
  Chemically synthesized
ccuacaagaucgaggccgu

SEQ ID NO: 17116 - RNA, 19 nt, artificial
  Chemically synthesized
gaaucuuuguuucagguuc

SEQ ID NO: 17117 - RNA, 19 nt, artificial
  Chemically synthesized
gccuuugugcuucuguucu

SEQ ID NO: 17118 - RNA, 19 nt, artificial
  Chemically synthesized
accacugcgagaccaacau

SEQ ID NO: 17119 - RNA, 19 nt, artificial
  Chemically synthesized
acaucaacaucgaugagug

SEQ ID NO: 17120 - RNA, 19 nt, artificial
  Chemically synthesized
agcccggcgugcagggcaa

SEQ ID NO: 17121 - RNA, 19 nt, artificial
  Chemically synthesized
gggcgucugugugcgcucu

SEQ ID NO: 17122 - RNA, 19 nt, artificial
  Chemically synthesized
cgggcgacgucacccacga

SEQ ID NO: 17123 - RNA, 19 nt, artificial
  Chemically synthesized
aucuacaugaggaacugua

SEQ ID NO: 17124 - RNA, 19 nt, artificial
  Chemically synthesized
cugcaagaacgccgggaca

SEQ ID NO: 17125 - RNA, 19 nt, artificial
  Chemically synthesized
gcggauuaauuugcaucug

SEQ ID NO: 17126 - RNA, 19 nt, artificial
  Chemically synthesized
gagagccaggguuuuccua

SEQ ID NO: 17127 - RNA, 19 nt, artificial
  Chemically synthesized
cuugcaagcaugcuuguga

SEQ ID NO: 17128 - RNA, 19 nt, artificial
  Chemically synthesized
gugugaauccaacccuugu

SEQ ID NO: 17129 - RNA, 19 nt, artificial
  Chemically synthesized
ccagaggagccuuuuuaaa

SEQ ID NO: 17130 - RNA, 19 nt, artificial
  Chemically synthesized
ggcuucaccggccagaacu

SEQ ID NO: 17131 - RNA, 19 nt, artificial
  Chemically synthesized
ccuggaagaacugcacgca

SEQ ID NO: 17132 - RNA, 19 nt, artificial
  Chemically synthesized
ggccgcuccaccagcauca

SEQ ID NO: 17133 - RNA, 19 nt, artificial
  Chemically synthesized
gguucccugagggcuucaa

SEQ ID NO: 17134 - RNA, 19 nt, artificial
  Chemically synthesized
agcauauggguuagauguu

SEQ ID NO: 17135 - RNA, 19 nt, artificial
  Chemically synthesized
ggcaccugcgaccugcuca

SEQ ID NO: 17136 - RNA, 19 nt, artificial
  Chemically synthesized
ggagauugacaaccggcag

SEQ ID NO: 17137 - RNA, 19 nt, artificial
  Chemically synthesized
ggaaccgagccacagaccu

SEQ ID NO: 17138 - RNA, 19 nt, artificial
  Chemically synthesized
gagagcuucuccugugucu

SEQ ID NO: 17139 - RNA, 19 nt, artificial
  Chemically synthesized
gucugcugugccaccucaa

SEQ ID NO: 17140 - RNA, 19 nt, artificial
  Chemically synthesized
uugcaagcaugcuugugaa

SEQ ID NO: 17141 - RNA, 19 nt, artificial
  Chemically synthesized
cgucagacuuggcucagcu

SEQ ID NO: 17142 - RNA, 19 nt, artificial
  Chemically synthesized
cgggcuacacaggcagcua

SEQ ID NO: 17143 - RNA, 19 nt, artificial
  Chemically synthesized
accaguuugaauggucaau

SEQ ID NO: 17144 - RNA, 19 nt, artificial
  Chemically synthesized
gcaggaugucaacgagugu

SEQ ID NO: 17145 - RNA, 19 nt, artificial
  Chemically synthesized
gccacuacggcuccugcaa

SEQ ID NO: 17146 - RNA, 19 nt, artificial
  Chemically synthesized
ugcacagacggcaucaaca

SEQ ID NO: 17147 - RNA, 19 nt, artificial
  Chemically synthesized
cugcgagaccaacaucaac

SEQ ID NO: 17148 - RNA, 19 nt, artificial
  Chemically synthesized
agggcgccacgugugagaa

SEQ ID NO: 17149 - RNA, 19 nt, artificial
  Chemically synthesized
guugccggguacaagugca

SEQ ID NO: 17150 - RNA, 19 nt, artificial
  Chemically synthesized
gcuccaucgucuaccugga

SEQ ID NO: 17151 - RNA, 19 nt, artificial
  Chemically synthesized
gaccaacaucaacgagugu

SEQ ID NO: 17152 - RNA, 19 nt, artificial
  Chemically synthesized
gggcaucugugccaguacg

SEQ ID NO: 17153 - RNA, 19 nt, artificial
  Chemically synthesized
ucuucaagcgugacgcaca

SEQ ID NO: 17154 - RNA, 19 nt, artificial
  Chemically synthesized
ggaggcauccuacccuuuu

SEQ ID NO: 17155 - RNA, 19 nt, artificial
  Chemically synthesized
cgcugccuggacaagauca

SEQ ID NO: 17156 - RNA, 19 nt, artificial
  Chemically synthesized
aauaccaaguauagccuau

SEQ ID NO: 17157 - RNA, 19 nt, artificial
  Chemically synthesized
cgagcauaguccaaaaagc

SEQ ID NO: 17158 - RNA, 19 nt, artificial
  Chemically synthesized
cgcugcgaguccgucauca

SEQ ID NO: 17159 - RNA, 19 nt, artificial
  Chemically synthesized
acaacugcgugugugucaa

SEQ ID NO: 17160 - RNA, 19 nt, artificial
  Chemically synthesized
ggcugcaacagcgcggagu

SEQ ID NO: 17161 - RNA, 19 nt, artificial
  Chemically synthesized
uguugugugucaugccagu

SEQ ID NO: 17162 - RNA, 19 nt, artificial
  Chemically synthesized
gcaagugcguggccggcua

SEQ ID NO: 17163 - RNA, 19 nt, artificial
  Chemically synthesized
cccaacaccuacaagugcu

SEQ ID NO: 17164 - RNA, 19 nt, artificial
  Chemically synthesized
gaaccuugugcacuggugu

SEQ ID NO: 17165 - RNA, 19 nt, artificial
  Chemically synthesized
cuacguaggaugaaaagau

SEQ ID NO: 17166 - RNA, 19 nt, artificial
  Chemically synthesized
ccugcgaccugcucacgcu

SEQ ID NO: 17167 - RNA, 19 nt, artificial
  Chemically synthesized
guggacagcuacacgugca

SEQ ID NO: 17168 - RNA, 19 nt, artificial
  Chemically synthesized
ugcaugucaaacaugagau

SEQ ID NO: 17169 - RNA, 19 nt, artificial
  Chemically synthesized
gagcauguguaacaucaac

SEQ ID NO: 17170 - RNA, 19 nt, artificial
  Chemically synthesized
ggucaguacuguaccgagg

SEQ ID NO: 17171 - RNA, 19 nt, artificial
  Chemically synthesized
ccugugagcccacauccga

SEQ ID NO: 17172 - RNA, 19 nt, artificial
  Chemically synthesized
ucaugcaugucaaacauga

SEQ ID NO: 17173 - RNA, 19 nt, artificial
  Chemically synthesized
gggccaccugcacggacua

SEQ ID NO: 17174 - RNA, 19 nt, artificial
  Chemically synthesized
ccgccgccgugaacaaugu

SEQ ID NO: 17175 - RNA, 19 nt, artificial
  Chemically synthesized
ggaccugccacaacaccca

SEQ ID NO: 17176 - RNA, 19 nt, artificial
  Chemically synthesized
cgccgacgucaacgccgua

SEQ ID NO: 17177 - RNA, 19 nt, artificial
  Chemically synthesized
ggcugcgcagcgacaaggu

SEQ ID NO: 17178 - RNA, 19 nt, artificial
  Chemically synthesized
aguacgauguggacgagug

SEQ ID NO: 17179 - RNA, 19 nt, artificial
  Chemically synthesized
gucaguacuguaccgagga

SEQ ID NO: 17180 - RNA, 19 nt, artificial
  Chemically synthesized
gauccugauccggaaccga

SEQ ID NO: 17181 - RNA, 19 nt, artificial
  Chemically synthesized
ugaacugcucugaggagau

SEQ ID NO: 17182 - RNA, 19 nt, artificial
  Chemically synthesized
ggacggacccaacacuuac

SEQ ID NO: 17183 - RNA, 19 nt, artificial
  Chemically synthesized
ggacaagaucgauggcuac

SEQ ID NO: 17184 - RNA, 19 nt, artificial
  Chemically synthesized
ggccggcuggccuuugaga

SEQ ID NO: 17185 - RNA, 19 nt, artificial
  Chemically synthesized
ccugcagccgccaccacca

SEQ ID NO: 17186 - RNA, 19 nt, artificial
  Chemically synthesized
aaagaaaugauguuggaga

SEQ ID NO: 17187 - RNA, 19 nt, artificial
  Chemically synthesized
augagucuguuguguguca

SEQ ID NO: 17188 - RNA, 19 nt, artificial
  Chemically synthesized
cgggauccacugugagaac

SEQ ID NO: 17189 - RNA, 19 nt, artificial
  Chemically synthesized
cauggacgacaaccagaau

SEQ ID NO: 17190 - RNA, 19 nt, artificial
  Chemically synthesized
ugucaaacaugagaugugu

SEQ ID NO: 17191 - RNA, 19 nt, artificial
  Chemically synthesized
ccuuccacuuccugcggga

SEQ ID NO: 17192 - RNA, 19 nt, artificial
  Chemically synthesized
uguguucucggagugugua

SEQ ID NO: 17193 - RNA, 19 nt, artificial
  Chemically synthesized
cgcggguucaucugcaagu

SEQ ID NO: 17194 - RNA, 19 nt, artificial
  Chemically synthesized
ggacaucacggaucauaug

SEQ ID NO: 17195 - RNA, 19 nt, artificial
  Chemically synthesized
gugaucuacaugaggaacu

SEQ ID NO: 17196 - RNA, 19 nt, artificial
  Chemically synthesized
gagugccagcugaugccaa

SEQ ID NO: 17197 - RNA, 19 nt, artificial
  Chemically synthesized
caguuugaauggucaaugc

SEQ ID NO: 17198 - RNA, 19 nt, artificial
  Chemically synthesized
ggcuucacugggcaucugu

SEQ ID NO: 17199 - RNA, 19 nt, artificial
  Chemically synthesized
cugaggagaucgacgagug

SEQ ID NO: 17200 - RNA, 19 nt, artificial
  Chemically synthesized
gcaugucaaacaugagaug

SEQ ID NO: 17201 - RNA, 19 nt, artificial
  Chemically synthesized
uguacgaccaguacugcaa

SEQ ID NO: 17202 - RNA, 19 nt, artificial
  Chemically synthesized
gagggcgccacgugugaga

SEQ ID NO: 17203 - RNA, 19 nt, artificial
  Chemically synthesized
gagcauaguccaaaaagcu

SEQ ID NO: 17204 - RNA, 19 nt, artificial
  Chemically synthesized
guugguuauacaaguucuu

SEQ ID NO: 17205 - RNA, 19 nt, artificial
  Chemically synthesized
ugugccacauccuggacua

SEQ ID NO: 17206 - RNA, 19 nt, artificial
  Chemically synthesized
gggacgaggaccuggagac

SEQ ID NO: 17207 - RNA, 19 nt, artificial
  Chemically synthesized
gguccaccaguuugaaugg

SEQ ID NO: 17208 - RNA, 19 nt, artificial
  Chemically synthesized
gccucaagcccggcgugca

SEQ ID NO: 17209 - RNA, 19 nt, artificial
  Chemically synthesized
cuggcaagggcagaccugu

SEQ ID NO: 17210 - RNA, 19 nt, artificial
  Chemically synthesized
caacguggacgacugcaau

SEQ ID NO: 17211 - RNA, 19 nt, artificial
  Chemically synthesized
cgggcgagaccgccuugca

SEQ ID NO: 17212 - RNA, 19 nt, artificial
  Chemically synthesized
ccugcgccguggccuccaa

SEQ ID NO: 17213 - RNA, 19 nt, artificial
  Chemically synthesized
cuuccgcacgcggauuaau

SEQ ID NO: 17214 - RNA, 19 nt, artificial
  Chemically synthesized
gccucugccgcccaggcua

SEQ ID NO: 17215 - RNA, 19 nt, artificial
  Chemically synthesized
ggcaaguccgcccugcacu

SEQ ID NO: 17216 - RNA, 19 nt, artificial
  Chemically synthesized
ggucaaugagugcaacagc

SEQ ID NO: 17217 - RNA, 19 nt, artificial
  Chemically synthesized
cgcugguggugguggugcu

SEQ ID NO: 17218 - RNA, 19 nt, artificial
  Chemically synthesized
caacacgccugacugcaca

SEQ ID NO: 17219 - RNA, 19 nt, artificial
  Chemically synthesized
gcggugacugcucccucaa

SEQ ID NO: 17220 - RNA, 19 nt, artificial
  Chemically synthesized
acugcgagaccgacaucga

SEQ ID NO: 17221 - RNA, 19 nt, artificial
  Chemically synthesized
gcacccaugguaccaauca

SEQ ID NO: 17222 - RNA, 19 nt, artificial
  Chemically synthesized
guccgcaagcccagcagca

SEQ ID NO: 17223 - RNA, 19 nt, artificial
  Chemically synthesized
caucaacaucgaugagugu

SEQ ID NO: 17224 - RNA, 19 nt, artificial
  Chemically synthesized
gcccguucuugaaauguag

SEQ ID NO: 17225 - RNA, 19 nt, artificial
  Chemically synthesized
ccaagauguugauuuuuac

SEQ ID NO: 17226 - RNA, 19 nt, artificial
  Chemically synthesized
gccugugagccgggcuaca

SEQ ID NO: 17227 - RNA, 19 nt, artificial
  Chemically synthesized
ggacaugccacguggugga

SEQ ID NO: 17228 - RNA, 19 nt, artificial
  Chemically synthesized
guaguuuacagaaaaagac

SEQ ID NO: 17229 - RNA, 19 nt, artificial
  Chemically synthesized
gcccggcuggucagggaaa

SEQ ID NO: 17230 - RNA, 19 nt, artificial
  Chemically synthesized
ccggagcagcugcgcaaca

SEQ ID NO: 17231 - RNA, 19 nt, artificial
  Chemically synthesized
cugugagaacaacacgccu

SEQ ID NO: 17232 - RNA, 19 nt, artificial
  Chemically synthesized
gguggagugggaccaacug

SEQ ID NO: 17233 - RNA, 19 nt, artificial
  Chemically synthesized
cuggacaagaucaaugagu

SEQ ID NO: 17234 - RNA, 19 nt, artificial
  Chemically synthesized
agaucaacguggacgacug

SEQ ID NO: 17235 - RNA, 19 nt, artificial
  Chemically synthesized
caucaacaacaaugagugu

SEQ ID NO: 17236 - RNA, 19 nt, artificial
  Chemically synthesized
ccaguuugaauggucaaug

SEQ ID NO: 17237 - RNA, 19 nt, artificial
  Chemically synthesized
ggcuggccacccagccuca

SEQ ID NO: 17238 - RNA, 19 nt, artificial
  Chemically synthesized
gcuaccugggcagccucaa

SEQ ID NO: 17239 - RNA, 19 nt, artificial
  Chemically synthesized
gguuauacaaguucuuggu

SEQ ID NO: 17240 - RNA, 19 nt, artificial
  Chemically synthesized
acugccagaccaacaucaa

SEQ ID NO: 17241 - RNA, 19 nt, artificial
  Chemically synthesized
gggaccugugagcccacau

SEQ ID NO: 17242 - RNA, 19 nt, artificial
  Chemically synthesized
aaagugaucuacaugagga

SEQ ID NO: 17243 - RNA, 19 nt, artificial
  Chemically synthesized
gacuaugagagcuucuccu

SEQ ID NO: 17244 - RNA, 19 nt, artificial
  Chemically synthesized
ggcgugcagggcaagaagg

SEQ ID NO: 17245 - RNA, 19 nt, artificial
  Chemically synthesized
ccggcuggccuuugagacu

SEQ ID NO: 17246 - RNA, 19 nt, artificial
  Chemically synthesized
agagcggcauggugccgaa

SEQ ID NO: 17247 - RNA, 19 nt, artificial
  Chemically synthesized
gcaucugcaugcccggcua

SEQ ID NO: 17248 - RNA, 19 nt, artificial
  Chemically synthesized
gaggucgacaucaacgagu

SEQ ID NO: 17249 - RNA, 19 nt, artificial
  Chemically synthesized
agacuaugccugcagcugu

SEQ ID NO: 17250 - RNA, 19 nt, artificial
  Chemically synthesized
agcucagccgcgugcugca

SEQ ID NO: 17251 - RNA, 19 nt, artificial
  Chemically synthesized
guuugggaggagcagauuu

SEQ ID NO: 17252 - RNA, 19 nt, artificial
  Chemically synthesized
gacugugcggagcauguac

SEQ ID NO: 17253 - RNA, 19 nt, artificial
  Chemically synthesized
cugucuggacaagaucgau

SEQ ID NO: 17254 - RNA, 19 nt, artificial
  Chemically synthesized
ccguggagggcaugcugga

SEQ ID NO: 17255 - RNA, 19 nt, artificial
  Chemically synthesized
agugcacccaugguaccaa

SEQ ID NO: 17256 - RNA, 19 nt, artificial
  Chemically synthesized
cgcacugcgagguggacau

SEQ ID NO: 17257 - RNA, 19 nt, artificial
  Chemically synthesized
cagggagcauguguaacau

SEQ ID NO: 17258 - RNA, 19 nt, artificial
  Chemically synthesized
gcggcuggaccggccuuua

SEQ ID NO: 17259 - RNA, 19 nt, artificial
  Chemically synthesized
ggacccaacacuuacaccu

SEQ ID NO: 17260 - RNA, 19 nt, artificial
  Chemically synthesized
ggcgacgucacccacgagu

SEQ ID NO: 17261 - RNA, 19 nt, artificial
  Chemically synthesized
gccacauccuggacuacag

SEQ ID NO: 17262 - RNA, 19 nt, artificial
  Chemically synthesized
ggcuccuaccgcugcgucu

SEQ ID NO: 17263 - RNA, 19 nt, artificial
  Chemically synthesized
ccuggguggagugggacca

SEQ ID NO: 17264 - RNA, 19 nt, artificial
  Chemically synthesized
gugacuccucgcccugcaa

SEQ ID NO: 17265 - RNA, 19 nt, artificial
  Chemically synthesized
gaagaacgcuucagacggu

SEQ ID NO: 17266 - RNA, 19 nt, artificial
  Chemically synthesized
ccuggagaccaagaaguuc

SEQ ID NO: 17267 - RNA, 19 nt, artificial
  Chemically synthesized
uccggaaccgagccacaga

SEQ ID NO: 17268 - RNA, 19 nt, artificial
  Chemically synthesized
gagccgggcuacacaggga

SEQ ID NO: 17269 - RNA, 19 nt, artificial
  Chemically synthesized
cugugacccuggguggagu

SEQ ID NO: 17270 - RNA, 19 nt, artificial
  Chemically synthesized
gcagcuacugccagcacga

SEQ ID NO: 17271 - RNA, 19 nt, artificial
  Chemically synthesized
ccugccugucugaggucaa

SEQ ID NO: 17272 - RNA, 19 nt, artificial
  Chemically synthesized
ccaacugccagaccaacau

SEQ ID NO: 17273 - RNA, 19 nt, artificial
  Chemically synthesized
cgcacaaggugucuuccag

SEQ ID NO: 17274 - RNA, 19 nt, artificial
  Chemically synthesized
gcgcccugucccagaugau

SEQ ID NO: 17275 - RNA, 19 nt, artificial
  Chemically synthesized
gccacgugugagaaugacg

SEQ ID NO: 17276 - RNA, 19 nt, artificial
  Chemically synthesized
ccuccuucuacugcgagug

SEQ ID NO: 17277 - RNA, 19 nt, artificial
  Chemically synthesized
cggccgucaucuccgacuu

SEQ ID NO: 17278 - RNA, 19 nt, artificial
  Chemically synthesized
gugugcacggaaggguaca

SEQ ID NO: 17279 - RNA, 19 nt, artificial
  Chemically synthesized
ugcaagcaugcuugugaaa

SEQ ID NO: 17280 - RNA, 19 nt, artificial
  Chemically synthesized
cccuguacgaccaguacug

SEQ ID NO: 17281 - RNA, 19 nt, artificial
  Chemically synthesized
caugcuugugaaaaugugu

SEQ ID NO: 17282 - RNA, 19 nt, artificial
  Chemically synthesized
cugugagccgggcuacaca

SEQ ID NO: 17283 - RNA, 19 nt, artificial
  Chemically synthesized
ggcuuugacugccagcgug

SEQ ID NO: 17284 - RNA, 19 nt, artificial
  Chemically synthesized
ucauggacgacaaccagaa

SEQ ID NO: 17285 - RNA, 19 nt, artificial
  Chemically synthesized
ggcaaacggaggcaaagcu

SEQ ID NO: 17286 - RNA, 19 nt, artificial
  Chemically synthesized
cccaagugcuuuaacaacg

SEQ ID NO: 17287 - RNA, 19 nt, artificial
  Chemically synthesized
gagugcgacucacagcccu

SEQ ID NO: 17288 - RNA, 19 nt, artificial
  Chemically synthesized
gcuccugcacagacggcau

SEQ ID NO: 17289 - RNA, 19 nt, artificial
  Chemically synthesized
ggcccaacccgugucacaa

SEQ ID NO: 17290 - RNA, 19 nt, artificial
  Chemically synthesized
gaaauguaggcaucaugca

SEQ ID NO: 17291 - RNA, 19 nt, artificial
  Chemically synthesized
gcaccugccgggagggcuu

SEQ ID NO: 17292 - RNA, 19 nt, artificial
  Chemically synthesized
caucaacgagugugccagu

SEQ ID NO: 17293 - RNA, 19 nt, artificial
  Chemically synthesized
agcgagaacauugaugacu

SEQ ID NO: 17294 - RNA, 19 nt, artificial
  Chemically synthesized
agggcaugcuggaggaccu

SEQ ID NO: 17295 - RNA, 19 nt, artificial
  Chemically synthesized
gugucugaggccagcaaga

SEQ ID NO: 17296 - RNA, 19 nt, artificial
  Chemically synthesized
gggugagguugacgccgac

SEQ ID NO: 17297 - RNA, 19 nt, artificial
  Chemically synthesized
cugucaauggcaaggccau

SEQ ID NO: 17298 - RNA, 19 nt, artificial
  Chemically synthesized
acacagggagcauguguaa

SEQ ID NO: 17299 - RNA, 19 nt, artificial
  Chemically synthesized
ggcaaaugcuggcagaccc

SEQ ID NO: 17300 - RNA, 19 nt, artificial
  Chemically synthesized
acugugagaucaacgugga

SEQ ID NO: 17301 - RNA, 19 nt, artificial
  Chemically synthesized
gcacgacgccacugauccu

SEQ ID NO: 17302 - RNA, 19 nt, artificial
  Chemically synthesized
cgggacaucacggaucaua

SEQ ID NO: 17303 - RNA, 19 nt, artificial
  Chemically synthesized
cccauggcuaccugucaga

SEQ ID NO: 17304 - RNA, 19 nt, artificial
  Chemically synthesized
cgaugcgagaucgacguca

SEQ ID NO: 17305 - RNA, 19 nt, artificial
  Chemically synthesized
ggcacucagggugugcacu

SEQ ID NO: 17306 - RNA, 19 nt, artificial
  Chemically synthesized
accaguggcuacgugugca

SEQ ID NO: 17307 - RNA, 19 nt, artificial
  Chemically synthesized
ggcuggccuuugagacugg

SEQ ID NO: 17308 - RNA, 19 nt, artificial
  Chemically synthesized
gccgcugcgaguccgucau

SEQ ID NO: 17309 - RNA, 19 nt, artificial
  Chemically synthesized
uggacaucgaugagugcga

SEQ ID NO: 17310 - RNA, 19 nt, artificial
  Chemically synthesized
aagacaugaccaguggcua

SEQ ID NO: 17311 - RNA, 19 nt, artificial
  Chemically synthesized
ccaaaugccugccagaacg

SEQ ID NO: 17312 - RNA, 19 nt, artificial
  Chemically synthesized
cgacaucaacgagugcguu

SEQ ID NO: 17313 - RNA, 19 nt, artificial
  Chemically synthesized
cacucagggugugcacugu

SEQ ID NO: 17314 - RNA, 19 nt, artificial
  Chemically synthesized
gccagcgugcggaaggcca

SEQ ID NO: 17315 - RNA, 19 nt, artificial
  Chemically synthesized
gcgagugccgugcugguca

SEQ ID NO: 17316 - RNA, 19 nt, artificial
  Chemically synthesized
uuuguuucagguucaguau

SEQ ID NO: 17317 - RNA, 19 nt, artificial
  Chemically synthesized
gcaucaauggcuucaccug

SEQ ID NO: 17318 - RNA, 19 nt, artificial
  Chemically synthesized
cguucuugaaauguaggca

SEQ ID NO: 17319 - RNA, 19 nt, artificial
  Chemically synthesized
cgcaguugugcuccugaag

SEQ ID NO: 17320 - RNA, 19 nt, artificial
  Chemically synthesized
cgcgcgacaucgcacagga

SEQ ID NO: 17321 - RNA, 19 nt, artificial
  Chemically synthesized
agacaugaccaguggcuac

SEQ ID NO: 17322 - RNA, 19 nt, artificial
  Chemically synthesized
aggugcugcuggaccacuu

SEQ ID NO: 17323 - RNA, 19 nt, artificial
  Chemically synthesized
ugaacgagcauaguccaaa

SEQ ID NO: 17324 - RNA, 19 nt, artificial
  Chemically synthesized
gagcuuccugaguggagag

SEQ ID NO: 17325 - RNA, 19 nt, artificial
  Chemically synthesized
uggagauugacaaccggca

SEQ ID NO: 17326 - RNA, 19 nt, artificial
  Chemically synthesized
gagugcgucucgaacccgu

SEQ ID NO: 17327 - RNA, 19 nt, artificial
  Chemically synthesized
gcaauaccaaguauagccu

SEQ ID NO: 17328 - RNA, 19 nt, artificial
  Chemically synthesized
cccugcccguucuugaaau

SEQ ID NO: 17329 - RNA, 19 nt, artificial
  Chemically synthesized
cuugugcacuggugugacu

SEQ ID NO: 17330 - RNA, 19 nt, artificial
  Chemically synthesized
gauuguccaggaaacaacu

SEQ ID NO: 17331 - RNA, 19 nt, artificial
  Chemically synthesized
gguacaagugcaacugccu

SEQ ID NO: 17332 - RNA, 19 nt, artificial
  Chemically synthesized
ggcgagaccgccuugcacc

SEQ ID NO: 17333 - RNA, 19 nt, artificial
  Chemically synthesized
gggacgucagacuuggcuc

SEQ ID NO: 17334 - RNA, 19 nt, artificial
  Chemically synthesized
gccgaccagaggagccuuu

SEQ ID NO: 17335 - RNA, 19 nt, artificial
  Chemically synthesized
gagcaugcgggcaagugca

SEQ ID NO: 17336 - RNA, 19 nt, artificial
  Chemically synthesized
gacaaugccugccucacca

SEQ ID NO: 17337 - RNA, 19 nt, artificial
  Chemically synthesized
gaacaauguggaugccgca

SEQ ID NO: 17338 - RNA, 19 nt, artificial
  Chemically synthesized
cugugugcgcucuguggau

SEQ ID NO: 17339 - RNA, 19 nt, artificial
  Chemically synthesized
cguguggccuccuucuacu

SEQ ID NO: 17340 - RNA, 19 nt, artificial
  Chemically synthesized
ugaccuggacgaccagaca

SEQ ID NO: 17341 - RNA, 19 nt, artificial
  Chemically synthesized
gggagggcagcuacgagac

SEQ ID NO: 17342 - RNA, 19 nt, artificial
  Chemically synthesized
ggccgugcagagugagacc

SEQ ID NO: 17343 - RNA, 19 nt, artificial
  Chemically synthesized
uggagaagggaaguugaac

SEQ ID NO: 17344 - RNA, 19 nt, artificial
  Chemically synthesized
ccagcagccuggcggugca

SEQ ID NO: 17345 - RNA, 19 nt, artificial
  Chemically synthesized
ccaccacugcgagaccaac

SEQ ID NO: 17346 - RNA, 19 nt, artificial
  Chemically synthesized
agguugacgccgacugcau

SEQ ID NO: 17347 - RNA, 19 nt, artificial
  Chemically synthesized
gacgauuguccaggaaaca

SEQ ID NO: 17348 - RNA, 19 nt, artificial
  Chemically synthesized
ugccaaaugccugccagaa

SEQ ID NO: 17349 - RNA, 19 nt, artificial
  Chemically synthesized
gcaaagacaugaccagugg

SEQ ID NO: 17350 - RNA, 19 nt, artificial
  Chemically synthesized
caccuuccgcacgcggauu

SEQ ID NO: 17351 - RNA, 19 nt, artificial
  Chemically synthesized
guggacgagugccagcuga

SEQ ID NO: 17352 - RNA, 19 nt, artificial
  Chemically synthesized
cuuugagacuggcccaccu

SEQ ID NO: 17353 - RNA, 19 nt, artificial
  Chemically synthesized
ugcccguucuugaaaugua

SEQ ID NO: 17354 - RNA, 19 nt, artificial
  Chemically synthesized
gaauggcgggaagugugaa

SEQ ID NO: 17355 - RNA, 19 nt, artificial
  Chemically synthesized
ggcuggacuggugaggacu

SEQ ID NO: 17356 - RNA, 19 nt, artificial
  Chemically synthesized
ccugucuggacaagaucga

SEQ ID NO: 17357 - RNA, 19 nt, artificial
  Chemically synthesized
agggcacguguauugacga

SEQ ID NO: 17358 - RNA, 19 nt, artificial
  Chemically synthesized
ccgcacgcggauuaauuug

SEQ ID NO: 17359 - RNA, 19 nt, artificial
  Chemically synthesized
gcagcuacugugaggaccu

SEQ ID NO: 17360 - RNA, 19 nt, artificial
  Chemically synthesized
cugggcaucugugccagua

SEQ ID NO: 17361 - RNA, 19 nt, artificial
  Chemically synthesized
ugcagccugcagugcaaca

SEQ ID NO: 17362 - RNA, 19 nt, artificial
  Chemically synthesized
accuuccgcacgcggauua

SEQ ID NO: 17363 - RNA, 19 nt, artificial
  Chemically synthesized
cagucucugcagugcugga

SEQ ID NO: 17364 - RNA, 19 nt, artificial
  Chemically synthesized
gccgugggcugcguccuuu

SEQ ID NO: 17365 - RNA, 19 nt, artificial
  Chemically synthesized
gagaacaacacgccugacu

SEQ ID NO: 17366 - RNA, 19 nt, artificial
  Chemically synthesized
accaguacugcaaggacca

SEQ ID NO: 17367 - RNA, 19 nt, artificial
  Chemically synthesized
caggcuucaccggccagaa

SEQ ID NO: 17368 - RNA, 19 nt, artificial
  Chemically synthesized
ccgacacccaccugggcau

SEQ ID NO: 17369 - RNA, 19 nt, artificial
  Chemically synthesized
cccuucuaccguugccugu

SEQ ID NO: 17370 - RNA, 19 nt, artificial
  Chemically synthesized
uccgcaagcccagcagcaa

SEQ ID NO: 17371 - RNA, 19 nt, artificial
  Chemically synthesized
agaaguuccgguucgagga

SEQ ID NO: 17372 - RNA, 19 nt, artificial
  Chemically synthesized
ccggaaccgagccacagac

SEQ ID NO: 17373 - RNA, 19 nt, artificial
  Chemically synthesized
cccugcugggccaggugaa

SEQ ID NO: 17374 - RNA, 19 nt, artificial
  Chemically synthesized
ggcuuccuuucccaagccu

SEQ ID NO: 17375 - RNA, 19 nt, artificial
  Chemically synthesized
ugcagugcuggaaguacuu

SEQ ID NO: 17376 - RNA, 19 nt, artificial
  Chemically synthesized
ccaucaagcgugccgccga

SEQ ID NO: 17377 - RNA, 19 nt, artificial
  Chemically synthesized
accucugcuucugccugaa

SEQ ID NO: 17378 - RNA, 19 nt, artificial
  Chemically synthesized
cgcauuccaacgucuccga

SEQ ID NO: 17379 - RNA, 19 nt, artificial
  Chemically synthesized
gguaccaaucaugaaucuu

SEQ ID NO: 17380 - RNA, 19 nt, artificial
  Chemically synthesized
ggacaggucaguacuguac

SEQ ID NO: 17381 - RNA, 19 nt, artificial
  Chemically synthesized
uuguuucagguucaguauu

SEQ ID NO: 17382 - RNA, 19 nt, artificial
  Chemically synthesized
ccgccaaauucaacgggcu

SEQ ID NO: 17383 - RNA, 19 nt, artificial
  Chemically synthesized
gcaccugcguggaccaggu

SEQ ID NO: 17384 - RNA, 19 nt, artificial
  Chemically synthesized
ccugcguggacggcaucaa

SEQ ID NO: 17385 - RNA, 19 nt, artificial
  Chemically synthesized
acgcugacggaguacaagu

SEQ ID NO: 17386 - RNA, 19 nt, artificial
  Chemically synthesized
ggcugcguccuuugguccu

SEQ ID NO: 17387 - RNA, 19 nt, artificial
  Chemically synthesized
cugcgagaucaaccuggau

SEQ ID NO: 17388 - RNA, 19 nt, artificial
  Chemically synthesized
ccggugagaccugccugaa

SEQ ID NO: 17389 - RNA, 19 nt, artificial
  Chemically synthesized
auucugagaaaacaagcaa

SEQ ID NO: 17390 - RNA, 19 nt, artificial
  Chemically synthesized
cucaacgacgcaugcauca

SEQ ID NO: 17391 - RNA, 19 nt, artificial
  Chemically synthesized
cgcugaccugcgcaugucu

SEQ ID NO: 17392 - RNA, 19 nt, artificial
  Chemically synthesized
ggcuggaccggccuuuacu

SEQ ID NO: 17393 - RNA, 19 nt, artificial
  Chemically synthesized
ggcgucuccagcccuccca

SEQ ID NO: 17394 - RNA, 19 nt, artificial
  Chemically synthesized
cugaggccagcaagaagaa

SEQ ID NO: 17395 - RNA, 19 nt, artificial
  Chemically synthesized
uggccuccuucuacugcga

SEQ ID NO: 17396 - RNA, 19 nt, artificial
  Chemically synthesized
accucaacgacgcaugcau

SEQ ID NO: 17397 - RNA, 19 nt, artificial
  Chemically synthesized
gccagcucugguucccuga

SEQ ID NO: 17398 - RNA, 19 nt, artificial
  Chemically synthesized
ugaggaaaauaucgacgau

SEQ ID NO: 17399 - RNA, 19 nt, artificial
  Chemically synthesized
uggacugugcggagcaugu

SEQ ID NO: 17400 - RNA, 19 nt, artificial
  Chemically synthesized
caccugugugugcacggaa

SEQ ID NO: 17401 - RNA, 19 nt, artificial
  Chemically synthesized
ugggcggguccaccaguuu

SEQ ID NO: 17402 - RNA, 19 nt, artificial
  Chemically synthesized
guggcacuugccuggguca

SEQ ID NO: 17403 - RNA, 19 nt, artificial
  Chemically synthesized
gaucaaccuggaugacugu

SEQ ID NO: 17404 - RNA, 19 nt, artificial
  Chemically synthesized
gcggaaggccagugcaacc

SEQ ID NO: 17405 - RNA, 19 nt, artificial
  Chemically synthesized
cucaaggcacggaggaaga

SEQ ID NO: 17406 - RNA, 19 nt, artificial
  Chemically synthesized
agguggacaucgaugagug

SEQ ID NO: 17407 - RNA, 19 nt, artificial
  Chemically synthesized
agccuuagccgcccaugca

SEQ ID NO: 17408 - RNA, 19 nt, artificial
  Chemically synthesized
cacacacggaggcauccua

SEQ ID NO: 17409 - RNA, 19 nt, artificial
  Chemically synthesized
gcgaggaggagcugcgcaa

SEQ ID NO: 17410 - RNA, 19 nt, artificial
  Chemically synthesized
cgcagcgacaagguguuga

SEQ ID NO: 17411 - RNA, 19 nt, artificial
  Chemically synthesized
aguuccagugcaucugcau

SEQ ID NO: 17412 - RNA, 19 nt, artificial
  Chemically synthesized
ccuauggcagaaaaaaugu

SEQ ID NO: 17413 - RNA, 19 nt, artificial
  Chemically synthesized
agcugcacuucauguacgu

SEQ ID NO: 17414 - RNA, 19 nt, artificial
  Chemically synthesized
gcuaacaaagauaugcaga

SEQ ID NO: 17415 - RNA, 19 nt, artificial
  Chemically synthesized
ccuuagccgcccaugcacu

SEQ ID NO: 17416 - RNA, 19 nt, artificial
  Chemically synthesized
gccggcaggaugucaacga

SEQ ID NO: 17417 - RNA, 19 nt, artificial
  Chemically synthesized
acgaugucaaugagugcga

SEQ ID NO: 17418 - RNA, 19 nt, artificial
  Chemically synthesized
cccuucgaggccuccuaca

SEQ ID NO: 17419 - RNA, 19 nt, artificial
  Chemically synthesized
cgccgugaacaauguggau

SEQ ID NO: 17420 - RNA, 19 nt, artificial
  Chemically synthesized
cgcaacagcuccuuccacu

SEQ ID NO: 17421 - RNA, 19 nt, artificial
  Chemically synthesized
acugcgaggucaacacaga

SEQ ID NO: 17422 - RNA, 19 nt, artificial
  Chemically synthesized
acaucaacgagugcguucu

SEQ ID NO: 17423 - RNA, 19 nt, artificial
  Chemically synthesized
ugccugaccuggacgacca

SEQ ID NO: 17424 - RNA, 19 nt, artificial
  Chemically synthesized
gagucuguugugugucaug

SEQ ID NO: 17425 - RNA, 19 nt, artificial
  Chemically synthesized
cuggagaccaagaaguucc

SEQ ID NO: 17426 - RNA, 19 nt, artificial
  Chemically synthesized
guaggcaucaugcauguca

SEQ ID NO: 17427 - RNA, 19 nt, artificial
  Chemically synthesized
ggcaucaauggcuucaccu

SEQ ID NO: 17428 - RNA, 19 nt, artificial
  Chemically synthesized
ucaaugagugcgacucaca

SEQ ID NO: 17429 - RNA, 19 nt, artificial
  Chemically synthesized
ggcccugaauuucacugug

SEQ ID NO: 17430 - RNA, 19 nt, artificial
  Chemically synthesized
agcgcccugucccagauga

SEQ ID NO: 17431 - RNA, 19 nt, artificial
  Chemically synthesized
gaggccgugcagagugaga

SEQ ID NO: 17432 - RNA, 19 nt, artificial
  Chemically synthesized
ugugacagccagugcaacu

SEQ ID NO: 17433 - RNA, 19 nt, artificial
  Chemically synthesized
ugcuggaccacuuugccaa

SEQ ID NO: 17434 - RNA, 19 nt, artificial
  Chemically synthesized
uggcagacccacacccagu

SEQ ID NO: 17435 - RNA, 19 nt, artificial
  Chemically synthesized
ggccggagcuuccugagug

SEQ ID NO: 17436 - RNA, 19 nt, artificial
  Chemically synthesized
cuaccuggagauugacaac

SEQ ID NO: 17437 - RNA, 19 nt, artificial
  Chemically synthesized
ccggcacgcuggugguggu

SEQ ID NO: 17438 - RNA, 19 nt, artificial
  Chemically synthesized
cugccgacgcacaaggugu

SEQ ID NO: 17439 - RNA, 19 nt, artificial
  Chemically synthesized
gccggagcuuccugagugg

SEQ ID NO: 17440 - RNA, 19 nt, artificial
  Chemically synthesized
ucacgcugacggaguacaa

SEQ ID NO: 17441 - RNA, 19 nt, artificial
  Chemically synthesized
ggacgaccagacagaccac

SEQ ID NO: 17442 - RNA, 19 nt, artificial
  Chemically synthesized
gcugcaaaggcaagcccug

SEQ ID NO: 17443 - RNA, 19 nt, artificial
  Chemically synthesized
gguuuuccuacguaggaug

SEQ ID NO: 17444 - RNA, 19 nt, artificial
  Chemically synthesized
gcaagugcaucaacacgcu

SEQ ID NO: 17445 - RNA, 19 nt, artificial
  Chemically synthesized
ccucgcugggcagccucaa

SEQ ID NO: 17446 - RNA, 19 nt, artificial
  Chemically synthesized
aguacugcaaggaccacuu

SEQ ID NO: 17447 - RNA, 19 nt, artificial
  Chemically synthesized
cgccuuugugcuucuguuc

SEQ ID NO: 17448 - RNA, 19 nt, artificial
  Chemically synthesized
gccuggccguggagggcau

SEQ ID NO: 17449 - RNA, 19 nt, artificial
  Chemically synthesized
agcccgugguucugccuga

SEQ ID NO: 17450 - RNA, 19 nt, artificial
  Chemically synthesized
cuguacgaccaguacugca

SEQ ID NO: 17451 - RNA, 19 nt, artificial
  Chemically synthesized
guaggaugaaaagauucuu

SEQ ID NO: 17452 - RNA, 19 nt, artificial
  Chemically synthesized
uguuggagaagggaaguug

SEQ ID NO: 17453 - RNA, 19 nt, artificial
  Chemically synthesized
aggaacuguagaugaugua

SEQ ID NO: 17454 - RNA, 19 nt, artificial
  Chemically synthesized
augguuucuugcaagcaug

SEQ ID NO: 17455 - RNA, 19 nt, artificial
  Chemically synthesized
gcugcaugcggcugugucu

SEQ ID NO: 17456 - RNA, 19 nt, artificial
  Chemically synthesized
ccgaggauguggacgagug

SEQ ID NO: 17457 - RNA, 19 nt, artificial
  Chemically synthesized
cugccugucugaggucaau

SEQ ID NO: 17458 - RNA, 19 nt, artificial
  Chemically synthesized
agccucaacggguacaagu

SEQ ID NO: 17459 - RNA, 19 nt, artificial
  Chemically synthesized
ccugugagguggcugcgca

SEQ ID NO: 17460 - RNA, 19 nt, artificial
  Chemically synthesized
ggccuggagacgggcaaca

SEQ ID NO: 17461 - RNA, 19 nt, artificial
  Chemically synthesized
auggcuaccugucagacgu

SEQ ID NO: 17462 - RNA, 19 nt, artificial
  Chemically synthesized
ccacgugguggaccgcaga

SEQ ID NO: 17463 - RNA, 19 nt, artificial
  Chemically synthesized
gggaccacaggacccaacu

SEQ ID NO: 17464 - RNA, 19 nt, artificial
  Chemically synthesized
agggugugcacugugagau

SEQ ID NO: 17465 - RNA, 19 nt, artificial
  Chemically synthesized
auagaguguaguuuacaga

SEQ ID NO: 17466 - RNA, 19 nt, artificial
  Chemically synthesized
cacggaggaagaaguccca

SEQ ID NO: 17467 - RNA, 19 nt, artificial
  Chemically synthesized
cucgcagugcuuccagagu

SEQ ID NO: 17468 - RNA, 19 nt, artificial
  Chemically synthesized
gcuggcagacccacaccca

SEQ ID NO: 17469 - RNA, 19 nt, artificial
  Chemically synthesized
gacagccagugcaacucag

SEQ ID NO: 17470 - RNA, 19 nt, artificial
  Chemically synthesized
gcaucugaaauaggaaaca

SEQ ID NO: 17471 - RNA, 19 nt, artificial
  Chemically synthesized
ccggcgcagcugcacuuca

SEQ ID NO: 17472 - RNA, 19 nt, artificial
  Chemically synthesized
gaagaacugcacgcagucu

SEQ ID NO: 17473 - RNA, 19 nt, artificial
  Chemically synthesized
cugcgcagcgacaaggugu

SEQ ID NO: 17474 - RNA, 19 nt, artificial
  Chemically synthesized
ucuuaaugaaugagucugu

SEQ ID NO: 17475 - RNA, 19 nt, artificial
  Chemically synthesized
gacuuuaaaagugaucuac

SEQ ID NO: 17476 - RNA, 19 nt, artificial
  Chemically synthesized
ccgccgugaacaaugugga

SEQ ID NO: 17477 - RNA, 19 nt, artificial
  Chemically synthesized
gacgucaacgagugcgucu

SEQ ID NO: 17478 - RNA, 19 nt, artificial
  Chemically synthesized
gucaacgagugcgucucga

SEQ ID NO: 17479 - RNA, 19 nt, artificial
  Chemically synthesized
gccucaacggguacaagug

SEQ ID NO: 17480 - RNA, 19 nt, artificial
  Chemically synthesized
aucaauggcugcaaaggca

SEQ ID NO: 17481 - RNA, 19 nt, artificial
  Chemically synthesized
agugagggacgucagacuu

SEQ ID NO: 17482 - RNA, 19 nt, artificial
  Chemically synthesized
cugcgugcagcgcgucaau

SEQ ID NO: 17483 - RNA, 19 nt, artificial
  Chemically synthesized
cugcaagaauggugccaag

SEQ ID NO: 17484 - RNA, 19 nt, artificial
  Chemically synthesized
ccagaguggacaggucagu

SEQ ID NO: 17485 - RNA, 19 nt, artificial
  Chemically synthesized
ggagagccgagccaggcag

SEQ ID NO: 17486 - RNA, 19 nt, artificial
  Chemically synthesized
gauggcacgacgccacuga

SEQ ID NO: 17487 - RNA, 19 nt, artificial
  Chemically synthesized
gagagcuccugcuucaacg

SEQ ID NO: 17488 - RNA, 19 nt, artificial
  Chemically synthesized
acuuacagaugcagcagca

SEQ ID NO: 17489 - RNA, 19 nt, artificial
  Chemically synthesized
gcggguucaucugcaagug

SEQ ID NO: 17490 - RNA, 19 nt, artificial
  Chemically synthesized
ccacugugagaacaacacg

SEQ ID NO: 17491 - RNA, 19 nt, artificial
  Chemically synthesized
ccgcuacucacgcucugau

SEQ ID NO: 17492 - RNA, 19 nt, artificial
  Chemically synthesized
gcauuccggaggccuucaa

SEQ ID NO: 17493 - RNA, 19 nt, artificial
  Chemically synthesized
gaggacuaugagagcuucu

SEQ ID NO: 17494 - RNA, 19 nt, artificial
  Chemically synthesized
cugcgaggacggcaucaau

SEQ ID NO: 17495 - RNA, 19 nt, artificial
  Chemically synthesized
gaggcaccugccacaacga

SEQ ID NO: 17496 - RNA, 19 nt, artificial
  Chemically synthesized
gcaucugugccaguacgau

SEQ ID NO: 17497 - RNA, 19 nt, artificial
  Chemically synthesized
ccugcaaagacaugaccag

SEQ ID NO: 17498 - RNA, 19 nt, artificial
  Chemically synthesized
gcgucugugugcgcucugu

SEQ ID NO: 17499 - RNA, 19 nt, artificial
  Chemically synthesized
cagugucugcagggcuaca

SEQ ID NO: 17500 - RNA, 19 nt, artificial
  Chemically synthesized
gccugcacuccucagggca

SEQ ID NO: 17501 - RNA, 19 nt, artificial
  Chemically synthesized
acuccucgccuguggacaa

SEQ ID NO: 17502 - RNA, 19 nt, artificial
  Chemically synthesized
ggccgaccagaggagccuu

SEQ ID NO: 17503 - RNA, 19 nt, artificial
  Chemically synthesized
caacggcggcaccugcaaa

SEQ ID NO: 17504 - RNA, 19 nt, artificial
  Chemically synthesized
ugugagcccacauccgaga

SEQ ID NO: 17505 - RNA, 19 nt, artificial
  Chemically synthesized
gugggcggcuacagcugca

SEQ ID NO: 17506 - RNA, 19 nt, artificial
  Chemically synthesized
ggacaucgaugagugcgac

SEQ ID NO: 17507 - RNA, 19 nt, artificial
  Chemically synthesized
ggcuucagcgggauccacu

SEQ ID NO: 17508 - RNA, 19 nt, artificial
  Chemically synthesized
ccguguuuuguaggagacu

SEQ ID NO: 17509 - RNA, 19 nt, artificial
  Chemically synthesized
guggcacccagaacugcgu

SEQ ID NO: 17510 - RNA, 19 nt, artificial
  Chemically synthesized
ccugcagccaggacgugga

SEQ ID NO: 17511 - RNA, 19 nt, artificial
  Chemically synthesized
cgacaccaacccugucaau

SEQ ID NO: 17512 - RNA, 19 nt, artificial
  Chemically synthesized
ucaucaacucacacgccga

SEQ ID NO: 17513 - RNA, 19 nt, artificial
  Chemically synthesized
gggcccugaauuucacugu

SEQ ID NO: 17514 - RNA, 19 nt, artificial
  Chemically synthesized
cuacaugaggaacuguaga

SEQ ID NO: 17515 - RNA, 19 nt, artificial
  Chemically synthesized
ucaauggcugcaaaggcaa

SEQ ID NO: 17516 - RNA, 19 nt, artificial
  Chemically synthesized
cagaacaacagggaggaga

SEQ ID NO: 17517 - RNA, 19 nt, artificial
  Chemically synthesized
cgcugacggaguacaagug

SEQ ID NO: 17518 - RNA, 19 nt, artificial
  Chemically synthesized
aacaaagauaugcagaaca

SEQ ID NO: 17519 - RNA, 19 nt, artificial
  Chemically synthesized
caaacaugagaugugugga

SEQ ID NO: 17520 - RNA, 19 nt, artificial
  Chemically synthesized
acaacgaggucggcuccua

SEQ ID NO: 17521 - RNA, 19 nt, artificial
  Chemically synthesized
ugcugugccaccucaacga

SEQ ID NO: 17522 - RNA, 19 nt, artificial
  Chemically synthesized
ccugcgagcaugcgggcaa

SEQ ID NO: 17523 - RNA, 19 nt, artificial
  Chemically synthesized
gcuacugccagcacgaugu

SEQ ID NO: 17524 - RNA, 19 nt, artificial
  Chemically synthesized
uuuagaugguuucuugcaa

SEQ ID NO: 17525 - RNA, 19 nt, artificial
  Chemically synthesized
gguggcuacaacugcgugu

SEQ ID NO: 17526 - RNA, 19 nt, artificial
  Chemically synthesized
gaugucaaugagugcgacu

SEQ ID NO: 17527 - RNA, 19 nt, artificial
  Chemically synthesized
gugccugccugccaggcuu

SEQ ID NO: 17528 - RNA, 19 nt, artificial
  Chemically synthesized
cccgcauuccggaggccuu

SEQ ID NO: 17529 - RNA, 19 nt, artificial
  Chemically synthesized
ggccagaagcccgggcuuu

SEQ ID NO: 17530 - RNA, 19 nt, artificial
  Chemically synthesized
acucacacgccgacgucaa

SEQ ID NO: 17531 - RNA, 19 nt, artificial
  Chemically synthesized
gcugcaacagcgcggagug

SEQ ID NO: 17532 - RNA, 19 nt, artificial
  Chemically synthesized
ccaacaucaacgagugugc

SEQ ID NO: 17533 - RNA, 19 nt, artificial
  Chemically synthesized
cucacgcugacggaguaca

SEQ ID NO: 17534 - RNA, 19 nt, artificial
  Chemically synthesized
cauccugccagaacaccca

SEQ ID NO: 17535 - RNA, 19 nt, artificial
  Chemically synthesized
cgaggacuaugagagcuuc

SEQ ID NO: 17536 - RNA, 19 nt, artificial
  Chemically synthesized
aaaggcaagcccugcaaga

SEQ ID NO: 17537 - RNA, 19 nt, artificial
  Chemically synthesized
acgagaccgccaaggugcu

SEQ ID NO: 17538 - RNA, 19 nt, artificial
  Chemically synthesized
aacaacaaugagugugaau

SEQ ID NO: 17539 - RNA, 19 nt, artificial
  Chemically synthesized
agugcucgcugggugccaa

SEQ ID NO: 17540 - RNA, 19 nt, artificial
  Chemically synthesized
cugccuggacaagaucaau

SEQ ID NO: 17541 - RNA, 19 nt, artificial
  Chemically synthesized
cccagguagaaacuuuuau

SEQ ID NO: 17542 - RNA, 19 nt, artificial
  Chemically synthesized
gguugacgccgacugcaug

SEQ ID NO: 17543 - RNA, 19 nt, artificial
  Chemically synthesized
ggcagccugcgcugccuca

SEQ ID NO: 17544 - RNA, 19 nt, artificial
  Chemically synthesized
cuuccuuucccaagccuuc

SEQ ID NO: 17545 - RNA, 19 nt, artificial
  Chemically synthesized
uucagaugcaaauuaaucc

SEQ ID NO: 17546 - RNA, 19 nt, artificial
  Chemically synthesized
uuuucuguaaacuacacuc

SEQ ID NO: 17547 - RNA, 19 nt, artificial
  Chemically synthesized
uaaguuuuguggcugcacc

SEQ ID NO: 17548 - RNA, 19 nt, artificial
  Chemically synthesized
uguucuggcaggaugcgcc

SEQ ID NO: 17549 - RNA, 19 nt, artificial
  Chemically synthesized
uucuucaggagcacaacug

SEQ ID NO: 17550 - RNA, 19 nt, artificial
  Chemically synthesized
ucaacuucccuucuccaac

SEQ ID NO: 17551 - RNA, 19 nt, artificial
  Chemically synthesized
ucuccacucaggaagcucc

SEQ ID NO: 17552 - RNA, 19 nt, artificial
  Chemically synthesized
uugauguuacacaugcucc

SEQ ID NO: 17553 - RNA, 19 nt, artificial
  Chemically synthesized
auuuuuucugccauaggcu

SEQ ID NO: 17554 - RNA, 19 nt, artificial
  Chemically synthesized
uuucuguaaacuacacucu

SEQ ID NO: 17555 - RNA, 19 nt, artificial
  Chemically synthesized
uugaucucgcaguuggguc

SEQ ID NO: 17556 - RNA, 19 nt, artificial
  Chemically synthesized
ucaaacugguggacccgcc

SEQ ID NO: 17557 - RNA, 19 nt, artificial
  Chemically synthesized
uucaggagcacaacugcgg

SEQ ID NO: 17558 - RNA, 19 nt, artificial
  Chemically synthesized
uguuugacaugcaugaugc

SEQ ID NO: 17559 - RNA, 19 nt, artificial
  Chemically synthesized
uuguacucguccagcagcc

SEQ ID NO: 17560 - RNA, 19 nt, artificial
  Chemically synthesized
uacugggugugggucugcc

SEQ ID NO: 17561 - RNA, 19 nt, artificial
  Chemically synthesized
uauugcaaaaaucugcucc

SEQ ID NO: 17562 - RNA, 19 nt, artificial
  Chemically synthesized
uguugcuggagcaucuucu

SEQ ID NO: 17563 - RNA, 19 nt, artificial
  Chemically synthesized
uaugcuuucacuuguuucc

SEQ ID NO: 17564 - RNA, 19 nt, artificial
  Chemically synthesized
aguuggucccacuccaccc

SEQ ID NO: 17565 - RNA, 19 nt, artificial
  Chemically synthesized
ugucuuugcaggugccgcc

SEQ ID NO: 17566 - RNA, 19 nt, artificial
  Chemically synthesized
uuugcugcugggcuugcgg

SEQ ID NO: 17567 - RNA, 19 nt, artificial
  Chemically synthesized
ucagaugcaaauuaauccg

SEQ ID NO: 17568 - RNA, 19 nt, artificial
  Chemically synthesized
auuuucacaagcaugcuug

SEQ ID NO: 17569 - RNA, 19 nt, artificial
  Chemically synthesized
ucggucucgcaguugcgcc

SEQ ID NO: 17570 - RNA, 19 nt, artificial
  Chemically synthesized
ucuggaugcagcuucuccu

SEQ ID NO: 17571 - RNA, 19 nt, artificial
  Chemically synthesized
ugcaucuguaaguuuugug

SEQ ID NO: 17572 - RNA, 19 nt, artificial
  Chemically synthesized
auaugauccgugauguccc

SEQ ID NO: 17573 - RNA, 19 nt, artificial
  Chemically synthesized
auggguuggacgcacacuc

SEQ ID NO: 17574 - RNA, 19 nt, artificial
  Chemically synthesized
ugaucucgcaguugggucc

SEQ ID NO: 17575 - RNA, 19 nt, artificial
  Chemically synthesized
uguucucacaguggauccc

SEQ ID NO: 17576 - RNA, 19 nt, artificial
  Chemically synthesized
uuacagacauuuuuucugc

SEQ ID NO: 17577 - RNA, 19 nt, artificial
  Chemically synthesized
uuggugucgcaguuggagc

SEQ ID NO: 17578 - RNA, 19 nt, artificial
  Chemically synthesized
ugagccaagucugacgucc

SEQ ID NO: 17579 - RNA, 19 nt, artificial
  Chemically synthesized
ucaucaauguucucgcugc

SEQ ID NO: 17580 - RNA, 19 nt, artificial
  Chemically synthesized
uacugaaccugaaacaaag

SEQ ID NO: 17581 - RNA, 19 nt, artificial
  Chemically synthesized
cauucuugcagggcuugcc

SEQ ID NO: 17582 - RNA, 19 nt, artificial
  Chemically synthesized
auaauacugaaccugaaac

SEQ ID NO: 17583 - RNA, 19 nt, artificial
  Chemically synthesized
uucucacaguggaucccgc

SEQ ID NO: 17584 - RNA, 19 nt, artificial
  Chemically synthesized
uuggcauacacacuccgag

SEQ ID NO: 17585 - RNA, 19 nt, artificial
  Chemically synthesized
uugcggaccuucuugcccu

SEQ ID NO: 17586 - RNA, 19 nt, artificial
  Chemically synthesized
uuuuguggcugcaccugcu

SEQ ID NO: 17587 - RNA, 19 nt, artificial
  Chemically synthesized
aacucauugaucuugucca

SEQ ID NO: 17588 - RNA, 19 nt, artificial
  Chemically synthesized
cguucaacuucccuucucc

SEQ ID NO: 17589 - RNA, 19 nt, artificial
  Chemically synthesized
uuggucucgcagugguggc

SEQ ID NO: 17590 - RNA, 19 nt, artificial
  Chemically synthesized
ucguugauguuggucucgc

SEQ ID NO: 17591 - RNA, 19 nt, artificial
  Chemically synthesized
ucggauugccugcacuccc

SEQ ID NO: 17592 - RNA, 19 nt, artificial
  Chemically synthesized
uugaagaccacguuggugu

SEQ ID NO: 17593 - RNA, 19 nt, artificial
  Chemically synthesized
ucgaccucacaggucugcc

SEQ ID NO: 17594 - RNA, 19 nt, artificial
  Chemically synthesized
ugcuggagcaucuucuucg

SEQ ID NO: 17595 - RNA, 19 nt, artificial
  Chemically synthesized
aaggguuggauucacacuc

SEQ ID NO: 17596 - RNA, 19 nt, artificial
  Chemically synthesized
ugaccauucaaacuggugg

SEQ ID NO: 17597 - RNA, 19 nt, artificial
  Chemically synthesized
uugcacagcucaaugugcc

SEQ ID NO: 17598 - RNA, 19 nt, artificial
  Chemically synthesized
aacagaagcacaaaggcgg

SEQ ID NO: 17599 - RNA, 19 nt, artificial
  Chemically synthesized
uuggcggucucguagcugc

SEQ ID NO: 17600 - RNA, 19 nt, artificial
  Chemically synthesized
uuggugugcagcacgcggc

SEQ ID NO: 17601 - RNA, 19 nt, artificial
  Chemically synthesized
ugggccagucucaaaggcc

SEQ ID NO: 17602 - RNA, 19 nt, artificial
  Chemically synthesized
ucacaguuggucccacucc

SEQ ID NO: 17603 - RNA, 19 nt, artificial
  Chemically synthesized
uaaaaaucaacaucuuggg

SEQ ID NO: 17604 - RNA, 19 nt, artificial
  Chemically synthesized
aagaacagaagcacaaagg

SEQ ID NO: 17605 - RNA, 19 nt, artificial
  Chemically synthesized
acagccacucgcauugacc

SEQ ID NO: 17606 - RNA, 19 nt, artificial
  Chemically synthesized
ugcuguugcacucauugac

SEQ ID NO: 17607 - RNA, 19 nt, artificial
  Chemically synthesized
ucacugaaguacuuccagc

SEQ ID NO: 17608 - RNA, 19 nt, artificial
  Chemically synthesized
uucugccauaggcuauacu

SEQ ID NO: 17609 - RNA, 19 nt, artificial
  Chemically synthesized
ugauguuggucucgcagug

SEQ ID NO: 17610 - RNA, 19 nt, artificial
  Chemically synthesized
acuucuuggucuccagguc

SEQ ID NO: 17611 - RNA, 19 nt, artificial
  Chemically synthesized
ucaggcguguuguucucac

SEQ ID NO: 17612 - RNA, 19 nt, artificial
  Chemically synthesized
uaugcucguucaacuuccc

SEQ ID NO: 17613 - RNA, 19 nt, artificial
  Chemically synthesized
ucguugacgucgaucucgc

SEQ ID NO: 17614 - RNA, 19 nt, artificial
  Chemically synthesized
cagucaucaauguucucgc

SEQ ID NO: 17615 - RNA, 19 nt, artificial
  Chemically synthesized
ucauuguuguugaugucac

SEQ ID NO: 17616 - RNA, 19 nt, artificial
  Chemically synthesized
agaacuugcuuguuuucuc

SEQ ID NO: 17617 - RNA, 19 nt, artificial
  Chemically synthesized
uacccuuccgugcacacac

SEQ ID NO: 17618 - RNA, 19 nt, artificial
  Chemically synthesized
ucauaguccucggauugcc

SEQ ID NO: 17619 - RNA, 19 nt, artificial
  Chemically synthesized
ugguugugcaggcuggcgc

SEQ ID NO: 17620 - RNA, 19 nt, artificial
  Chemically synthesized
uucaugauugguaccaugg

SEQ ID NO: 17621 - RNA, 19 nt, artificial
  Chemically synthesized
uuguugaugucacaguugg

SEQ ID NO: 17622 - RNA, 19 nt, artificial
  Chemically synthesized
cuucuuggucuccaggucc

SEQ ID NO: 17623 - RNA, 19 nt, artificial
  Chemically synthesized
acagucaucaauguucucg

SEQ ID NO: 17624 - RNA, 19 nt, artificial
  Chemically synthesized
ucguccacaucguacuggc

SEQ ID NO: 17625 - RNA, 19 nt, artificial
  Chemically synthesized
ugagggagcagucaccgcc

SEQ ID NO: 17626 - RNA, 19 nt, artificial
  Chemically synthesized
uugauguuggucucgcagu

SEQ ID NO: 17627 - RNA, 19 nt, artificial
  Chemically synthesized
uuugacaugcaugaugccu

SEQ ID NO: 17628 - RNA, 19 nt, artificial
  Chemically synthesized
acucgcaguagaaggaggc

SEQ ID NO: 17629 - RNA, 19 nt, artificial
  Chemically synthesized
ugaucucacagugcacacc

SEQ ID NO: 17630 - RNA, 19 nt, artificial
  Chemically synthesized
aaaaucaacaucuugggac

SEQ ID NO: 17631 - RNA, 19 nt, artificial
  Chemically synthesized
uucacacucauuguuguug

SEQ ID NO: 17632 - RNA, 19 nt, artificial
  Chemically synthesized
uugaccauucaaacuggug

SEQ ID NO: 17633 - RNA, 19 nt, artificial
  Chemically synthesized
uacauaauacugaaccuga

SEQ ID NO: 17634 - RNA, 19 nt, artificial
  Chemically synthesized
uugcgggacagcagcaccc

SEQ ID NO: 17635 - RNA, 19 nt, artificial
  Chemically synthesized
uuggucuggcaguugggac

SEQ ID NO: 17636 - RNA, 19 nt, artificial
  Chemically synthesized
ucugucugguugugcaggc

SEQ ID NO: 17637 - RNA, 19 nt, artificial
  Chemically synthesized
ucauugaucuuguccaggc

SEQ ID NO: 17638 - RNA, 19 nt, artificial
  Chemically synthesized
ucguugauguuggucuggc

SEQ ID NO: 17639 - RNA, 19 nt, artificial
  Chemically synthesized
ucuguaaguuuuguggcug

SEQ ID NO: 17640 - RNA, 19 nt, artificial
  Chemically synthesized
aagucuccuacaaaacacg

SEQ ID NO: 17641 - RNA, 19 nt, artificial
  Chemically synthesized
cacucguugauguuggucu

SEQ ID NO: 17642 - RNA, 19 nt, artificial
  Chemically synthesized
ucaucgauguugauguuac

SEQ ID NO: 17643 - RNA, 19 nt, artificial
  Chemically synthesized
auucucacacguggcgccc

SEQ ID NO: 17644 - RNA, 19 nt, artificial
  Chemically synthesized
aucuuguccagacaggugc

SEQ ID NO: 17645 - RNA, 19 nt, artificial
  Chemically synthesized
ugcacuggcugucacagug

SEQ ID NO: 17646 - RNA, 19 nt, artificial
  Chemically synthesized
uccucagagcaguucaccc

SEQ ID NO: 17647 - RNA, 19 nt, artificial
  Chemically synthesized
uugaugacggacucgcagc

SEQ ID NO: 17648 - RNA, 19 nt, artificial
  Chemically synthesized
uuuacuugaaggccuccgg

SEQ ID NO: 17649 - RNA, 19 nt, artificial
  Chemically synthesized
augcuugcaagaaaccauc

SEQ ID NO: 17650 - RNA, 19 nt, artificial
  Chemically synthesized
uccgagaacacauuuucac

SEQ ID NO: 17651 - RNA, 19 nt, artificial
  Chemically synthesized
uacagacauuuuuucugcc

SEQ ID NO: 17652 - RNA, 19 nt, artificial
  Chemically synthesized
uguuggucucgcaguggug

SEQ ID NO: 17653 - RNA, 19 nt, artificial
  Chemically synthesized
uucccuucuccaacaucau

SEQ ID NO: 17654 - RNA, 19 nt, artificial
  Chemically synthesized
augauugguaccaugggug

SEQ ID NO: 17655 - RNA, 19 nt, artificial
  Chemically synthesized
auguugauguuacacaugc

SEQ ID NO: 17656 - RNA, 19 nt, artificial
  Chemically synthesized
ugguauugcaaaaaucugc

SEQ ID NO: 17657 - RNA, 19 nt, artificial
  Chemically synthesized
ugccauaggcuauacuugg

SEQ ID NO: 17658 - RNA, 19 nt, artificial
  Chemically synthesized
uccagcagcaccuuggcgg

SEQ ID NO: 17659 - RNA, 19 nt, artificial
  Chemically synthesized
ucuuccucgcuguugcccg

SEQ ID NO: 17660 - RNA, 19 nt, artificial
  Chemically synthesized
aacuucuuggucuccaggu

SEQ ID NO: 17661 - RNA, 19 nt, artificial
  Chemically synthesized
ucauugaccucagacaggc

SEQ ID NO: 17662 - RNA, 19 nt, artificial
  Chemically synthesized
ucacaggucugcccuugcc

SEQ ID NO: 17663 - RNA, 19 nt, artificial
  Chemically synthesized
uguguuuuaaaaaggcucc

SEQ ID NO: 17664 - RNA, 19 nt, artificial
  Chemically synthesized
uuaauccgcgugcggaagg

SEQ ID NO: 17665 - RNA, 19 nt, artificial
  Chemically synthesized
uuguuguugaugucacagu

SEQ ID NO: 17666 - RNA, 19 nt, artificial
  Chemically synthesized
aacugguggacccgcccac

SEQ ID NO: 17667 - RNA, 19 nt, artificial
  Chemically synthesized
aguuguagguguucacgcc

SEQ ID NO: 17668 - RNA, 19 nt, artificial
  Chemically synthesized
ucgcauugaccauucaaac

SEQ ID NO: 17669 - RNA, 19 nt, artificial
  Chemically synthesized
acucguugauguuggucuc

SEQ ID NO: 17670 - RNA, 19 nt, artificial
  Chemically synthesized
auguuugacaugcaugaug

SEQ ID NO: 17671 - RNA, 19 nt, artificial
  Chemically synthesized
uucuggagggaccaagaac

SEQ ID NO: 17672 - RNA, 19 nt, artificial
  Chemically synthesized
uucuuggucuccagguccu

SEQ ID NO: 17673 - RNA, 19 nt, artificial
  Chemically synthesized
ucuucaggagcacaacugc

SEQ ID NO: 17674 - RNA, 19 nt, artificial
  Chemically synthesized
ucgucgaugucggucucgc

SEQ ID NO: 17675 - RNA, 19 nt, artificial
  Chemically synthesized
ucaucuacggcguugacgu

SEQ ID NO: 17676 - RNA, 19 nt, artificial
  Chemically synthesized
ucuggaagacaccuugugc

SEQ ID NO: 17677 - RNA, 19 nt, artificial
  Chemically synthesized
uugcacucauugaccucag

SEQ ID NO: 17678 - RNA, 19 nt, artificial
  Chemically synthesized
uguaaguguuggguccguc

SEQ ID NO: 17679 - RNA, 19 nt, artificial
  Chemically synthesized
auacacacuccgagaacac

SEQ ID NO: 17680 - RNA, 19 nt, artificial
  Chemically synthesized
uugacaugcaugaugccua

SEQ ID NO: 17681 - RNA, 19 nt, artificial
  Chemically synthesized
uagccaucgaucuugucca

SEQ ID NO: 17682 - RNA, 19 nt, artificial
  Chemically synthesized
uggucuggcaguugggacc

SEQ ID NO: 17683 - RNA, 19 nt, artificial
  Chemically synthesized
uuugccucuggaugcagcu

SEQ ID NO: 17684 - RNA, 19 nt, artificial
  Chemically synthesized
uccugggacuucuuccucc

SEQ ID NO: 17685 - RNA, 19 nt, artificial
  Chemically synthesized
ucgaagggcaggcacuggc

SEQ ID NO: 17686 - RNA, 19 nt, artificial
  Chemically synthesized
ucccacuccacccaggguc

SEQ ID NO: 17687 - RNA, 19 nt, artificial
  Chemically synthesized
augaagucggagaugacgg

SEQ ID NO: 17688 - RNA, 19 nt, artificial
  Chemically synthesized
cuacauaauacugaaccug

SEQ ID NO: 17689 - RNA, 19 nt, artificial
  Chemically synthesized
ucgauguugauguuacaca

SEQ ID NO: 17690 - RNA, 19 nt, artificial
  Chemically synthesized
cauucaaacugguggaccc

SEQ ID NO: 17691 - RNA, 19 nt, artificial
  Chemically synthesized
gaacucauugaucuugucc

SEQ ID NO: 17692 - RNA, 19 nt, artificial
  Chemically synthesized
auucuugcagggcuugccu

SEQ ID NO: 17693 - RNA, 19 nt, artificial
  Chemically synthesized
uucaaacugguggacccgc

SEQ ID NO: 17694 - RNA, 19 nt, artificial
  Chemically synthesized
ugcuccgcacaguccagcc

SEQ ID NO: 17695 - RNA, 19 nt, artificial
  Chemically synthesized
cauucucacacguggcgcc

SEQ ID NO: 17696 - RNA, 19 nt, artificial
  Chemically synthesized
ugcugcuggauguuugcug

SEQ ID NO: 17697 - RNA, 19 nt, artificial
  Chemically synthesized
uguuguggcaggucccgcc

SEQ ID NO: 17698 - RNA, 19 nt, artificial
  Chemically synthesized
ucgcacuccgcgcuguugc

SEQ ID NO: 17699 - RNA, 19 nt, artificial
  Chemically synthesized
auuguuguugaugucacag

SEQ ID NO: 17700 - RNA, 19 nt, artificial
  Chemically synthesized
uugcacugcaggcugcaga

SEQ ID NO: 17701 - RNA, 19 nt, artificial
  Chemically synthesized
ugaguugaugagguccucc

SEQ ID NO: 17702 - RNA, 19 nt, artificial
  Chemically synthesized
ugggacugcaugcuggugg

SEQ ID NO: 17703 - RNA, 19 nt, artificial
  Chemically synthesized
ucugccagcauuugccgcc

SEQ ID NO: 17704 - RNA, 19 nt, artificial
  Chemically synthesized
auauuuuccucacaguucu

SEQ ID NO: 17705 - RNA, 19 nt, artificial
  Chemically synthesized
acuccgagaacacauuuuc

SEQ ID NO: 17706 - RNA, 19 nt, artificial
  Chemically synthesized
uagggcagcaggcaguugc

SEQ ID NO: 17707 - RNA, 19 nt, artificial
  Chemically synthesized
augucuuugcaggugccgc

SEQ ID NO: 17708 - RNA, 19 nt, artificial
  Chemically synthesized
agaugcaaauuaauccgcg

SEQ ID NO: 17709 - RNA, 19 nt, artificial
  Chemically synthesized
uuugcuggcugcagguucu

SEQ ID NO: 17710 - RNA, 19 nt, artificial
  Chemically synthesized
uuguccagacaggugcccg

SEQ ID NO: 17711 - RNA, 19 nt, artificial
  Chemically synthesized
uugaaguugagggagcagu

SEQ ID NO: 17712 - RNA, 19 nt, artificial
  Chemically synthesized
uugaucucacagugcacac

SEQ ID NO: 17713 - RNA, 19 nt, artificial
  Chemically synthesized
uguggcugcaccugcuggg

SEQ ID NO: 17714 - RNA, 19 nt, artificial
  Chemically synthesized
aacugggcugcggucacgg

SEQ ID NO: 17715 - RNA, 19 nt, artificial
  Chemically synthesized
uggugucgcaguuggagcc

SEQ ID NO: 17716 - RNA, 19 nt, artificial
  Chemically synthesized
uguugaugcacuugcccgc

SEQ ID NO: 17717 - RNA, 19 nt, artificial
  Chemically synthesized
aucuguaaguuuuguggcu

SEQ ID NO: 17718 - RNA, 19 nt, artificial
  Chemically synthesized
aacccuggcucucagaacu

SEQ ID NO: 17719 - RNA, 19 nt, artificial
  Chemically synthesized
augucgaccucacaggucu

SEQ ID NO: 17720 - RNA, 19 nt, artificial
  Chemically synthesized
aucaggaucuggaagacac

SEQ ID NO: 17721 - RNA, 19 nt, artificial
  Chemically synthesized
aaguuuuguggcugcaccu

SEQ ID NO: 17722 - RNA, 19 nt, artificial
  Chemically synthesized
auguguuuuaaaaaggcuc

SEQ ID NO: 17723 - RNA, 19 nt, artificial
  Chemically synthesized
ucguccacguugaucucac

SEQ ID NO: 17724 - RNA, 19 nt, artificial
  Chemically synthesized
cguucuugcaguuguuucc

SEQ ID NO: 17725 - RNA, 19 nt, artificial
  Chemically synthesized
uuuuuucugccauaggcua

SEQ ID NO: 17726 - RNA, 19 nt, artificial
  Chemically synthesized
ugguucuggagggaccaag

SEQ ID NO: 17727 - RNA, 19 nt, artificial
  Chemically synthesized
ucuggagggaccaagaacu

SEQ ID NO: 17728 - RNA, 19 nt, artificial
  Chemically synthesized
ucugaagcguucuucaggg

SEQ ID NO: 17729 - RNA, 19 nt, artificial
  Chemically synthesized
caucuguaaguuuuguggc

SEQ ID NO: 17730 - RNA, 19 nt, artificial
  Chemically synthesized
acacucgucuguguugacc

SEQ ID NO: 17731 - RNA, 19 nt, artificial
  Chemically synthesized
uuccggaucaggaucugga

SEQ ID NO: 17732 - RNA, 19 nt, artificial
  Chemically synthesized
ucaauguucucgcugcagu

SEQ ID NO: 17733 - RNA, 19 nt, artificial
  Chemically synthesized
uucaacuucccuucuccaa

SEQ ID NO: 17734 - RNA, 19 nt, artificial
  Chemically synthesized
uacuccgucagcgugagca

SEQ ID NO: 17735 - RNA, 19 nt, artificial
  Chemically synthesized
cauucaggcaggucucacc

SEQ ID NO: 17736 - RNA, 19 nt, artificial
  Chemically synthesized
cuaugcucguucaacuucc

SEQ ID NO: 17737 - RNA, 19 nt, artificial
  Chemically synthesized
ugucaaucuccagguagac

SEQ ID NO: 17738 - RNA, 19 nt, artificial
  Chemically synthesized
uacaguacugaccugucca

SEQ ID NO: 17739 - RNA, 19 nt, artificial
  Chemically synthesized
uugcgcagcugcuccggcg

SEQ ID NO: 17740 - RNA, 19 nt, artificial
  Chemically synthesized
ucuuggcauacacacuccg

SEQ ID NO: 17741 - RNA, 19 nt, artificial
  Chemically synthesized
uuuuucugccauaggcuau

SEQ ID NO: 17742 - RNA, 19 nt, artificial
  Chemically synthesized
uuccucauguagaucacuu

SEQ ID NO: 17743 - RNA, 19 nt, artificial
  Chemically synthesized
ugucugguugugcaggcug

SEQ ID NO: 17744 - RNA, 19 nt, artificial
  Chemically synthesized
auuuuccucacaguucugg

SEQ ID NO: 17745 - RNA, 19 nt, artificial
  Chemically synthesized
auguucucgcugcaguccu

SEQ ID NO: 17746 - RNA, 19 nt, artificial
  Chemically synthesized
uuguugcacugcaggcugc

SEQ ID NO: 17747 - RNA, 19 nt, artificial
  Chemically synthesized
uuucugccauaggcuauac

SEQ ID NO: 17748 - RNA, 19 nt, artificial
  Chemically synthesized
acuugcaggaguagccgcc

SEQ ID NO: 17749 - RNA, 19 nt, artificial
  Chemically synthesized
ugaaguacuuccagcacug

SEQ ID NO: 17750 - RNA, 19 nt, artificial
  Chemically synthesized
augucggucucgcaguugc

SEQ ID NO: 17751 - RNA, 19 nt, artificial
  Chemically synthesized
uuugccuccguuugccucu

SEQ ID NO: 17752 - RNA, 19 nt, artificial
  Chemically synthesized
ucaucaucugggacagggc

SEQ ID NO: 17753 - RNA, 19 nt, artificial
  Chemically synthesized
aaggugagccagcuuugcc

SEQ ID NO: 17754 - RNA, 19 nt, artificial
  Chemically synthesized
uuuggcaucagcuggcacu

SEQ ID NO: 17755 - RNA, 19 nt, artificial
  Chemically synthesized
uguugcacucauugaccuc

SEQ ID NO: 17756 - RNA, 19 nt, artificial
  Chemically synthesized
ugaaguugagggagcaguc

SEQ ID NO: 17757 - RNA, 19 nt, artificial
  Chemically synthesized
aguacugaccuguccacuc

SEQ ID NO: 17758 - RNA, 19 nt, artificial
  Chemically synthesized
aaggcuacugugcagcggg

SEQ ID NO: 17759 - RNA, 19 nt, artificial
  Chemically synthesized
uugcacuggcugucacagu

SEQ ID NO: 17760 - RNA, 19 nt, artificial
  Chemically synthesized
uuggauucacacucauugu

SEQ ID NO: 17761 - RNA, 19 nt, artificial
  Chemically synthesized
ucaugucuuugcaggugcc

SEQ ID NO: 17762 - RNA, 19 nt, artificial
  Chemically synthesized
aucuuguccaggcagcggc

SEQ ID NO: 17763 - RNA, 19 nt, artificial
  Chemically synthesized
ugcgucacgcuugaagacc

SEQ ID NO: 17764 - RNA, 19 nt, artificial
  Chemically synthesized
auacaucaucuacaguucc

SEQ ID NO: 17765 - RNA, 19 nt, artificial
  Chemically synthesized
uucuugcagggcuugccuu

SEQ ID NO: 17766 - RNA, 19 nt, artificial
  Chemically synthesized
ucaucgauguccaccucgc

SEQ ID NO: 17767 - RNA, 19 nt, artificial
  Chemically synthesized
uuggcaccauucuugcagg

SEQ ID NO: 17768 - RNA, 19 nt, artificial
  Chemically synthesized
ugguccagcagcaccuugg

SEQ ID NO: 17769 - RNA, 19 nt, artificial
  Chemically synthesized
uagccgcccagguaguccg

SEQ ID NO: 17770 - RNA, 19 nt, artificial
  Chemically synthesized
aauacaucaucuacaguuc

SEQ ID NO: 17771 - RNA, 19 nt, artificial
  Chemically synthesized
ugguagcucaucaucuggg

SEQ ID NO: 17772 - RNA, 19 nt, artificial
  Chemically synthesized
acaaucgucgauauuuucc

SEQ ID NO: 17773 - RNA, 19 nt, artificial
  Chemically synthesized
auugguaccaugggugcac

SEQ ID NO: 17774 - RNA, 19 nt, artificial
  Chemically synthesized
uucucgcugcaguccucac

SEQ ID NO: 17775 - RNA, 19 nt, artificial
  Chemically synthesized
cauuuuuucugccauaggc

SEQ ID NO: 17776 - RNA, 19 nt, artificial
  Chemically synthesized
uugcuggagcaucuucuuc

SEQ ID NO: 17777 - RNA, 19 nt, artificial
  Chemically synthesized
agucugacgucccucacug

SEQ ID NO: 17778 - RNA, 19 nt, artificial
  Chemically synthesized
ucucacagugcacacccug

SEQ ID NO: 17779 - RNA, 19 nt, artificial
  Chemically synthesized
uuuguggcugcaccugcug

SEQ ID NO: 17780 - RNA, 19 nt, artificial
  Chemically synthesized
agggcuugccuuugcagcc

SEQ ID NO: 17781 - RNA, 19 nt, artificial
  Chemically synthesized
aucuggaagacaccuugug

SEQ ID NO: 17782 - RNA, 19 nt, artificial
  Chemically synthesized
gaucucacagugcacaccc

SEQ ID NO: 17783 - RNA, 19 nt, artificial
  Chemically synthesized
uguugauguuacacaugcu

SEQ ID NO: 17784 - RNA, 19 nt, artificial
  Chemically synthesized
ugcagaugcacuggaacuc

SEQ ID NO: 17785 - RNA, 19 nt, artificial
  Chemically synthesized
aaggcuugggaaaggaagc

SEQ ID NO: 17786 - RNA, 19 nt, artificial
  Chemically synthesized
aguggcugcacgucugccu

SEQ ID NO: 17787 - RNA, 19 nt, artificial
  Chemically synthesized
uucuguaaacuacacucua

SEQ ID NO: 17788 - RNA, 19 nt, artificial
  Chemically synthesized
uccuccucacagaaagugc

SEQ ID NO: 17789 - RNA, 19 nt, artificial
  Chemically synthesized
acggucucacucugcacgg

SEQ ID NO: 17790 - RNA, 19 nt, artificial
  Chemically synthesized
uggcugcugagcucacgcc

SEQ ID NO: 17791 - RNA, 19 nt, artificial
  Chemically synthesized
ugguuguugcacugcaggc

SEQ ID NO: 17792 - RNA, 19 nt, artificial
  Chemically synthesized
augaugccuacauuucaag

SEQ ID NO: 17793 - RNA, 19 nt, artificial
  Chemically synthesized
ugcugcugaguccacugcc

SEQ ID NO: 17794 - RNA, 19 nt, artificial
  Chemically synthesized
cacucguugacauccugcc

SEQ ID NO: 17795 - RNA, 19 nt, artificial
  Chemically synthesized
uugaucuuguccaggcagc

SEQ ID NO: 17796 - RNA, 19 nt, artificial
  Chemically synthesized
acucauugaccucagacag

SEQ ID NO: 17797 - RNA, 19 nt, artificial
  Chemically synthesized
uguucucgcugcaguccuc

SEQ ID NO: 17798 - RNA, 19 nt, artificial
  Chemically synthesized
auaugcuuucacuuguuuc

SEQ ID NO: 17799 - RNA, 19 nt, artificial
  Chemically synthesized
acuggcacucgaaggagcc

SEQ ID NO: 17800 - RNA, 19 nt, artificial
  Chemically synthesized
acugcgugcaguucuucca

SEQ ID NO: 17801 - RNA, 19 nt, artificial
  Chemically synthesized
uuggccgccacguucaggu

SEQ ID NO: 17802 - RNA, 19 nt, artificial
  Chemically synthesized
cuucccuucuccaacauca

SEQ ID NO: 17803 - RNA, 19 nt, artificial
  Chemically synthesized
acgucgucaauacacgugc

SEQ ID NO: 17804 - RNA, 19 nt, artificial
  Chemically synthesized
uugaagcaggagcucucug

SEQ ID NO: 17805 - RNA, 19 nt, artificial
  Chemically synthesized
uugacaggguuggugucgc

SEQ ID NO: 17806 - RNA, 19 nt, artificial
  Chemically synthesized
ugaggcugcccagguagcc

SEQ ID NO: 17807 - RNA, 19 nt, artificial
  Chemically synthesized
uugcagccauugaugacgg

SEQ ID NO: 17808 - RNA, 19 nt, artificial
  Chemically synthesized
acugccgguugucaaucuc

SEQ ID NO: 17809 - RNA, 19 nt, artificial
  Chemically synthesized
agcaaggcuacugugcagc

SEQ ID NO: 17810 - RNA, 19 nt, artificial
  Chemically synthesized
uugucaaucuccagguaga

SEQ ID NO: 17811 - RNA, 19 nt, artificial
  Chemically synthesized
uaguccucggauugccugc

SEQ ID NO: 17812 - RNA, 19 nt, artificial
  Chemically synthesized
uugucguccaugagggcac

SEQ ID NO: 17813 - RNA, 19 nt, artificial
  Chemically synthesized
ucugacgucccucacuggc

SEQ ID NO: 17814 - RNA, 19 nt, artificial
  Chemically synthesized
uaggcuauacuugguauug

SEQ ID NO: 17815 - RNA, 19 nt, artificial
  Chemically synthesized
uuugccgccguucuugcag

SEQ ID NO: 17816 - RNA, 19 nt, artificial
  Chemically synthesized
ucccucacuggcaugacac

SEQ ID NO: 17817 - RNA, 19 nt, artificial
  Chemically synthesized
uggucucgcagugguggcc

SEQ ID NO: 17818 - RNA, 19 nt, artificial
  Chemically synthesized
auucaugauugguaccaug

SEQ ID NO: 17819 - RNA, 19 nt, artificial
  Chemically synthesized
agaacuuguauaaccaacg

SEQ ID NO: 17820 - RNA, 19 nt, artificial
  Chemically synthesized
uaaaaaggcuccucugguc

SEQ ID NO: 17821 - RNA, 19 nt, artificial
  Chemically synthesized
guuguucucacaguggauc

SEQ ID NO: 17822 - RNA, 19 nt, artificial
  Chemically synthesized
ucguugaugucgaccucac

SEQ ID NO: 17823 - RNA, 19 nt, artificial
  Chemically synthesized
acuucccuucuccaacauc

SEQ ID NO: 17824 - RNA, 19 nt, artificial
  Chemically synthesized
caauguucucgcugcaguc

SEQ ID NO: 17825 - RNA, 19 nt, artificial
  Chemically synthesized
ucagacacuuugaagcccu

SEQ ID NO: 17826 - RNA, 19 nt, artificial
  Chemically synthesized
agagacugcgugcaguucu

SEQ ID NO: 17827 - RNA, 19 nt, artificial
  Chemically synthesized
uggaacucauugaucuugu

SEQ ID NO: 17828 - RNA, 19 nt, artificial
  Chemically synthesized
acuacauaauacugaaccu

SEQ ID NO: 17829 - RNA, 19 nt, artificial
  Chemically synthesized
aucuucuucggaaccuggg

SEQ ID NO: 17830 - RNA, 19 nt, artificial
  Chemically synthesized
ucucauaguccucggauug

SEQ ID NO: 17831 - RNA, 19 nt, artificial
  Chemically synthesized
cuugcggaccuucuugccc

SEQ ID NO: 17832 - RNA, 19 nt, artificial
  Chemically synthesized
ugcucguucaacuucccuu

SEQ ID NO: 17833 - RNA, 19 nt, artificial
  Chemically synthesized
cucuggaugcagcuucucc

SEQ ID NO: 17834 - RNA, 19 nt, artificial
  Chemically synthesized
auguuguccuggauguugg

SEQ ID NO: 17835 - RNA, 19 nt, artificial
  Chemically synthesized
uuguucacggcggcggccc

SEQ ID NO: 17836 - RNA, 19 nt, artificial
  Chemically synthesized
uaacccauaugcuuucacu

SEQ ID NO: 17837 - RNA, 19 nt, artificial
  Chemically synthesized
acucguugauguuggucug

SEQ ID NO: 17838 - RNA, 19 nt, artificial
  Chemically synthesized
ugugacccaggcaagugcc

SEQ ID NO: 17839 - RNA, 19 nt, artificial
  Chemically synthesized
uuuucacaagcaugcuugc

SEQ ID NO: 17840 - RNA, 19 nt, artificial
  Chemically synthesized
aguugagggagcagucacc

SEQ ID NO: 17841 - RNA, 19 nt, artificial
  Chemically synthesized
cacggucucacucugcacg

SEQ ID NO: 17842 - RNA, 19 nt, artificial
  Chemically synthesized
aagcaugcuugcaagaaac

SEQ ID NO: 17843 - RNA, 19 nt, artificial
  Chemically synthesized
uggcggucucguagcugcc

SEQ ID NO: 17844 - RNA, 19 nt, artificial
  Chemically synthesized
ugcgucggcagacacagcc

SEQ ID NO: 17845 - RNA, 19 nt, artificial
  Chemically synthesized
uuuucugccauaggcuaua

SEQ ID NO: 17846 - RNA, 19 nt, artificial
  Chemically synthesized
ugggugagcacucguccac

SEQ ID NO: 17847 - RNA, 19 nt, artificial
  Chemically synthesized
uguggcucgguuccggauc

SEQ ID NO: 17848 - RNA, 19 nt, artificial
  Chemically synthesized
aaaggguaggaugccuccg

SEQ ID NO: 17849 - RNA, 19 nt, artificial
  Chemically synthesized
aucugggacugcaugcugg

SEQ ID NO: 17850 - RNA, 19 nt, artificial
  Chemically synthesized
ucaggagcacaacugcggc

SEQ ID NO: 17851 - RNA, 19 nt, artificial
  Chemically synthesized
uuggucccacuccacccag

SEQ ID NO: 17852 - RNA, 19 nt, artificial
  Chemically synthesized
ucaggaucuggaagacacc

SEQ ID NO: 17853 - RNA, 19 nt, artificial
  Chemically synthesized
aacugcggcauccacauug

SEQ ID NO: 17854 - RNA, 19 nt, artificial
  Chemically synthesized
aaguggaaggagcuguugc

SEQ ID NO: 17855 - RNA, 19 nt, artificial
  Chemically synthesized
cagugcacaagguucuggc

SEQ ID NO: 17856 - RNA, 19 nt, artificial
  Chemically synthesized
ucgucgaucuccucagagc

SEQ ID NO: 17857 - RNA, 19 nt, artificial
  Chemically synthesized
uuggagcccucguuacagg

SEQ ID NO: 17858 - RNA, 19 nt, artificial
  Chemically synthesized
guuggauucacacucauug

SEQ ID NO: 17859 - RNA, 19 nt, artificial
  Chemically synthesized
ucauugaaguugagggagc

SEQ ID NO: 17860 - RNA, 19 nt, artificial
  Chemically synthesized
uaccaugccaugcugcagg

SEQ ID NO: 17861 - RNA, 19 nt, artificial
  Chemically synthesized
cacuggaacucauugaucu

SEQ ID NO: 17862 - RNA, 19 nt, artificial
  Chemically synthesized
uuaaaaaggcuccucuggu

SEQ ID NO: 17863 - RNA, 19 nt, artificial
  Chemically synthesized
uuguggcugcaccugcugg

SEQ ID NO: 17864 - RNA, 19 nt, artificial
  Chemically synthesized
ugguugucguccaugaggg

SEQ ID NO: 17865 - RNA, 19 nt, artificial
  Chemically synthesized
uacaugaagugcagcugcg

SEQ ID NO: 17866 - RNA, 19 nt, artificial
  Chemically synthesized
uucugcugcugcaucugua

SEQ ID NO: 17867 - RNA, 19 nt, artificial
  Chemically synthesized
gcaucuguaaguuuugugg

SEQ ID NO: 17868 - RNA, 19 nt, artificial
  Chemically synthesized
uugguauugcaaaaaucug

SEQ ID NO: 17869 - RNA, 19 nt, artificial
  Chemically synthesized
caaacugguggacccgccc

SEQ ID NO: 17870 - RNA, 19 nt, artificial
  Chemically synthesized
ugagguggcacagcagacc

SEQ ID NO: 17871 - RNA, 19 nt, artificial
  Chemically synthesized
aacuugcuuguuuucucag

SEQ ID NO: 17872 - RNA, 19 nt, artificial
  Chemically synthesized
uugcagaugaacccgcggg

SEQ ID NO: 17873 - RNA, 19 nt, artificial
  Chemically synthesized
aaagugguccagcagcacc

SEQ ID NO: 17874 - RNA, 19 nt, artificial
  Chemically synthesized
ugaaccugaaacaaagauu

SEQ ID NO: 17875 - RNA, 19 nt, artificial
  Chemically synthesized
aaccggaacuucuuggucu

SEQ ID NO: 17876 - RNA, 19 nt, artificial
  Chemically synthesized
ugccucuggaugcagcuuc

SEQ ID NO: 17877 - RNA, 19 nt, artificial
  Chemically synthesized
ucaggaacugggcugcggu

SEQ ID NO: 17878 - RNA, 19 nt, artificial
  Chemically synthesized
ugaccuguccacucuggcg

SEQ ID NO: 17879 - RNA, 19 nt, artificial
  Chemically synthesized
aguagcugccuguguagcc

SEQ ID NO: 17880 - RNA, 19 nt, artificial
  Chemically synthesized
gacugcgugcaguucuucc

SEQ ID NO: 17881 - RNA, 19 nt, artificial
  Chemically synthesized
ucugucuggucguccaggu

SEQ ID NO: 17882 - RNA, 19 nt, artificial
  Chemically synthesized
accuguaggagccgcagcc

SEQ ID NO: 17883 - RNA, 19 nt, artificial
  Chemically synthesized
ugcacuggccuuccgcacg

SEQ ID NO: 17884 - RNA, 19 nt, artificial
  Chemically synthesized
augucgugaugcaugcgcu

SEQ ID NO: 17885 - RNA, 19 nt, artificial
  Chemically synthesized
cacucgucuguguugaccu

SEQ ID NO: 17886 - RNA, 19 nt, artificial
  Chemically synthesized
acuggucaugucuuugcag

SEQ ID NO: 17887 - RNA, 19 nt, artificial
  Chemically synthesized
ucguacuggcacagaugcc

SEQ ID NO: 17888 - RNA, 19 nt, artificial
  Chemically synthesized
ucgucuguguugaccucgc

SEQ ID NO: 17889 - RNA, 19 nt, artificial
  Chemically synthesized
ugucggucucgcaguugcg

SEQ ID NO: 17890 - RNA, 19 nt, artificial
  Chemically synthesized
uguuguucucacaguggau

SEQ ID NO: 17891 - RNA, 19 nt, artificial
  Chemically synthesized
gucuccucccuguuguucu

SEQ ID NO: 17892 - RNA, 19 nt, artificial
  Chemically synthesized
ucaaagccgucgaagaggc

SEQ ID NO: 17893 - RNA, 19 nt, artificial
  Chemically synthesized
uuuuaaaaaggcuccucug

SEQ ID NO: 17894 - RNA, 19 nt, artificial
  Chemically synthesized
uuguccuggauguuggcau

SEQ ID NO: 17895 - RNA, 19 nt, artificial
  Chemically synthesized
uaaaaaggcaguguuucug

SEQ ID NO: 17896 - RNA, 19 nt, artificial
  Chemically synthesized
ucggcgucaaccucacccu

SEQ ID NO: 17897 - RNA, 19 nt, artificial
  Chemically synthesized
augcuccgcacaguccagc

SEQ ID NO: 17898 - RNA, 19 nt, artificial
  Chemically synthesized
augccuacauuucaagaac

SEQ ID NO: 17899 - RNA, 19 nt, artificial
  Chemically synthesized
uugccgccguucuugcagg

SEQ ID NO: 17900 - RNA, 19 nt, artificial
  Chemically synthesized
ugucacaguuggucccacu

SEQ ID NO: 17901 - RNA, 19 nt, artificial
  Chemically synthesized
augcaaauuaauccgcgug

SEQ ID NO: 17902 - RNA, 19 nt, artificial
  Chemically synthesized
acucuuggcauacacacuc

SEQ ID NO: 17903 - RNA, 19 nt, artificial
  Chemically synthesized
uugcgcccacuguagccgg

SEQ ID NO: 17904 - RNA, 19 nt, artificial
  Chemically synthesized
ugcacgucugccuggcucg

SEQ ID NO: 17905 - RNA, 19 nt, artificial
  Chemically synthesized
uugaugccgucugugcagg

SEQ ID NO: 17906 - RNA, 19 nt, artificial
  Chemically synthesized
ucguccaccagguccucac

SEQ ID NO: 17907 - RNA, 19 nt, artificial
  Chemically synthesized
ugaagucggagaugacggc

SEQ ID NO: 17908 - RNA, 19 nt, artificial
  Chemically synthesized
cgaccucacaggucugccc

SEQ ID NO: 17909 - RNA, 19 nt, artificial
  Chemically synthesized
uucagacauggguuggacg

SEQ ID NO: 17910 - RNA, 19 nt, artificial
  Chemically synthesized
ugcagcuucuccuaacagg

SEQ ID NO: 17911 - RNA, 19 nt, artificial
  Chemically synthesized
ucgcaguaaaggccggucc

SEQ ID NO: 17912 - RNA, 19 nt, artificial
  Chemically synthesized
ugugaguugaugagguccu

SEQ ID NO: 17913 - RNA, 19 nt, artificial
  Chemically synthesized
ucaaugugcccggcucugg

SEQ ID NO: 17914 - RNA, 19 nt, artificial
  Chemically synthesized
uugaccucgcagugcacac

SEQ ID NO: 17915 - RNA, 19 nt, artificial
  Chemically synthesized
uuccucacaguucuggccg

SEQ ID NO: 17916 - RNA, 19 nt, artificial
  Chemically synthesized
ucugccuggcucggcucuc

SEQ ID NO: 17917 - RNA, 19 nt, artificial
  Chemically synthesized
aaugcggccacgucggugg

SEQ ID NO: 17918 - RNA, 19 nt, artificial
  Chemically synthesized
ugguucggcaccaugccgc

SEQ ID NO: 17919 - RNA, 19 nt, artificial
  Chemically synthesized
uacugaccuguccacucug

SEQ ID NO: 17920 - RNA, 19 nt, artificial
  Chemically synthesized
uggacuaugcucguucaac

SEQ ID NO: 17921 - RNA, 19 nt, artificial
  Chemically synthesized
ucugccauaggcuauacuu

SEQ ID NO: 17922 - RNA, 19 nt, artificial
  Chemically synthesized
uugaugagguccuccagca

SEQ ID NO: 17923 - RNA, 19 nt, artificial
  Chemically synthesized
aguugcgcccacuguagcc

SEQ ID NO: 17924 - RNA, 19 nt, artificial
  Chemically synthesized
ucucacaguggaucccgcu

SEQ ID NO: 17925 - RNA, 19 nt, artificial
  Chemically synthesized
ugaccucgcagugcacacc

SEQ ID NO: 17926 - RNA, 19 nt, artificial
  Chemically synthesized
aucaauguucucgcugcag

SEQ ID NO: 17927 - RNA, 19 nt, artificial
  Chemically synthesized
acacacacgcaguuguagc

SEQ ID NO: 17928 - RNA, 19 nt, artificial
  Chemically synthesized
uuguuuccuauuucagaug

SEQ ID NO: 17929 - RNA, 19 nt, artificial
  Chemically synthesized
aggcugcagaccuuguugc

SEQ ID NO: 17930 - RNA, 19 nt, artificial
  Chemically synthesized
agguugaucucgcaguugg

SEQ ID NO: 17931 - RNA, 19 nt, artificial
  Chemically synthesized
ugagcucacgccaaggugc

SEQ ID NO: 17932 - RNA, 19 nt, artificial
  Chemically synthesized
ugagucgcacucauugaca

SEQ ID NO: 17933 - RNA, 19 nt, artificial
  Chemically synthesized
uguagcuguccacgcaguc

SEQ ID NO: 17934 - RNA, 19 nt, artificial
  Chemically synthesized
aauacacgugcccugguuc

SEQ ID NO: 17935 - RNA, 19 nt, artificial
  Chemically synthesized
acacucguccacaucguac

SEQ ID NO: 17936 - RNA, 19 nt, artificial
  Chemically synthesized
uagaugaagucggagauga

SEQ ID NO: 17937 - RNA, 19 nt, artificial
  Chemically synthesized
uguuggucuggcaguuggg

SEQ ID NO: 17938 - RNA, 19 nt, artificial
  Chemically synthesized
uauuuuccucacaguucug

SEQ ID NO: 17939 - RNA, 19 nt, artificial
  Chemically synthesized
uggguuggacgcacacucg

SEQ ID NO: 17940 - RNA, 19 nt, artificial
  Chemically synthesized
ucacagugcacacccugag

SEQ ID NO: 17941 - RNA, 19 nt, artificial
  Chemically synthesized
ugaggcugcccagcgaggc

SEQ ID NO: 17942 - RNA, 19 nt, artificial
  Chemically synthesized
cgaacaacuacauaauacu

SEQ ID NO: 17943 - RNA, 19 nt, artificial
  Chemically synthesized
uugccauugacaggguugg

SEQ ID NO: 17944 - RNA, 19 nt, artificial
  Chemically synthesized
aggauguggcacaagagcc

SEQ ID NO: 17945 - RNA, 19 nt, artificial
  Chemically synthesized
aaaucaacaucuugggacg

SEQ ID NO: 17946 - RNA, 19 nt, artificial
  Chemically synthesized
ucuuggucuccagguccuc

SEQ ID NO: 17947 - RNA, 19 nt, artificial
  Chemically synthesized
uccagcaggcgcuuggcgg

SEQ ID NO: 17948 - RNA, 19 nt, artificial
  Chemically synthesized
uucaggugcccgaugccca

SEQ ID NO: 17949 - RNA, 19 nt, artificial
  Chemically synthesized
cagaagaaucuuuucaucc

SEQ ID NO: 17950 - RNA, 19 nt, artificial
  Chemically synthesized
agacacuggcacucgaagg

SEQ ID NO: 17951 - RNA, 19 nt, artificial
  Chemically synthesized
caguuguagguguucacgc

SEQ ID NO: 17952 - RNA, 19 nt, artificial
  Chemically synthesized
aucgauguugauguuacac

SEQ ID NO: 17953 - RNA, 19 nt, artificial
  Chemically synthesized
acuggcugucacaguggcc

SEQ ID NO: 17954 - RNA, 19 nt, artificial
  Chemically synthesized
uugugcaggcuggcgcccu

SEQ ID NO: 17955 - RNA, 19 nt, artificial
  Chemically synthesized
aacagacucauucauuaag

SEQ ID NO: 17956 - RNA, 19 nt, artificial
  Chemically synthesized
uucuugcccugcacgccgg

SEQ ID NO: 17957 - RNA, 19 nt, artificial
  Chemically synthesized
aggugcaaggcggucucgc

SEQ ID NO: 17958 - RNA, 19 nt, artificial
  Chemically synthesized
auguccuccucacagaaag

SEQ ID NO: 17959 - RNA, 19 nt, artificial
  Chemically synthesized
cacucguugaugucgaccu

SEQ ID NO: 17960 - RNA, 19 nt, artificial
  Chemically synthesized
auguugaggcugcccagcg

SEQ ID NO: 17961 - RNA, 19 nt, artificial
  Chemically synthesized
acacuuugaagcccucagg

SEQ ID NO: 17962 - RNA, 19 nt, artificial
  Chemically synthesized
auucaaacugguggacccg

SEQ ID NO: 17963 - RNA, 19 nt, artificial
  Chemically synthesized
uucuugcaguuguuuccug

SEQ ID NO: 17964 - RNA, 19 nt, artificial
  Chemically synthesized
acaagguucuggcaguugg

SEQ ID NO: 17965 - RNA, 19 nt, artificial
  Chemically synthesized
uccacggucucacucugca

SEQ ID NO: 17966 - RNA, 19 nt, artificial
  Chemically synthesized
uuugaagcccucagggaac

SEQ ID NO: 17967 - RNA, 19 nt, artificial
  Chemically synthesized
ucuccucagagcaguucac

SEQ ID NO: 17968 - RNA, 19 nt, artificial
  Chemically synthesized
cagaugcacuggaacuccc

SEQ ID NO: 17969 - RNA, 19 nt, artificial
  Chemically synthesized
ugcugcugcuggauguuug

SEQ ID NO: 17970 - RNA, 19 nt, artificial
  Chemically synthesized
accuuggcggucucguagc

SEQ ID NO: 17971 - RNA, 19 nt, artificial
  Chemically synthesized
uccguuugccucuggaugc

SEQ ID NO: 17972 - RNA, 19 nt, artificial
  Chemically synthesized
uugccguccugggacuucu

SEQ ID NO: 17973 - RNA, 19 nt, artificial
  Chemically synthesized
ucauugacgcgcugcacgc

SEQ ID NO: 17974 - RNA, 19 nt, artificial
  Chemically synthesized
aacaccuugucgcugcgca

SEQ ID NO: 17975 - RNA, 19 nt, artificial
  Chemically synthesized
aacgucgucaauacacgug

SEQ ID NO: 17976 - RNA, 19 nt, artificial
  Chemically synthesized
aggucugcccuugccagcc

SEQ ID NO: 17977 - RNA, 19 nt, artificial
  Chemically synthesized
auugaugacggacucgcag

SEQ ID NO: 17978 - RNA, 19 nt, artificial
  Chemically synthesized
acacugugcaggcugaggu

SEQ ID NO: 17979 - RNA, 19 nt, artificial
  Chemically synthesized
uacguaggaaaacccuggc

SEQ ID NO: 17980 - RNA, 19 nt, artificial
  Chemically synthesized
ucuacggcguugacgucgg

SEQ ID NO: 17981 - RNA, 19 nt, artificial
  Chemically synthesized
ucauucugguugucgucca

SEQ ID NO: 17982 - RNA, 19 nt, artificial
  Chemically synthesized
aaauuaauccgcgugcgga

SEQ ID NO: 17983 - RNA, 19 nt, artificial
  Chemically synthesized
ugagccagcuuugccuccg

SEQ ID NO: 17984 - RNA, 19 nt, artificial
  Chemically synthesized
auucaggcaggucucaccg

SEQ ID NO: 17985 - RNA, 19 nt, artificial
  Chemically synthesized
aaaccaucuaaaacacaug

SEQ ID NO: 17986 - RNA, 19 nt, artificial
  Chemically synthesized
ugcacugcaggcugcagac

SEQ ID NO: 17987 - RNA, 19 nt, artificial
  Chemically synthesized
ucacacucauuguuguuga

SEQ ID NO: 17988 - RNA, 19 nt, artificial
  Chemically synthesized
aucuccagguagacgaugg

SEQ ID NO: 17989 - RNA, 19 nt, artificial
  Chemically synthesized
cgcacuugcaggaguagcc

SEQ ID NO: 17990 - RNA, 19 nt, artificial
  Chemically synthesized
uugucgcugcgcagccacc

SEQ ID NO: 17991 - RNA, 19 nt, artificial
  Chemically synthesized
augccuccgugugugaccc

SEQ ID NO: 17992 - RNA, 19 nt, artificial
  Chemically synthesized
aguugcacuuguacccggc

SEQ ID NO: 17993 - RNA, 19 nt, artificial
  Chemically synthesized
ucccacucgcacuccgcgc

SEQ ID NO: 17994 - RNA, 19 nt, artificial
  Chemically synthesized
ucugguugugcaggcuggc

SEQ ID NO: 17995 - RNA, 19 nt, artificial
  Chemically synthesized
augccguccacgcaggugc

SEQ ID NO: 17996 - RNA, 19 nt, artificial
  Chemically synthesized
ugggucugcaccaggugag

SEQ ID NO: 17997 - RNA, 19 nt, artificial
  Chemically synthesized
uggcgucgugccaucaugc

SEQ ID NO: 17998 - RNA, 19 nt, artificial
  Chemically synthesized
uccucuuccucgcuguugc

SEQ ID NO: 17999 - RNA, 19 nt, artificial
  Chemically synthesized
caaucgucgauauuuuccu

SEQ ID NO: 18000 - RNA, 19 nt, artificial
  Chemically synthesized
acucauuguuguugauguc

SEQ ID NO: 18001 - RNA, 19 nt, artificial
  Chemically synthesized
uccaccucgcagugcgucc

SEQ ID NO: 18002 - RNA, 19 nt, artificial
  Chemically synthesized
acacucguugauguccucc

SEQ ID NO: 18003 - RNA, 19 nt, artificial
  Chemically synthesized
guuuuguggcugcaccugc

SEQ ID NO: 18004 - RNA, 19 nt, artificial
  Chemically synthesized
auaguccucggauugccug

SEQ ID NO: 18005 - RNA, 19 nt, artificial
  Chemically synthesized
ugagcacucguccaccagg

SEQ ID NO: 18006 - RNA, 19 nt, artificial
  Chemically synthesized
ucacgcuugaagaccacgu

SEQ ID NO: 18007 - RNA, 19 nt, artificial
  Chemically synthesized
aguucugggugccacgggc

SEQ ID NO: 18008 - RNA, 19 nt, artificial
  Chemically synthesized
acacucgcaguagaaggag

SEQ ID NO: 18009 - RNA, 19 nt, artificial
  Chemically synthesized
acacucguagccaucgauc

SEQ ID NO: 18010 - RNA, 19 nt, artificial
  Chemically synthesized
acuugguauugcaaaaauc

SEQ ID NO: 18011 - RNA, 19 nt, artificial
  Chemically synthesized
acucguugacgucgaucuc

SEQ ID NO: 18012 - RNA, 19 nt, artificial
  Chemically synthesized
ggacacucgcaguagaagg

SEQ ID NO: 18013 - RNA, 19 nt, artificial
  Chemically synthesized
cagucauccagguugaucu

SEQ ID NO: 18014 - RNA, 19 nt, artificial
  Chemically synthesized
cacucguugacgucgaucu

SEQ ID NO: 18015 - RNA, 19 nt, artificial
  Chemically synthesized
ucucggguacaugcuccgc

SEQ ID NO: 18016 - RNA, 19 nt, artificial
  Chemically synthesized
ucucguagcugcccucccg

SEQ ID NO: 18017 - RNA, 19 nt, artificial
  Chemically synthesized
ugguagaugaagucggaga

SEQ ID NO: 18018 - RNA, 19 nt, artificial
  Chemically synthesized
caagucuccuacaaaacac

SEQ ID NO: 18019 - RNA, 19 nt, artificial
  Chemically synthesized
acaugcucccuguguagcc

SEQ ID NO: 18020 - RNA, 19 nt, artificial
  Chemically synthesized
ucuuguccagacaggugcc

SEQ ID NO: 18021 - RNA, 19 nt, artificial
  Chemically synthesized
aaucgucgauauuuuccuc

SEQ ID NO: 18022 - RNA, 19 nt, artificial
  Chemically synthesized
aucagcaccaccaccacca

SEQ ID NO: 18023 - RNA, 19 nt, artificial
  Chemically synthesized
uccagguugaucucgcagu

SEQ ID NO: 18024 - RNA, 19 nt, artificial
  Chemically synthesized
ucuugcagggcgaggaguc

SEQ ID NO: 18025 - RNA, 19 nt, artificial
  Chemically synthesized
acaguuggucccacuccac

SEQ ID NO: 18026 - RNA, 19 nt, artificial
  Chemically synthesized
acacacuccgagaacacau

SEQ ID NO: 18027 - RNA, 19 nt, artificial
  Chemically synthesized
aucugguccaggcaggugg

SEQ ID NO: 18028 - RNA, 19 nt, artificial
  Chemically synthesized
acgucugccuggcucggcu

SEQ ID NO: 18029 - RNA, 19 nt, artificial
  Chemically synthesized
aaaaaggcuccucuggucg

SEQ ID NO: 18030 - RNA, 19 nt, artificial
  Chemically synthesized
ucggguacaugcuccgcac

SEQ ID NO: 18031 - RNA, 19 nt, artificial
  Chemically synthesized
ucagacauggguuggacgc

SEQ ID NO: 18032 - RNA, 19 nt, artificial
  Chemically synthesized
uguuguugaugucacaguu

SEQ ID NO: 18033 - RNA, 19 nt, artificial
  Chemically synthesized
agcgucauucucacacgug

SEQ ID NO: 18034 - RNA, 19 nt, artificial
  Chemically synthesized
uguuuuaaaaaggcuccuc

SEQ ID NO: 18035 - RNA, 19 nt, artificial
  Chemically synthesized
accuucuugcccugcacgc

SEQ ID NO: 18036 - RNA, 19 nt, artificial
  Chemically synthesized
uucgagacgcacucguuga

SEQ ID NO: 18037 - RNA, 19 nt, artificial
  Chemically synthesized
ucaugauugguaccauggg

SEQ ID NO: 18038 - RNA, 19 nt, artificial
  Chemically synthesized
ugggucugccagcauuugc

SEQ ID NO: 18039 - RNA, 19 nt, artificial
  Chemically synthesized
acggccucgaucuuguagg

SEQ ID NO: 18040 - RNA, 19 nt, artificial
  Chemically synthesized
gaaccugaaacaaagauuc

SEQ ID NO: 18041 - RNA, 19 nt, artificial
  Chemically synthesized
agaacagaagcacaaaggc

SEQ ID NO: 18042 - RNA, 19 nt, artificial
  Chemically synthesized
auguuggucucgcaguggu

SEQ ID NO: 18043 - RNA, 19 nt, artificial
  Chemically synthesized
cacucaucgauguugaugu

SEQ ID NO: 18044 - RNA, 19 nt, artificial
  Chemically synthesized
uugcccugcacgccgggcu

SEQ ID NO: 18045 - RNA, 19 nt, artificial
  Chemically synthesized
agagcgcacacagacgccc

SEQ ID NO: 18046 - RNA, 19 nt, artificial
  Chemically synthesized
ucgugggugacgucgcccg

SEQ ID NO: 18047 - RNA, 19 nt, artificial
  Chemically synthesized
uacaguuccucauguagau

SEQ ID NO: 18048 - RNA, 19 nt, artificial
  Chemically synthesized
ugucccggcguucuugcag

SEQ ID NO: 18049 - RNA, 19 nt, artificial
  Chemically synthesized
cagaugcaaauuaauccgc

SEQ ID NO: 18050 - RNA, 19 nt, artificial
  Chemically synthesized
uaggaaaacccuggcucuc

SEQ ID NO: 18051 - RNA, 19 nt, artificial
  Chemically synthesized
ucacaagcaugcuugcaag

SEQ ID NO: 18052 - RNA, 19 nt, artificial
  Chemically synthesized
acaaggguuggauucacac

SEQ ID NO: 18053 - RNA, 19 nt, artificial
  Chemically synthesized
uuuaaaaaggcuccucugg

SEQ ID NO: 18054 - RNA, 19 nt, artificial
  Chemically synthesized
aguucuggccggugaagcc

SEQ ID NO: 18055 - RNA, 19 nt, artificial
  Chemically synthesized
ugcgugcaguucuuccagg

SEQ ID NO: 18056 - RNA, 19 nt, artificial
  Chemically synthesized
ugaugcugguggagcggcc

SEQ ID NO: 18057 - RNA, 19 nt, artificial
  Chemically synthesized
uugaagcccucagggaacc

SEQ ID NO: 18058 - RNA, 19 nt, artificial
  Chemically synthesized
aacaucuaacccauaugcu

SEQ ID NO: 18059 - RNA, 19 nt, artificial
  Chemically synthesized
ugagcaggucgcaggugcc

SEQ ID NO: 18060 - RNA, 19 nt, artificial
  Chemically synthesized
cugccgguugucaaucucc

SEQ ID NO: 18061 - RNA, 19 nt, artificial
  Chemically synthesized
aggucuguggcucgguucc

SEQ ID NO: 18062 - RNA, 19 nt, artificial
  Chemically synthesized
agacacaggagaagcucuc

SEQ ID NO: 18063 - RNA, 19 nt, artificial
  Chemically synthesized
uugagguggcacagcagac

SEQ ID NO: 18064 - RNA, 19 nt, artificial
  Chemically synthesized
uucacaagcaugcuugcaa

SEQ ID NO: 18065 - RNA, 19 nt, artificial
  Chemically synthesized
agcugagccaagucugacg

SEQ ID NO: 18066 - RNA, 19 nt, artificial
  Chemically synthesized
uagcugccuguguagcccg

SEQ ID NO: 18067 - RNA, 19 nt, artificial
  Chemically synthesized
auugaccauucaaacuggu

SEQ ID NO: 18068 - RNA, 19 nt, artificial
  Chemically synthesized
acacucguugacauccugc

SEQ ID NO: 18069 - RNA, 19 nt, artificial
  Chemically synthesized
uugcaggagccguaguggc

SEQ ID NO: 18070 - RNA, 19 nt, artificial
  Chemically synthesized
uguugaugccgucugugca

SEQ ID NO: 18071 - RNA, 19 nt, artificial
  Chemically synthesized
guugauguuggucucgcag

SEQ ID NO: 18072 - RNA, 19 nt, artificial
  Chemically synthesized
uucucacacguggcgcccu

SEQ ID NO: 18073 - RNA, 19 nt, artificial
  Chemically synthesized
ugcacuuguacccggcaac

SEQ ID NO: 18074 - RNA, 19 nt, artificial
  Chemically synthesized
uccagguagacgauggagc

SEQ ID NO: 18075 - RNA, 19 nt, artificial
  Chemically synthesized
acacucguugauguugguc

SEQ ID NO: 18076 - RNA, 19 nt, artificial
  Chemically synthesized
cguacuggcacagaugccc

SEQ ID NO: 18077 - RNA, 19 nt, artificial
  Chemically synthesized
ugugcgucacgcuugaaga

SEQ ID NO: 18078 - RNA, 19 nt, artificial
  Chemically synthesized
aaaaggguaggaugccucc

SEQ ID NO: 18079 - RNA, 19 nt, artificial
  Chemically synthesized
ugaucuuguccaggcagcg

SEQ ID NO: 18080 - RNA, 19 nt, artificial
  Chemically synthesized
auaggcuauacuugguauu

SEQ ID NO: 18081 - RNA, 19 nt, artificial
  Chemically synthesized
gcuuuuuggacuaugcucg

SEQ ID NO: 18082 - RNA, 19 nt, artificial
  Chemically synthesized
ugaugacggacucgcagcg

SEQ ID NO: 18083 - RNA, 19 nt, artificial
  Chemically synthesized
uugacacacacgcaguugu

SEQ ID NO: 18084 - RNA, 19 nt, artificial
  Chemically synthesized
acuccgcgcuguugcagcc

SEQ ID NO: 18085 - RNA, 19 nt, artificial
  Chemically synthesized
acuggcaugacacacaaca

SEQ ID NO: 18086 - RNA, 19 nt, artificial
  Chemically synthesized
uagccggccacgcacuugc

SEQ ID NO: 18087 - RNA, 19 nt, artificial
  Chemically synthesized
agcacuuguagguguuggg

SEQ ID NO: 18088 - RNA, 19 nt, artificial
  Chemically synthesized
acaccagugcacaagguuc

SEQ ID NO: 18089 - RNA, 19 nt, artificial
  Chemically synthesized
aucuuuucauccuacguag

SEQ ID NO: 18090 - RNA, 19 nt, artificial
  Chemically synthesized
agcgugagcaggucgcagg

SEQ ID NO: 18091 - RNA, 19 nt, artificial
  Chemically synthesized
ugcacguguagcuguccac

SEQ ID NO: 18092 - RNA, 19 nt, artificial
  Chemically synthesized
aucucauguuugacaugca

SEQ ID NO: 18093 - RNA, 19 nt, artificial
  Chemically synthesized
guugauguuacacaugcuc

SEQ ID NO: 18094 - RNA, 19 nt, artificial
  Chemically synthesized
ccucgguacaguacugacc

SEQ ID NO: 18095 - RNA, 19 nt, artificial
  Chemically synthesized
ucggaugugggcucacagg

SEQ ID NO: 18096 - RNA, 19 nt, artificial
  Chemically synthesized
ucauguuugacaugcauga

SEQ ID NO: 18097 - RNA, 19 nt, artificial
  Chemically synthesized
uaguccgugcagguggccc

SEQ ID NO: 18098 - RNA, 19 nt, artificial
  Chemically synthesized
acauuguucacggcggcgg

SEQ ID NO: 18099 - RNA, 19 nt, artificial
  Chemically synthesized
uggguguuguggcaggucc

SEQ ID NO: 18100 - RNA, 19 nt, artificial
  Chemically synthesized
uacggcguugacgucggcg

SEQ ID NO: 18101 - RNA, 19 nt, artificial
  Chemically synthesized
accuugucgcugcgcagcc

SEQ ID NO: 18102 - RNA, 19 nt, artificial
  Chemically synthesized
cacucguccacaucguacu

SEQ ID NO: 18103 - RNA, 19 nt, artificial
  Chemically synthesized
uccucgguacaguacugac

SEQ ID NO: 18104 - RNA, 19 nt, artificial
  Chemically synthesized
ucgguuccggaucaggauc

SEQ ID NO: 18105 - RNA, 19 nt, artificial
  Chemically synthesized
aucuccucagagcaguuca

SEQ ID NO: 18106 - RNA, 19 nt, artificial
  Chemically synthesized
guaaguguuggguccgucc

SEQ ID NO: 18107 - RNA, 19 nt, artificial
  Chemically synthesized
guagccaucgaucuugucc

SEQ ID NO: 18108 - RNA, 19 nt, artificial
  Chemically synthesized
ucucaaaggccagccggcc

SEQ ID NO: 18109 - RNA, 19 nt, artificial
  Chemically synthesized
uggugguggcggcugcagg

SEQ ID NO: 18110 - RNA, 19 nt, artificial
  Chemically synthesized
ucuccaacaucauuucuuu

SEQ ID NO: 18111 - RNA, 19 nt, artificial
  Chemically synthesized
ugacacacaacagacucau

SEQ ID NO: 18112 - RNA, 19 nt, artificial
  Chemically synthesized
guucucacaguggaucccg

SEQ ID NO: 18113 - RNA, 19 nt, artificial
  Chemically synthesized
auucugguugucguccaug

SEQ ID NO: 18114 - RNA, 19 nt, artificial
  Chemically synthesized
acacaucucauguuugaca

SEQ ID NO: 18115 - RNA, 19 nt, artificial
  Chemically synthesized
ucccgcaggaaguggaagg

SEQ ID NO: 18116 - RNA, 19 nt, artificial
  Chemically synthesized
uacacacuccgagaacaca

SEQ ID NO: 18117 - RNA, 19 nt, artificial
  Chemically synthesized
acuugcagaugaacccgcg

SEQ ID NO: 18118 - RNA, 19 nt, artificial
  Chemically synthesized
cauaugauccgugaugucc

SEQ ID NO: 18119 - RNA, 19 nt, artificial
  Chemically synthesized
aguuccucauguagaucac

SEQ ID NO: 18120 - RNA, 19 nt, artificial
  Chemically synthesized
uuggcaucagcuggcacuc

SEQ ID NO: 18121 - RNA, 19 nt, artificial
  Chemically synthesized
gcauugaccauucaaacug

SEQ ID NO: 18122 - RNA, 19 nt, artificial
  Chemically synthesized
acagaugcccagugaagcc

SEQ ID NO: 18123 - RNA, 19 nt, artificial
  Chemically synthesized
cacucgucgaucuccucag

SEQ ID NO: 18124 - RNA, 19 nt, artificial
  Chemically synthesized
caucucauguuugacaugc

SEQ ID NO: 18125 - RNA, 19 nt, artificial
  Chemically synthesized
uugcaguacuggucguaca

SEQ ID NO: 18126 - RNA, 19 nt, artificial
  Chemically synthesized
ucucacacguggcgcccuc

SEQ ID NO: 18127 - RNA, 19 nt, artificial
  Chemically synthesized
agcuuuuuggacuaugcuc

SEQ ID NO: 18128 - RNA, 19 nt, artificial
  Chemically synthesized
aagaacuuguauaaccaac

SEQ ID NO: 18129 - RNA, 19 nt, artificial
  Chemically synthesized
uaguccaggauguggcaca

SEQ ID NO: 18130 - RNA, 19 nt, artificial
  Chemically synthesized
gucuccagguccucguccc

SEQ ID NO: 18131 - RNA, 19 nt, artificial
  Chemically synthesized
ccauucaaacugguggacc

SEQ ID NO: 18132 - RNA, 19 nt, artificial
  Chemically synthesized
ugcacgccgggcuugaggc

SEQ ID NO: 18133 - RNA, 19 nt, artificial
  Chemically synthesized
acaggucugcccuugccag

SEQ ID NO: 18134 - RNA, 19 nt, artificial
  Chemically synthesized
auugcagucguccacguug

SEQ ID NO: 18135 - RNA, 19 nt, artificial
  Chemically synthesized
ugcaaggcggucucgcccg

SEQ ID NO: 18136 - RNA, 19 nt, artificial
  Chemically synthesized
uuggaggccacggcgcagg

SEQ ID NO: 18137 - RNA, 19 nt, artificial
  Chemically synthesized
auuaauccgcgugcggaag

SEQ ID NO: 18138 - RNA, 19 nt, artificial
  Chemically synthesized
uagccugggcggcagaggc

SEQ ID NO: 18139 - RNA, 19 nt, artificial
  Chemically synthesized
agugcagggcggacuugcc

SEQ ID NO: 18140 - RNA, 19 nt, artificial
  Chemically synthesized
gcuguugcacucauugacc

SEQ ID NO: 18141 - RNA, 19 nt, artificial
  Chemically synthesized
agcaccaccaccaccagcg

SEQ ID NO: 18142 - RNA, 19 nt, artificial
  Chemically synthesized
ugugcagucaggcguguug

SEQ ID NO: 18143 - RNA, 19 nt, artificial
  Chemically synthesized
uugagggagcagucaccgc

SEQ ID NO: 18144 - RNA, 19 nt, artificial
  Chemically synthesized
ucgaugucggucucgcagu

SEQ ID NO: 18145 - RNA, 19 nt, artificial
  Chemically synthesized
ugauugguaccaugggugc

SEQ ID NO: 18146 - RNA, 19 nt, artificial
  Chemically synthesized
ugcugcugggcuugcggac

SEQ ID NO: 18147 - RNA, 19 nt, artificial
  Chemically synthesized
acacucaucgauguugaug

SEQ ID NO: 18148 - RNA, 19 nt, artificial
  Chemically synthesized
cuacauuucaagaacgggc

SEQ ID NO: 18149 - RNA, 19 nt, artificial
  Chemically synthesized
guaaaaaucaacaucuugg

SEQ ID NO: 18150 - RNA, 19 nt, artificial
  Chemically synthesized
uguagcccggcucacaggc

SEQ ID NO: 18151 - RNA, 19 nt, artificial
  Chemically synthesized
uccaccacguggcaugucc

SEQ ID NO: 18152 - RNA, 19 nt, artificial
  Chemically synthesized
gucuuuuucuguaaacuac

SEQ ID NO: 18153 - RNA, 19 nt, artificial
  Chemically synthesized
uuucccugaccagccgggc

SEQ ID NO: 18154 - RNA, 19 nt, artificial
  Chemically synthesized
uguugcgcagcugcuccgg

SEQ ID NO: 18155 - RNA, 19 nt, artificial
  Chemically synthesized
aggcguguuguucucacag

SEQ ID NO: 18156 - RNA, 19 nt, artificial
  Chemically synthesized
caguuggucccacuccacc

SEQ ID NO: 18157 - RNA, 19 nt, artificial
  Chemically synthesized
acucauugaucuuguccag

SEQ ID NO: 18158 - RNA, 19 nt, artificial
  Chemically synthesized
cagucguccacguugaucu

SEQ ID NO: 18159 - RNA, 19 nt, artificial
  Chemically synthesized
acacucauuguuguugaug

SEQ ID NO: 18160 - RNA, 19 nt, artificial
  Chemically synthesized
cauugaccauucaaacugg

SEQ ID NO: 18161 - RNA, 19 nt, artificial
  Chemically synthesized
ugaggcuggguggccagcc

SEQ ID NO: 18162 - RNA, 19 nt, artificial
  Chemically synthesized
uugaggcugcccagguagc

SEQ ID NO: 18163 - RNA, 19 nt, artificial
  Chemically synthesized
accaagaacuuguauaacc

SEQ ID NO: 18164 - RNA, 19 nt, artificial
  Chemically synthesized
uugauguuggucuggcagu

SEQ ID NO: 18165 - RNA, 19 nt, artificial
  Chemically synthesized
augugggcucacagguccc

SEQ ID NO: 18166 - RNA, 19 nt, artificial
  Chemically synthesized
uccucauguagaucacuuu

SEQ ID NO: 18167 - RNA, 19 nt, artificial
  Chemically synthesized
aggagaagcucucauaguc

SEQ ID NO: 18168 - RNA, 19 nt, artificial
  Chemically synthesized
ccuucuugcccugcacgcc

SEQ ID NO: 18169 - RNA, 19 nt, artificial
  Chemically synthesized
agucucaaaggccagccgg

SEQ ID NO: 18170 - RNA, 19 nt, artificial
  Chemically synthesized
uucggcaccaugccgcucu

SEQ ID NO: 18171 - RNA, 19 nt, artificial
  Chemically synthesized
uagccgggcaugcagaugc

SEQ ID NO: 18172 - RNA, 19 nt, artificial
  Chemically synthesized
acucguugaugucgaccuc

SEQ ID NO: 18173 - RNA, 19 nt, artificial
  Chemically synthesized
acagcugcaggcauagucu

SEQ ID NO: 18174 - RNA, 19 nt, artificial
  Chemically synthesized
ugcagcacgcggcugagcu

SEQ ID NO: 18175 - RNA, 19 nt, artificial
  Chemically synthesized
aaaucugcuccucccaaac

SEQ ID NO: 18176 - RNA, 19 nt, artificial
  Chemically synthesized
guacaugcuccgcacaguc

SEQ ID NO: 18177 - RNA, 19 nt, artificial
  Chemically synthesized
aucgaucuuguccagacag

SEQ ID NO: 18178 - RNA, 19 nt, artificial
  Chemically synthesized
uccagcaugcccuccacgg

SEQ ID NO: 18179 - RNA, 19 nt, artificial
  Chemically synthesized
uugguaccaugggugcacu

SEQ ID NO: 18180 - RNA, 19 nt, artificial
  Chemically synthesized
auguccaccucgcagugcg

SEQ ID NO: 18181 - RNA, 19 nt, artificial
  Chemically synthesized
auguuacacaugcucccug

SEQ ID NO: 18182 - RNA, 19 nt, artificial
  Chemically synthesized
uaaaggccgguccagccgc

SEQ ID NO: 18183 - RNA, 19 nt, artificial
  Chemically synthesized
agguguaaguguugggucc

SEQ ID NO: 18184 - RNA, 19 nt, artificial
  Chemically synthesized
acucgugggugacgucgcc

SEQ ID NO: 18185 - RNA, 19 nt, artificial
  Chemically synthesized
cuguaguccaggauguggc

SEQ ID NO: 18186 - RNA, 19 nt, artificial
  Chemically synthesized
agacgcagcgguaggagcc

SEQ ID NO: 18187 - RNA, 19 nt, artificial
  Chemically synthesized
uggucccacuccacccagg

SEQ ID NO: 18188 - RNA, 19 nt, artificial
  Chemically synthesized
uugcagggcgaggagucac

SEQ ID NO: 18189 - RNA, 19 nt, artificial
  Chemically synthesized
accgucugaagcguucuuc

SEQ ID NO: 18190 - RNA, 19 nt, artificial
  Chemically synthesized
gaacuucuuggucuccagg

SEQ ID NO: 18191 - RNA, 19 nt, artificial
  Chemically synthesized
ucuguggcucgguuccgga

SEQ ID NO: 18192 - RNA, 19 nt, artificial
  Chemically synthesized
ucccuguguagcccggcuc

SEQ ID NO: 18193 - RNA, 19 nt, artificial
  Chemically synthesized
acuccacccagggucacag

SEQ ID NO: 18194 - RNA, 19 nt, artificial
  Chemically synthesized
ucgugcuggcaguagcugc

SEQ ID NO: 18195 - RNA, 19 nt, artificial
  Chemically synthesized
uugaccucagacaggcagg

SEQ ID NO: 18196 - RNA, 19 nt, artificial
  Chemically synthesized
auguuggucuggcaguugg

SEQ ID NO: 18197 - RNA, 19 nt, artificial
  Chemically synthesized
cuggaagacaccuugugcg

SEQ ID NO: 18198 - RNA, 19 nt, artificial
  Chemically synthesized
aucaucugggacagggcgc

SEQ ID NO: 18199 - RNA, 19 nt, artificial
  Chemically synthesized
cgucauucucacacguggc

SEQ ID NO: 18200 - RNA, 19 nt, artificial
  Chemically synthesized
cacucgcaguagaaggagg

SEQ ID NO: 18201 - RNA, 19 nt, artificial
  Chemically synthesized
aagucggagaugacggccg

SEQ ID NO: 18202 - RNA, 19 nt, artificial
  Chemically synthesized
uguacccuuccgugcacac

SEQ ID NO: 18203 - RNA, 19 nt, artificial
  Chemically synthesized
uuucacaagcaugcuugca

SEQ ID NO: 18204 - RNA, 19 nt, artificial
  Chemically synthesized
caguacuggucguacaggg

SEQ ID NO: 18205 - RNA, 19 nt, artificial
  Chemically synthesized
acacauuuucacaagcaug

SEQ ID NO: 18206 - RNA, 19 nt, artificial
  Chemically synthesized
uguguagcccggcucacag

SEQ ID NO: 18207 - RNA, 19 nt, artificial
  Chemically synthesized
cacgcuggcagucaaagcc

SEQ ID NO: 18208 - RNA, 19 nt, artificial
  Chemically synthesized
uucugguugucguccauga

SEQ ID NO: 18209 - RNA, 19 nt, artificial
  Chemically synthesized
agcuuugccuccguuugcc

SEQ ID NO: 18210 - RNA, 19 nt, artificial
  Chemically synthesized
cguuguuaaagcacuuggg

SEQ ID NO: 18211 - RNA, 19 nt, artificial
  Chemically synthesized
agggcugugagucgcacuc

SEQ ID NO: 18212 - RNA, 19 nt, artificial
  Chemically synthesized
augccgucugugcaggagc

SEQ ID NO: 18213 - RNA, 19 nt, artificial
  Chemically synthesized
uugugacacggguugggcc

SEQ ID NO: 18214 - RNA, 19 nt, artificial
  Chemically synthesized
ugcaugaugccuacauuuc

SEQ ID NO: 18215 - RNA, 19 nt, artificial
  Chemically synthesized
aagcccucccggcaggugc

SEQ ID NO: 18216 - RNA, 19 nt, artificial
  Chemically synthesized
acuggcacacucguugaug

SEQ ID NO: 18217 - RNA, 19 nt, artificial
  Chemically synthesized
agucaucaauguucucgcu

SEQ ID NO: 18218 - RNA, 19 nt, artificial
  Chemically synthesized
agguccuccagcaugcccu

SEQ ID NO: 18219 - RNA, 19 nt, artificial
  Chemically synthesized
ucuugcuggccucagacac

SEQ ID NO: 18220 - RNA, 19 nt, artificial
  Chemically synthesized
gucggcgucaaccucaccc

SEQ ID NO: 18221 - RNA, 19 nt, artificial
  Chemically synthesized
auggccuugccauugacag

SEQ ID NO: 18222 - RNA, 19 nt, artificial
  Chemically synthesized
uuacacaugcucccugugu

SEQ ID NO: 18223 - RNA, 19 nt, artificial
  Chemically synthesized
gggucugccagcauuugcc

SEQ ID NO: 18224 - RNA, 19 nt, artificial
  Chemically synthesized
uccacguugaucucacagu

SEQ ID NO: 18225 - RNA, 19 nt, artificial
  Chemically synthesized
aggaucaguggcgucgugc

SEQ ID NO: 18226 - RNA, 19 nt, artificial
  Chemically synthesized
uaugauccgugaugucccg

SEQ ID NO: 18227 - RNA, 19 nt, artificial
  Chemically synthesized
ucugacagguagccauggg

SEQ ID NO: 18228 - RNA, 19 nt, artificial
  Chemically synthesized
ugacgucgaucucgcaucg

SEQ ID NO: 18229 - RNA, 19 nt, artificial
  Chemically synthesized
agugcacacccugagugcc

SEQ ID NO: 18230 - RNA, 19 nt, artificial
  Chemically synthesized
ugcacacguagccacuggu

SEQ ID NO: 18231 - RNA, 19 nt, artificial
  Chemically synthesized
ccagucucaaaggccagcc

SEQ ID NO: 18232 - RNA, 19 nt, artificial
  Chemically synthesized
augacggacucgcagcggc

SEQ ID NO: 18233 - RNA, 19 nt, artificial
  Chemically synthesized
ucgcacucaucgaugucca

SEQ ID NO: 18234 - RNA, 19 nt, artificial
  Chemically synthesized
uagccacuggucaugucuu

SEQ ID NO: 18235 - RNA, 19 nt, artificial
  Chemically synthesized
cguucuggcaggcauuugg

SEQ ID NO: 18236 - RNA, 19 nt, artificial
  Chemically synthesized
aacgcacucguugaugucg

SEQ ID NO: 18237 - RNA, 19 nt, artificial
  Chemically synthesized
acagugcacacccugagug

SEQ ID NO: 18238 - RNA, 19 nt, artificial
  Chemically synthesized
uggccuuccgcacgcuggc

SEQ ID NO: 18239 - RNA, 19 nt, artificial
  Chemically synthesized
ugaccagcacggcacucgc

SEQ ID NO: 18240 - RNA, 19 nt, artificial
  Chemically synthesized
auacugaaccugaaacaaa

SEQ ID NO: 18241 - RNA, 19 nt, artificial
  Chemically synthesized
caggugaagccauugaugc

SEQ ID NO: 18242 - RNA, 19 nt, artificial
  Chemically synthesized
ugccuacauuucaagaacg

SEQ ID NO: 18243 - RNA, 19 nt, artificial
  Chemically synthesized
cuucaggagcacaacugcg

SEQ ID NO: 18244 - RNA, 19 nt, artificial
  Chemically synthesized
uccugugcgaugucgcgcg

SEQ ID NO: 18245 - RNA, 19 nt, artificial
  Chemically synthesized
guagccacuggucaugucu

SEQ ID NO: 18246 - RNA, 19 nt, artificial
  Chemically synthesized
aagugguccagcagcaccu

SEQ ID NO: 18247 - RNA, 19 nt, artificial
  Chemically synthesized
uuuggacuaugcucguuca

SEQ ID NO: 18248 - RNA, 19 nt, artificial
  Chemically synthesized
cucuccacucaggaagcuc

SEQ ID NO: 18249 - RNA, 19 nt, artificial
  Chemically synthesized
ugccgguugucaaucucca

SEQ ID NO: 18250 - RNA, 19 nt, artificial
  Chemically synthesized
acggguucgagacgcacuc

SEQ ID NO: 18251 - RNA, 19 nt, artificial
  Chemically synthesized
aggcuauacuugguauugc

SEQ ID NO: 18252 - RNA, 19 nt, artificial
  Chemically synthesized
auuucaagaacgggcaggg

SEQ ID NO: 18253 - RNA, 19 nt, artificial
  Chemically synthesized
agucacaccagugcacaag

SEQ ID NO: 18254 - RNA, 19 nt, artificial
  Chemically synthesized
aguuguuuccuggacaauc

SEQ ID NO: 18255 - RNA, 19 nt, artificial
  Chemically synthesized
aggcaguugcacuuguacc

SEQ ID NO: 18256 - RNA, 19 nt, artificial
  Chemically synthesized
ggugcaaggcggucucgcc

SEQ ID NO: 18257 - RNA, 19 nt, artificial
  Chemically synthesized
gagccaagucugacguccc

SEQ ID NO: 18258 - RNA, 19 nt, artificial
  Chemically synthesized
aaaggcuccucuggucggc

SEQ ID NO: 18259 - RNA, 19 nt, artificial
  Chemically synthesized
ugcacuugcccgcaugcuc

SEQ ID NO: 18260 - RNA, 19 nt, artificial
  Chemically synthesized
uggugaggcaggcauuguc

SEQ ID NO: 18261 - RNA, 19 nt, artificial
  Chemically synthesized
ugcggcauccacauuguuc

SEQ ID NO: 18262 - RNA, 19 nt, artificial
  Chemically synthesized
auccacagagcgcacacag

SEQ ID NO: 18263 - RNA, 19 nt, artificial
  Chemically synthesized
aguagaaggaggccacacg

SEQ ID NO: 18264 - RNA, 19 nt, artificial
  Chemically synthesized
ugucuggucguccagguca

SEQ ID NO: 18265 - RNA, 19 nt, artificial
  Chemically synthesized
gucucguagcugcccuccc

SEQ ID NO: 18266 - RNA, 19 nt, artificial
  Chemically synthesized
ggucucacucugcacggcc

SEQ ID NO: 18267 - RNA, 19 nt, artificial
  Chemically synthesized
guucaacuucccuucucca

SEQ ID NO: 18268 - RNA, 19 nt, artificial
  Chemically synthesized
ugcaccgccaggcugcugg

SEQ ID NO: 18269 - RNA, 19 nt, artificial
  Chemically synthesized
guuggucucgcaguggugg

SEQ ID NO: 18270 - RNA, 19 nt, artificial
  Chemically synthesized
augcagucggcgucaaccu

SEQ ID NO: 18271 - RNA, 19 nt, artificial
  Chemically synthesized
uguuuccuggacaaucguc

SEQ ID NO: 18272 - RNA, 19 nt, artificial
  Chemically synthesized
uucuggcaggcauuuggca

SEQ ID NO: 18273 - RNA, 19 nt, artificial
  Chemically synthesized
ccacuggucaugucuuugc

SEQ ID NO: 18274 - RNA, 19 nt, artificial
  Chemically synthesized
aauccgcgugcggaaggug

SEQ ID NO: 18275 - RNA, 19 nt, artificial
  Chemically synthesized
ucagcuggcacucguccac

SEQ ID NO: 18276 - RNA, 19 nt, artificial
  Chemically synthesized
aggugggccagucucaaag

SEQ ID NO: 18277 - RNA, 19 nt, artificial
  Chemically synthesized
uacauuucaagaacgggca

SEQ ID NO: 18278 - RNA, 19 nt, artificial
  Chemically synthesized
uucacacuucccgccauuc

SEQ ID NO: 18279 - RNA, 19 nt, artificial
  Chemically synthesized
aguccucaccaguccagcc

SEQ ID NO: 18280 - RNA, 19 nt, artificial
  Chemically synthesized
ucgaucuuguccagacagg

SEQ ID NO: 18281 - RNA, 19 nt, artificial
  Chemically synthesized
ucgucaauacacgugcccu

SEQ ID NO: 18282 - RNA, 19 nt, artificial
  Chemically synthesized
caaauuaauccgcgugcgg

SEQ ID NO: 18283 - RNA, 19 nt, artificial
  Chemically synthesized
agguccucacaguagcugc

SEQ ID NO: 18284 - RNA, 19 nt, artificial
  Chemically synthesized
uacuggcacagaugcccag

SEQ ID NO: 18285 - RNA, 19 nt, artificial
  Chemically synthesized
uguugcacugcaggcugca

SEQ ID NO: 18286 - RNA, 19 nt, artificial
  Chemically synthesized
uaauccgcgugcggaaggu

SEQ ID NO: 18287 - RNA, 19 nt, artificial
  Chemically synthesized
uccagcacugcagagacug

SEQ ID NO: 18288 - RNA, 19 nt, artificial
  Chemically synthesized
aaaggacgcagcccacggc

SEQ ID NO: 18289 - RNA, 19 nt, artificial
  Chemically synthesized
agucaggcguguuguucuc

SEQ ID NO: 18290 - RNA, 19 nt, artificial
  Chemically synthesized
ugguccuugcaguacuggu

SEQ ID NO: 18291 - RNA, 19 nt, artificial
  Chemically synthesized
uucuggccggugaagccug

SEQ ID NO: 18292 - RNA, 19 nt, artificial
  Chemically synthesized
augcccaggugggugucgg

SEQ ID NO: 18293 - RNA, 19 nt, artificial
  Chemically synthesized
acaggcaacgguagaaggg

SEQ ID NO: 18294 - RNA, 19 nt, artificial
  Chemically synthesized
uugcugcugggcuugcgga

SEQ ID NO: 18295 - RNA, 19 nt, artificial
  Chemically synthesized
uccucgaaccggaacuucu

SEQ ID NO: 18296 - RNA, 19 nt, artificial
  Chemically synthesized
gucuguggcucgguuccgg

SEQ ID NO: 18297 - RNA, 19 nt, artificial
  Chemically synthesized
uucaccuggcccagcaggg

SEQ ID NO: 18298 - RNA, 19 nt, artificial
  Chemically synthesized
aggcuugggaaaggaagcc

SEQ ID NO: 18299 - RNA, 19 nt, artificial
  Chemically synthesized
aaguacuuccagcacugca

SEQ ID NO: 18300 - RNA, 19 nt, artificial
  Chemically synthesized
ucggcggcacgcuugaugg

SEQ ID NO: 18301 - RNA, 19 nt, artificial
  Chemically synthesized
uucaggcagaagcagaggu

SEQ ID NO: 18302 - RNA, 19 nt, artificial
  Chemically synthesized
ucggagacguuggaaugcg

SEQ ID NO: 18303 - RNA, 19 nt, artificial
  Chemically synthesized
aagauucaugauugguacc

SEQ ID NO: 18304 - RNA, 19 nt, artificial
  Chemically synthesized
guacaguacugaccugucc

SEQ ID NO: 18305 - RNA, 19 nt, artificial
  Chemically synthesized
aauacugaaccugaaacaa

SEQ ID NO: 18306 - RNA, 19 nt, artificial
  Chemically synthesized
agcccguugaauuuggcgg

SEQ ID NO: 18307 - RNA, 19 nt, artificial
  Chemically synthesized
accugguccacgcaggugc

SEQ ID NO: 18308 - RNA, 19 nt, artificial
  Chemically synthesized
uugaugccguccacgcagg

SEQ ID NO: 18309 - RNA, 19 nt, artificial
  Chemically synthesized
acuuguacuccgucagcgu

SEQ ID NO: 18310 - RNA, 19 nt, artificial
  Chemically synthesized
aggaccaaaggacgcagcc

SEQ ID NO: 18311 - RNA, 19 nt, artificial
  Chemically synthesized
auccagguugaucucgcag

SEQ ID NO: 18312 - RNA, 19 nt, artificial
  Chemically synthesized
uucaggcaggucucaccgg

SEQ ID NO: 18313 - RNA, 19 nt, artificial
  Chemically synthesized
uugcuuguuuucucagaau

SEQ ID NO: 18314 - RNA, 19 nt, artificial
  Chemically synthesized
ugaugcaugcgucguugag

SEQ ID NO: 18315 - RNA, 19 nt, artificial
  Chemically synthesized
agacaugcgcaggucagcg

SEQ ID NO: 18316 - RNA, 19 nt, artificial
  Chemically synthesized
aguaaaggccgguccagcc

SEQ ID NO: 18317 - RNA, 19 nt, artificial
  Chemically synthesized
ugggagggcuggagacgcc

SEQ ID NO: 18318 - RNA, 19 nt, artificial
  Chemically synthesized
uucuucuugcuggccucag

SEQ ID NO: 18319 - RNA, 19 nt, artificial
  Chemically synthesized
ucgcaguagaaggaggcca

SEQ ID NO: 18320 - RNA, 19 nt, artificial
  Chemically synthesized
augcaugcgucguugaggu

SEQ ID NO: 18321 - RNA, 19 nt, artificial
  Chemically synthesized
ucagggaaccagagcuggc

SEQ ID NO: 18322 - RNA, 19 nt, artificial
  Chemically synthesized
aucgucgauauuuuccuca

SEQ ID NO: 18323 - RNA, 19 nt, artificial
  Chemically synthesized
acaugcuccgcacagucca

SEQ ID NO: 18324 - RNA, 19 nt, artificial
  Chemically synthesized
uuccgugcacacacaggug

SEQ ID NO: 18325 - RNA, 19 nt, artificial
  Chemically synthesized
aaacugguggacccgccca

SEQ ID NO: 18326 - RNA, 19 nt, artificial
  Chemically synthesized
ugacccaggcaagugccac

SEQ ID NO: 18327 - RNA, 19 nt, artificial
  Chemically synthesized
acagucauccagguugauc

SEQ ID NO: 18328 - RNA, 19 nt, artificial
  Chemically synthesized
gguugcacuggccuuccgc

SEQ ID NO: 18329 - RNA, 19 nt, artificial
  Chemically synthesized
ucuuccuccgugccuugag

SEQ ID NO: 18330 - RNA, 19 nt, artificial
  Chemically synthesized
cacucaucgauguccaccu

SEQ ID NO: 18331 - RNA, 19 nt, artificial
  Chemically synthesized
ugcaugggcggcuaaggcu

SEQ ID NO: 18332 - RNA, 19 nt, artificial
  Chemically synthesized
uaggaugccuccgugugug

SEQ ID NO: 18333 - RNA, 19 nt, artificial
  Chemically synthesized
uugcgcagcuccuccucgc

SEQ ID NO: 18334 - RNA, 19 nt, artificial
  Chemically synthesized
ucaacaccuugucgcugcg

SEQ ID NO: 18335 - RNA, 19 nt, artificial
  Chemically synthesized
augcagaugcacuggaacu

SEQ ID NO: 18336 - RNA, 19 nt, artificial
  Chemically synthesized
acauuuuuucugccauagg

SEQ ID NO: 18337 - RNA, 19 nt, artificial
  Chemically synthesized
acguacaugaagugcagcu

SEQ ID NO: 18338 - RNA, 19 nt, artificial
  Chemically synthesized
ucugcauaucuuuguuagc

SEQ ID NO: 18339 - RNA, 19 nt, artificial
  Chemically synthesized
agugcaugggcggcuaagg

SEQ ID NO: 18340 - RNA, 19 nt, artificial
  Chemically synthesized
ucguugacauccugccggc

SEQ ID NO: 18341 - RNA, 19 nt, artificial
  Chemically synthesized
ucgcacucauugacaucgu

SEQ ID NO: 18342 - RNA, 19 nt, artificial
  Chemically synthesized
uguaggaggccucgaaggg

SEQ ID NO: 18343 - RNA, 19 nt, artificial
  Chemically synthesized
auccacauuguucacggcg

SEQ ID NO: 18344 - RNA, 19 nt, artificial
  Chemically synthesized
aguggaaggagcuguugcg

SEQ ID NO: 18345 - RNA, 19 nt, artificial
  Chemically synthesized
ucuguguugaccucgcagu

SEQ ID NO: 18346 - RNA, 19 nt, artificial
  Chemically synthesized
agaacgcacucguugaugu

SEQ ID NO: 18347 - RNA, 19 nt, artificial
  Chemically synthesized
uggucguccaggucaggca

SEQ ID NO: 18348 - RNA, 19 nt, artificial
  Chemically synthesized
caugacacacaacagacuc

SEQ ID NO: 18349 - RNA, 19 nt, artificial
  Chemically synthesized
ggaacuucuuggucuccag

SEQ ID NO: 18350 - RNA, 19 nt, artificial
  Chemically synthesized
ugacaugcaugaugccuac

SEQ ID NO: 18351 - RNA, 19 nt, artificial
  Chemically synthesized
aggugaagccauugaugcc

SEQ ID NO: 18352 - RNA, 19 nt, artificial
  Chemically synthesized
ugugagucgcacucauuga

SEQ ID NO: 18353 - RNA, 19 nt, artificial
  Chemically synthesized
cacagugaaauucagggcc

SEQ ID NO: 18354 - RNA, 19 nt, artificial
  Chemically synthesized
ucaucugggacagggcgcu

SEQ ID NO: 18355 - RNA, 19 nt, artificial
  Chemically synthesized
ucucacucugcacggccuc

SEQ ID NO: 18356 - RNA, 19 nt, artificial
  Chemically synthesized
aguugcacuggcugucaca

SEQ ID NO: 18357 - RNA, 19 nt, artificial
  Chemically synthesized
uuggcaaagugguccagca

SEQ ID NO: 18358 - RNA, 19 nt, artificial
  Chemically synthesized
acugggugugggucugcca

SEQ ID NO: 18359 - RNA, 19 nt, artificial
  Chemically synthesized
cacucaggaagcuccggcc

SEQ ID NO: 18360 - RNA, 19 nt, artificial
  Chemically synthesized
guugucaaucuccagguag

SEQ ID NO: 18361 - RNA, 19 nt, artificial
  Chemically synthesized
accaccaccagcgugccgg

SEQ ID NO: 18362 - RNA, 19 nt, artificial
  Chemically synthesized
acaccuugugcgucggcag

SEQ ID NO: 18363 - RNA, 19 nt, artificial
  Chemically synthesized
ccacucaggaagcuccggc

SEQ ID NO: 18364 - RNA, 19 nt, artificial
  Chemically synthesized
uuguacuccgucagcguga

SEQ ID NO: 18365 - RNA, 19 nt, artificial
  Chemically synthesized
guggucugucuggucgucc

SEQ ID NO: 18366 - RNA, 19 nt, artificial
  Chemically synthesized
cagggcuugccuuugcagc

SEQ ID NO: 18367 - RNA, 19 nt, artificial
  Chemically synthesized
cauccuacguaggaaaacc

SEQ ID NO: 18368 - RNA, 19 nt, artificial
  Chemically synthesized
agcguguugaugcacuugc

SEQ ID NO: 18369 - RNA, 19 nt, artificial
  Chemically synthesized
uugaggcugcccagcgagg

SEQ ID NO: 18370 - RNA, 19 nt, artificial
  Chemically synthesized
aagugguccuugcaguacu

SEQ ID NO: 18371 - RNA, 19 nt, artificial
  Chemically synthesized
gaacagaagcacaaaggcg

SEQ ID NO: 18372 - RNA, 19 nt, artificial
  Chemically synthesized
augcccuccacggccaggc

SEQ ID NO: 18373 - RNA, 19 nt, artificial
  Chemically synthesized
ucaggcagaaccacgggcu

SEQ ID NO: 18374 - RNA, 19 nt, artificial
  Chemically synthesized
ugcaguacuggucguacag

SEQ ID NO: 18375 - RNA, 19 nt, artificial
  Chemically synthesized
aagaaucuuuucauccuac

SEQ ID NO: 18376 - RNA, 19 nt, artificial
  Chemically synthesized
caacuucccuucuccaaca

SEQ ID NO: 18377 - RNA, 19 nt, artificial
  Chemically synthesized
uacaucaucuacaguuccu

SEQ ID NO: 18378 - RNA, 19 nt, artificial
  Chemically synthesized
caugcuugcaagaaaccau

SEQ ID NO: 18379 - RNA, 19 nt, artificial
  Chemically synthesized
agacacagccgcaugcagc

SEQ ID NO: 18380 - RNA, 19 nt, artificial
  Chemically synthesized
cacucguccacauccucgg

SEQ ID NO: 18381 - RNA, 19 nt, artificial
  Chemically synthesized
auugaccucagacaggcag

SEQ ID NO: 18382 - RNA, 19 nt, artificial
  Chemically synthesized
acuuguacccguugaggcu

SEQ ID NO: 18383 - RNA, 19 nt, artificial
  Chemically synthesized
ugcgcagccaccucacagg

SEQ ID NO: 18384 - RNA, 19 nt, artificial
  Chemically synthesized
uguugcccgucuccaggcc

SEQ ID NO: 18385 - RNA, 19 nt, artificial
  Chemically synthesized
acgucugacagguagccau

SEQ ID NO: 18386 - RNA, 19 nt, artificial
  Chemically synthesized
ucugcgguccaccacgugg

SEQ ID NO: 18387 - RNA, 19 nt, artificial
  Chemically synthesized
aguuggguccugugguccc

SEQ ID NO: 18388 - RNA, 19 nt, artificial
  Chemically synthesized
aucucacagugcacacccu

SEQ ID NO: 18389 - RNA, 19 nt, artificial
  Chemically synthesized
ucuguaaacuacacucuau

SEQ ID NO: 18390 - RNA, 19 nt, artificial
  Chemically synthesized
ugggacuucuuccuccgug

SEQ ID NO: 18391 - RNA, 19 nt, artificial
  Chemically synthesized
acucuggaagcacugcgag

SEQ ID NO: 18392 - RNA, 19 nt, artificial
  Chemically synthesized
ugggugugggucugccagc

SEQ ID NO: 18393 - RNA, 19 nt, artificial
  Chemically synthesized
cugaguugcacuggcuguc

SEQ ID NO: 18394 - RNA, 19 nt, artificial
  Chemically synthesized
uguuuccuauuucagaugc

SEQ ID NO: 18395 - RNA, 19 nt, artificial
  Chemically synthesized
ugaagugcagcugcgccgg

SEQ ID NO: 18396 - RNA, 19 nt, artificial
  Chemically synthesized
agacugcgugcaguucuuc

SEQ ID NO: 18397 - RNA, 19 nt, artificial
  Chemically synthesized
acaccuugucgcugcgcag

SEQ ID NO: 18398 - RNA, 19 nt, artificial
  Chemically synthesized
acagacucauucauuaaga

SEQ ID NO: 18399 - RNA, 19 nt, artificial
  Chemically synthesized
guagaucacuuuuaaaguc

SEQ ID NO: 18400 - RNA, 19 nt, artificial
  Chemically synthesized
uccacauuguucacggcgg

SEQ ID NO: 18401 - RNA, 19 nt, artificial
  Chemically synthesized
agacgcacucguugacguc

SEQ ID NO: 18402 - RNA, 19 nt, artificial
  Chemically synthesized
ucgagacgcacucguugac

SEQ ID NO: 18403 - RNA, 19 nt, artificial
  Chemically synthesized
cacuuguacccguugaggc

SEQ ID NO: 18404 - RNA, 19 nt, artificial
  Chemically synthesized
ugccuuugcagccauugau

SEQ ID NO: 18405 - RNA, 19 nt, artificial
  Chemically synthesized
aagucugacgucccucacu

SEQ ID NO: 18406 - RNA, 19 nt, artificial
  Chemically synthesized
auugacgcgcugcacgcag

SEQ ID NO: 18407 - RNA, 19 nt, artificial
  Chemically synthesized
cuuggcaccauucuugcag

SEQ ID NO: 18408 - RNA, 19 nt, artificial
  Chemically synthesized
acugaccuguccacucugg

SEQ ID NO: 18409 - RNA, 19 nt, artificial
  Chemically synthesized
cugccuggcucggcucucc

SEQ ID NO: 18410 - RNA, 19 nt, artificial
  Chemically synthesized
ucaguggcgucgugccauc

SEQ ID NO: 18411 - RNA, 19 nt, artificial
  Chemically synthesized
cguugaagcaggagcucuc

SEQ ID NO: 18412 - RNA, 19 nt, artificial
  Chemically synthesized
ugcugcugcaucuguaagu

SEQ ID NO: 18413 - RNA, 19 nt, artificial
  Chemically synthesized
cacuugcagaugaacccgc

SEQ ID NO: 18414 - RNA, 19 nt, artificial
  Chemically synthesized
cguguuguucucacagugg

SEQ ID NO: 18415 - RNA, 19 nt, artificial
  Chemically synthesized
aucagagcgugaguagcgg

SEQ ID NO: 18416 - RNA, 19 nt, artificial
  Chemically synthesized
uugaaggccuccggaaugc

SEQ ID NO: 18417 - RNA, 19 nt, artificial
  Chemically synthesized
agaagcucucauaguccuc

SEQ ID NO: 18418 - RNA, 19 nt, artificial
  Chemically synthesized
auugaugccguccucgcag

SEQ ID NO: 18419 - RNA, 19 nt, artificial
  Chemically synthesized
ucguuguggcaggugccuc

SEQ ID NO: 18420 - RNA, 19 nt, artificial
  Chemically synthesized
aucguacuggcacagaugc

SEQ ID NO: 18421 - RNA, 19 nt, artificial
  Chemically synthesized
cuggucaugucuuugcagg

SEQ ID NO: 18422 - RNA, 19 nt, artificial
  Chemically synthesized
acagagcgcacacagacgc

SEQ ID NO: 18423 - RNA, 19 nt, artificial
  Chemically synthesized
uguagcccugcagacacug

SEQ ID NO: 18424 - RNA, 19 nt, artificial
  Chemically synthesized
ugcccugaggagugcaggc

SEQ ID NO: 18425 - RNA, 19 nt, artificial
  Chemically synthesized
uuguccacaggcgaggagu

SEQ ID NO: 18426 - RNA, 19 nt, artificial
  Chemically synthesized
aaggcuccucuggucggcc

SEQ ID NO: 18427 - RNA, 19 nt, artificial
  Chemically synthesized
uuugcaggugccgccguug

SEQ ID NO: 18428 - RNA, 19 nt, artificial
  Chemically synthesized
ucucggaugugggcucaca

SEQ ID NO: 18429 - RNA, 19 nt, artificial
  Chemically synthesized
ugcagcuguagccgcccac

SEQ ID NO: 18430 - RNA, 19 nt, artificial
  Chemically synthesized
gucgcacucaucgaugucc

SEQ ID NO: 18431 - RNA, 19 nt, artificial
  Chemically synthesized
aguggaucccgcugaagcc

SEQ ID NO: 18432 - RNA, 19 nt, artificial
  Chemically synthesized
agucuccuacaaaacacgg

SEQ ID NO: 18433 - RNA, 19 nt, artificial
  Chemically synthesized
acgcaguucugggugccac

SEQ ID NO: 18434 - RNA, 19 nt, artificial
  Chemically synthesized
uccacguccuggcugcagg

SEQ ID NO: 18435 - RNA, 19 nt, artificial
  Chemically synthesized
auugacaggguuggugucg

SEQ ID NO: 18436 - RNA, 19 nt, artificial
  Chemically synthesized
ucggcgugugaguugauga

SEQ ID NO: 18437 - RNA, 19 nt, artificial
  Chemically synthesized
acagugaaauucagggccc

SEQ ID NO: 18438 - RNA, 19 nt, artificial
  Chemically synthesized
ucuacaguuccucauguag

SEQ ID NO: 18439 - RNA, 19 nt, artificial
  Chemically synthesized
uugccuuugcagccauuga

SEQ ID NO: 18440 - RNA, 19 nt, artificial
  Chemically synthesized
ucuccucccuguuguucug

SEQ ID NO: 18441 - RNA, 19 nt, artificial
  Chemically synthesized
cacuuguacuccgucagcg

SEQ ID NO: 18442 - RNA, 19 nt, artificial
  Chemically synthesized
uguucugcauaucuuuguu

SEQ ID NO: 18443 - RNA, 19 nt, artificial
  Chemically synthesized
uccacacaucucauguuug

SEQ ID NO: 18444 - RNA, 19 nt, artificial
  Chemically synthesized
uaggagccgaccucguugu

SEQ ID NO: 18445 - RNA, 19 nt, artificial
  Chemically synthesized
ucguugagguggcacagca

SEQ ID NO: 18446 - RNA, 19 nt, artificial
  Chemically synthesized
uugcccgcaugcucgcagg

SEQ ID NO: 18447 - RNA, 19 nt, artificial
  Chemically synthesized
acaucgugcuggcaguagc

SEQ ID NO: 18448 - RNA, 19 nt, artificial
  Chemically synthesized
uugcaagaaaccaucuaaa

SEQ ID NO: 18449 - RNA, 19 nt, artificial
  Chemically synthesized
acacgcaguuguagccacc

SEQ ID NO: 18450 - RNA, 19 nt, artificial
  Chemically synthesized
agucgcacucauugacauc

SEQ ID NO: 18451 - RNA, 19 nt, artificial
  Chemically synthesized
aagccuggcaggcaggcac

SEQ ID NO: 18452 - RNA, 19 nt, artificial
  Chemically synthesized
aaggccuccggaaugcggg

SEQ ID NO: 18453 - RNA, 19 nt, artificial
  Chemically synthesized
aaagcccgggcuucuggcc

SEQ ID NO: 18454 - RNA, 19 nt, artificial
  Chemically synthesized
uugacgucggcgugugagu

SEQ ID NO: 18455 - RNA, 19 nt, artificial
  Chemically synthesized
cacuccgcgcuguugcagc

SEQ ID NO: 18456 - RNA, 19 nt, artificial
  Chemically synthesized
gcacacucguugauguugg

SEQ ID NO: 18457 - RNA, 19 nt, artificial
  Chemically synthesized
uguacuccgucagcgugag

SEQ ID NO: 18458 - RNA, 19 nt, artificial
  Chemically synthesized
uggguguucuggcaggaug

SEQ ID NO: 18459 - RNA, 19 nt, artificial
  Chemically synthesized
gaagcucucauaguccucg

SEQ ID NO: 18460 - RNA, 19 nt, artificial
  Chemically synthesized
ucuugcagggcuugccuuu

SEQ ID NO: 18461 - RNA, 19 nt, artificial
  Chemically synthesized
agcaccuuggcggucucgu

SEQ ID NO: 18462 - RNA, 19 nt, artificial
  Chemically synthesized
auucacacucauuguuguu

SEQ ID NO: 18463 - RNA, 19 nt, artificial
  Chemically synthesized
uuggcacccagcgagcacu

SEQ ID NO: 18464 - RNA, 19 nt, artificial
  Chemically synthesized
auugaucuuguccaggcag

SEQ ID NO: 18465 - RNA, 19 nt, artificial
  Chemically synthesized
auaaaaguuucuaccuggg

SEQ ID NO: 18466 - RNA, 19 nt, artificial
  Chemically synthesized
caugcagucggcgucaacc

SEQ ID NO: 18467 - RNA, 19 nt, artificial
  Chemically synthesized
ugaggcagcgcaggcugcc

SEQ ID NO: 18468 - RNA, 19 nt, Artificial Sequence
  Chemically synthesized
gaaggcuugggaaaggaag

SEQ ID NO: 18469 - RNA, 19 nt, artificial
  Chemically synthesized
ggcuucacgggcagcuacu

SEQ ID NO: 18470 - RNA, 19 nt, artificial
  Chemically synthesized
gcgcagaugccaacaucca

SEQ ID NO: 18471 - RNA, 19 nt, artificial
  Chemically synthesized
ugcacaccaacguggucuu

SEQ ID NO: 18472 - RNA, 19 nt, artificial
  Chemically synthesized
ugcagacccagcaggugca

SEQ ID NO: 18473 - RNA, 19 nt, artificial
  Chemically synthesized
guugugcuccugaagaacg

SEQ ID NO: 18474 - RNA, 19 nt, artificial
  Chemically synthesized
ucugugaggaggacaucaa

SEQ ID NO: 18475 - RNA, 19 nt, artificial
  Chemically synthesized
gaaacacugccuuuuuauu

SEQ ID NO: 18476 - RNA, 19 nt, artificial
  Chemically synthesized
gccaggacguggaugagug

SEQ ID NO: 18477 - RNA, 19 nt, artificial
  Chemically synthesized
accgggacaucacggauca

SEQ ID NO: 18478 - RNA, 19 nt, artificial
  Chemically synthesized
cccucaacuucaaugaccc

SEQ ID NO: 18479 - RNA, 19 nt, artificial
  Chemically synthesized
guggacaggucaguacugu

SEQ ID NO: 18480 - RNA, 19 nt, artificial
  Chemically synthesized
gaccaguacugcaaggacc

SEQ ID NO: 18481 - RNA, 19 nt, artificial
  Chemically synthesized
gccaacauccaggacaaca

SEQ ID NO: 18482 - RNA, 19 nt, artificial
  Chemically synthesized
ggugcugcugucccgcaag

SEQ ID NO: 18483 - RNA, 19 nt, artificial
  Chemically synthesized
cgacugcauggacgucaau

SEQ ID NO: 18484 - RNA, 19 nt, artificial
  Chemically synthesized
ccuguguggacggcgugaa

SEQ ID NO: 18485 - RNA, 19 nt, artificial
  Chemically synthesized
cugugacagccagugcaac

SEQ ID NO: 18486 - RNA, 19 nt, artificial
  Chemically synthesized
gggcuacacagggagcaug

SEQ ID NO: 18487 - RNA, 19 nt, artificial
  Chemically synthesized
acugcauggacgucaaugu

SEQ ID NO: 18488 - RNA, 19 nt, artificial
  Chemically synthesized
gcgacugccugcccggcuu

SEQ ID NO: 18489 - RNA, 19 nt, artificial
  Chemically synthesized
gagaccaagaaguuccggu

SEQ ID NO: 18490 - RNA, 19 nt, artificial
  Chemically synthesized
guguaguuuacagaaaaag

SEQ ID NO: 18491 - RNA, 19 nt, artificial
  Chemically synthesized
cugcucccucaacuucaau

SEQ ID NO: 18492 - RNA, 19 nt, artificial
  Chemically synthesized
ccugaccagugguccagcu

SEQ ID NO: 18493 - RNA, 19 nt, artificial
  Chemically synthesized
ccaaccgggacaucacgga

SEQ ID NO: 18494 - RNA, 19 nt, artificial
  Chemically synthesized
agaccaccggcaguggacu

SEQ ID NO: 18495 - RNA, 19 nt, artificial
  Chemically synthesized
gacccagcaggugcagcca

SEQ ID NO: 18496 - RNA, 19 nt, artificial
  Chemically synthesized
ggaccacaggacccaacug

SEQ ID NO: 18497 - RNA, 19 nt, artificial
  Chemically synthesized
cacagaaacacugccuuuu

SEQ ID NO: 18498 - RNA, 19 nt, artificial
  Chemically synthesized
cacuuugccaaccgggaca

SEQ ID NO: 18499 - RNA, 19 nt, artificial
  Chemically synthesized
ccaacguggucuucaagcg

SEQ ID NO: 18500 - RNA, 19 nt, artificial
  Chemically synthesized
gucaucuccgacuucaucu

SEQ ID NO: 18501 - RNA, 19 nt, artificial
  Chemically synthesized
cauccuggacuacagcuuc

SEQ ID NO: 18502 - RNA, 19 nt, artificial
  Chemically synthesized
agaaacacugccuuuuuau

SEQ ID NO: 18503 - RNA, 19 nt, artificial
  Chemically synthesized
acagaaacacugccuuuuu

SEQ ID NO: 18504 - RNA, 19 nt, artificial
  Chemically synthesized
accuggugcagacccagca

SEQ ID NO: 18505 - RNA, 19 nt, artificial
  Chemically synthesized
agaacauugaugacugugc

SEQ ID NO: 18506 - RNA, 19 nt, artificial
  Chemically synthesized
ccgggacaucacggaucau

SEQ ID NO: 18507 - RNA, 19 nt, artificial
  Chemically synthesized
cugugagcccacauccgag

SEQ ID NO: 18508 - RNA, 19 nt, artificial
  Chemically synthesized
cacaccaacguggucuuca

SEQ ID NO: 18509 - RNA, 19 nt, artificial
  Chemically synthesized
gccacugugacagccagug

SEQ ID NO: 18510 - RNA, 19 nt, artificial
  Chemically synthesized
aguugugcuccugaagaac

SEQ ID NO: 18511 - RNA, 19 nt, artificial
  Chemically synthesized
caacugugacaucaacaac

SEQ ID NO: 18512 - RNA, 19 nt, artificial
  Chemically synthesized
gaugccaacauccaggaca

SEQ ID NO: 18513 - RNA, 19 nt, artificial
  Chemically synthesized
acauccuggacuacagcuu

SEQ ID NO: 18514 - RNA, 19 nt, artificial
  Chemically synthesized
cggccacugugacagccag

SEQ ID NO: 18515 - RNA, 19 nt, artificial
  Chemically synthesized
agaguggacaggucaguac

SEQ ID NO: 18516 - RNA, 19 nt, artificial
  Chemically synthesized
gcgugcugcacaccaacgu

SEQ ID NO: 18517 - RNA, 19 nt, artificial
  Chemically synthesized
auccaacccuugugucaac

SEQ ID NO: 18518 - RNA, 19 nt, artificial
  Chemically synthesized
aguggacaggucaguacug

SEQ ID NO: 18519 - RNA, 19 nt, artificial
  Chemically synthesized
gccuguguggacggcguga

SEQ ID NO: 18520 - RNA, 19 nt, artificial
  Chemically synthesized
gugacagccagugcaacuc

SEQ ID NO: 18521 - RNA, 19 nt, artificial
  Chemically synthesized
caguacugcaaggaccacu

SEQ ID NO: 18522 - RNA, 19 nt, artificial
  Chemically synthesized
guggccagugccugcccuu

SEQ ID NO: 18523 - RNA, 19 nt, artificial
  Chemically synthesized
uggagggcaugcuggagga

SEQ ID NO: 18524 - RNA, 19 nt, artificial
  Chemically synthesized
cacuuccugcgggagcuca

SEQ ID NO: 18525 - RNA, 19 nt, artificial
  Chemically synthesized
cugugaggaggacaucaac

SEQ ID NO: 18526 - RNA, 19 nt, artificial
  Chemically synthesized
ccagcgcagaugccaacau

SEQ ID NO: 18527 - RNA, 19 nt, artificial
  Chemically synthesized
gacuucaucuaccagggcg

SEQ ID NO: 18528 - RNA, 19 nt, artificial
  Chemically synthesized
ccacugugacagccagugc

SEQ ID NO: 18529 - RNA, 19 nt, artificial
  Chemically synthesized
gcuggacuggugaggacug

SEQ ID NO: 18530 - RNA, 19 nt, artificial
  Chemically synthesized
ggugcagacccagcaggug

SEQ ID NO: 18531 - RNA, 19 nt, artificial
  Chemically synthesized
gccagcgcagaugccaaca

SEQ ID NO: 18532 - RNA, 19 nt, artificial
  Chemically synthesized
uccuucuacugcgaguguc

SEQ ID NO: 18533 - RNA, 19 nt, artificial
  Chemically synthesized
caacguggucuucaagcgu

SEQ ID NO: 18534 - RNA, 19 nt, artificial
  Chemically synthesized
acugccagaaccuugugca

SEQ ID NO: 18535 - RNA, 19 nt, artificial
  Chemically synthesized
gagaacauugaugacugug

SEQ ID NO: 18536 - RNA, 19 nt, artificial
  Chemically synthesized
caccaacguggucuucaag

SEQ ID NO: 18537 - RNA, 19 nt, artificial
  Chemically synthesized
uggagaccaagaaguuccg

SEQ ID NO: 18538 - RNA, 19 nt, artificial
  Chemically synthesized
cggaggaagaagucccagg

SEQ ID NO: 18539 - RNA, 19 nt, artificial
  Chemically synthesized
agccaggacguggaugagu

SEQ ID NO: 18540 - RNA, 19 nt, artificial
  Chemically synthesized
uacugcaaggaccacuuca

SEQ ID NO: 18541 - RNA, 19 nt, artificial
  Chemically synthesized
agcauggccagcucugguu

SEQ ID NO: 18542 - RNA, 19 nt, artificial
  Chemically synthesized
gcuggaccacuuugccaac

SEQ ID NO: 18543 - RNA, 19 nt, artificial
  Chemically synthesized
acaugaccaguggcuacgu

SEQ ID NO: 18544 - RNA, 19 nt, artificial
  Chemically synthesized
ggaccacuuugccaaccgg

SEQ ID NO: 18545 - RNA, 19 nt, artificial
  Chemically synthesized
ccuggugcagacccagcag

SEQ ID NO: 18546 - RNA, 19 nt, artificial
  Chemically synthesized
ggccagcucugguucccug

SEQ ID NO: 18547 - RNA, 19 nt, artificial
  Chemically synthesized
ggacuggugaggacugcag

SEQ ID NO: 18548 - RNA, 19 nt, artificial
  Chemically synthesized
ggcagcuacugugaggacc

SEQ ID NO: 18549 - RNA, 19 nt, artificial
  Chemically synthesized
cuacacagggagcaugugu

SEQ ID NO: 18550 - RNA, 19 nt, artificial
  Chemically synthesized
gguggccagugccugcccu

SEQ ID NO: 18551 - RNA, 19 nt, artificial
  Chemically synthesized
acugcaaggaccacuucag

SEQ ID NO: 18552 - RNA, 19 nt, artificial
  Chemically synthesized
accacuuugccaaccggga

SEQ ID NO: 18553 - RNA, 19 nt, artificial
  Chemically synthesized
cagcgcagaugccaacauc

SEQ ID NO: 18554 - RNA, 19 nt, artificial
  Chemically synthesized
aggaaacaacugcaagaac

SEQ ID NO: 18555 - RNA, 19 nt, artificial
  Chemically synthesized
cgugcugcacaccaacgug

SEQ ID NO: 18556 - RNA, 19 nt, artificial
  Chemically synthesized
aguagcugcccgugaagcc

SEQ ID NO: 18557 - RNA, 19 nt, artificial
  Chemically synthesized
uggauguuggcaucugcgc

SEQ ID NO: 18558 - RNA, 19 nt, artificial
  Chemically synthesized
aagaccacguuggugugca

SEQ ID NO: 18559 - RNA, 19 nt, artificial
  Chemically synthesized
ugcaccugcugggucugca

SEQ ID NO: 18560 - RNA, 19 nt, artificial
  Chemically synthesized
cguucuucaggagcacaac

SEQ ID NO: 18561 - RNA, 19 nt, artificial
  Chemically synthesized
uugauguccuccucacaga

SEQ ID NO: 18562 - RNA, 19 nt, artificial
  Chemically synthesized
aauaaaaaggcaguguuuc

SEQ ID NO: 18563 - RNA, 19 nt, artificial
  Chemically synthesized
cacucauccacguccuggc

SEQ ID NO: 18564 - RNA, 19 nt, artificial
  Chemically synthesized
ugauccgugaugucccggu

SEQ ID NO: 18565 - RNA, 19 nt, artificial
  Chemically synthesized
gggucauugaaguugaggg

SEQ ID NO: 18566 - RNA, 19 nt, artificial
  Chemically synthesized
acaguacugaccuguccac

SEQ ID NO: 18567 - RNA, 19 nt, artificial
  Chemically synthesized
gguccuugcaguacugguc

SEQ ID NO: 18568 - RNA, 19 nt, artificial
  Chemically synthesized
uguuguccuggauguuggc

SEQ ID NO: 18569 - RNA, 19 nt, artificial
  Chemically synthesized
cuugcgggacagcagcacc

SEQ ID NO: 18570 - RNA, 19 nt, artificial
  Chemically synthesized
auugacguccaugcagucg

SEQ ID NO: 18571 - RNA, 19 nt, artificial
  Chemically synthesized
uucacgccguccacacagg

SEQ ID NO: 18572 - RNA, 19 nt, artificial
  Chemically synthesized
guugcacuggcugucacag

SEQ ID NO: 18573 - RNA, 19 nt, artificial
  Chemically synthesized
caugcucccuguguagccc

SEQ ID NO: 18574 - RNA, 19 nt, artificial
  Chemically synthesized
acauugacguccaugcagu

SEQ ID NO: 18575 - RNA, 19 nt, artificial
  Chemically synthesized
aagccgggcaggcagucgc

SEQ ID NO: 18576 - RNA, 19 nt, artificial
  Chemically synthesized
accggaacuucuuggucuc

SEQ ID NO: 18577 - RNA, 19 nt, artificial
  Chemically synthesized
cuuuuucuguaaacuacac

SEQ ID NO: 18578 - RNA, 19 nt, artificial
  Chemically synthesized
auugaaguugagggagcag

SEQ ID NO: 18579 - RNA, 19 nt, artificial
  Chemically synthesized
agcuggaccacuggucagg

SEQ ID NO: 18580 - RNA, 19 nt, artificial
  Chemically synthesized
uccgugaugucccgguugg

SEQ ID NO: 18581 - RNA, 19 nt, artificial
  Chemically synthesized
aguccacugccgguggucu

SEQ ID NO: 18582 - RNA, 19 nt, artificial
  Chemically synthesized
uggcugcaccugcuggguc

SEQ ID NO: 18583 - RNA, 19 nt, artificial
  Chemically synthesized
caguuggguccuguggucc

SEQ ID NO: 18584 - RNA, 19 nt, artificial
  Chemically synthesized
aaaaggcaguguuucugug

SEQ ID NO: 18585 - RNA, 19 nt, artificial
  Chemically synthesized
ugucccgguuggcaaagug

SEQ ID NO: 18586 - RNA, 19 nt, artificial
  Chemically synthesized
cgcuugaagaccacguugg

SEQ ID NO: 18587 - RNA, 19 nt, artificial
  Chemically synthesized
agaugaagucggagaugac

SEQ ID NO: 18588 - RNA, 19 nt, artificial
  Chemically synthesized
gaagcuguaguccaggaug

SEQ ID NO: 18589 - RNA, 19 nt, artificial
  Chemically synthesized
auaaaaaggcaguguuucu

SEQ ID NO: 18590 - RNA, 19 nt, artificial
  Chemically synthesized
aaaaaggcaguguuucugu

SEQ ID NO: 18591 - RNA, 19 nt, artificial
  Chemically synthesized
ugcugggucugcaccaggu

SEQ ID NO: 18592 - RNA, 19 nt, artificial
  Chemically synthesized
gcacagucaucaauguucu

SEQ ID NO: 18593 - RNA, 19 nt, artificial
  Chemically synthesized
augauccgugaugucccgg

SEQ ID NO: 18594 - RNA, 19 nt, artificial
  Chemically synthesized
cucggaugugggcucacag

SEQ ID NO: 18595 - RNA, 19 nt, artificial
  Chemically synthesized
ugaagaccacguuggugug

SEQ ID NO: 18596 - RNA, 19 nt, artificial
  Chemically synthesized
cacuggcugucacaguggc

SEQ ID NO: 18597 - RNA, 19 nt, artificial
  Chemically synthesized
guucuucaggagcacaacu

SEQ ID NO: 18598 - RNA, 19 nt, artificial
  Chemically synthesized
guuguugaugucacaguug

SEQ ID NO: 18599 - RNA, 19 nt, artificial
  Chemically synthesized
uguccuggauguuggcauc

SEQ ID NO: 18600 - RNA, 19 nt, artificial
  Chemically synthesized
aagcuguaguccaggaugu

SEQ ID NO: 18601 - RNA, 19 nt, artificial
  Chemically synthesized
cuggcugucacaguggccg

SEQ ID NO: 18602 - RNA, 19 nt, artificial
  Chemically synthesized
guacugaccuguccacucu

SEQ ID NO: 18603 - RNA, 19 nt, artificial
  Chemically synthesized
acguuggugugcagcacgc

SEQ ID NO: 18604 - RNA, 19 nt, artificial
  Chemically synthesized
guugacacaaggguuggau

SEQ ID NO: 18605 - RNA, 19 nt, artificial
  Chemically synthesized
caguacugaccuguccacu

SEQ ID NO: 18606 - RNA, 19 nt, artificial
  Chemically synthesized
ucacgccguccacacaggc

SEQ ID NO: 18607 - RNA, 19 nt, artificial
  Chemically synthesized
gaguugcacuggcugucac

SEQ ID NO: 18608 - RNA, 19 nt, artificial
  Chemically synthesized
agugguccuugcaguacug

SEQ ID NO: 18609 - RNA, 19 nt, artificial
  Chemically synthesized
aagggcaggcacuggccac

SEQ ID NO: 18610 - RNA, 19 nt, artificial
  Chemically synthesized
uccuccagcaugcccucca

SEQ ID NO: 18611 - RNA, 19 nt, artificial
  Chemically synthesized
ugagcucccgcaggaagug

SEQ ID NO: 18612 - RNA, 19 nt, artificial
  Chemically synthesized
guugauguccuccucacag

SEQ ID NO: 18613 - RNA, 19 nt, artificial
  Chemically synthesized
auguuggcaucugcgcugg

SEQ ID NO: 18614 - RNA, 19 nt, artificial
  Chemically synthesized
cgcccugguagaugaaguc

SEQ ID NO: 18615 - RNA, 19 nt, artificial
  Chemically synthesized
gcacuggcugucacagugg

SEQ ID NO: 18616 - RNA, 19 nt, artificial
  Chemically synthesized
caguccucaccaguccagc

SEQ ID NO: 18617 - RNA, 19 nt, artificial
  Chemically synthesized
caccugcugggucugcacc

SEQ ID NO: 18618 - RNA, 19 nt, artificial
  Chemically synthesized
uguuggcaucugcgcuggc

SEQ ID NO: 18619 - RNA, 19 nt, artificial
  Chemically synthesized
gacacucgcaguagaagga

SEQ ID NO: 18620 - RNA, 19 nt, artificial
  Chemically synthesized
acgcuugaagaccacguug

SEQ ID NO: 18621 - RNA, 19 nt, artificial
  Chemically synthesized
ugcacaagguucuggcagu

SEQ ID NO: 18622 - RNA, 19 nt, artificial
  Chemically synthesized
cacagucaucaauguucuc

SEQ ID NO: 18623 - RNA, 19 nt, artificial
  Chemically synthesized
cuugaagaccacguuggug

SEQ ID NO: 18624 - RNA, 19 nt, artificial
  Chemically synthesized
cggaacuucuuggucucca

SEQ ID NO: 18625 - RNA, 19 nt, artificial
  Chemically synthesized
ccugggacuucuuccuccg

SEQ ID NO: 18626 - RNA, 19 nt, artificial
  Chemically synthesized
acucauccacguccuggcu

SEQ ID NO: 18627 - RNA, 19 nt, artificial
  Chemically synthesized
ugaagugguccuugcagua

SEQ ID NO: 18628 - RNA, 19 nt, artificial
  Chemically synthesized
aaccagagcuggccaugcu

SEQ ID NO: 18629 - RNA, 19 nt, artificial
  Chemically synthesized
guuggcaaagugguccagc

SEQ ID NO: 18630 - RNA, 19 nt, artificial
  Chemically synthesized
acguagccacuggucaugu

SEQ ID NO: 18631 - RNA, 19 nt, artificial
  Chemically synthesized
ccgguuggcaaaguggucc

SEQ ID NO: 18632 - RNA, 19 nt, artificial
  Chemically synthesized
cugcugggucugcaccagg

SEQ ID NO: 18633 - RNA, 19 nt, artificial
  Chemically synthesized
cagggaaccagagcuggcc

SEQ ID NO: 18634 - RNA, 19 nt, artificial
  Chemically synthesized
cugcaguccucaccagucc

SEQ ID NO: 18635 - RNA, 19 nt, artificial
  Chemically synthesized
gguccucacaguagcugcc

SEQ ID NO: 18636 - RNA, 19 nt, artificial
  Chemically synthesized
acacaugcucccuguguag

SEQ ID NO: 18637 - RNA, 19 nt, artificial
  Chemically synthesized
agggcaggcacuggccacc

SEQ ID NO: 18638 - RNA, 19 nt, artificial
  Chemically synthesized
cugaagugguccuugcagu

SEQ ID NO: 18639 - RNA, 19 nt, artificial
  Chemically synthesized
ucccgguuggcaaaguggu

SEQ ID NO: 18640 - RNA, 19 nt, artificial
  Chemically synthesized
gauguuggcaucugcgcug

SEQ ID NO: 18641 - RNA, 19 nt, artificial
  Chemically synthesized
guucuugcaguuguuuccu

SEQ ID NO: 18642 - RNA, 19 nt, artificial
  Chemically synthesized
cacguuggugugcagcacg

SEQ ID NO: 18643 - RNA, 18 nt, artificial
  Chemically synthesized
ggcaagcccugcaagaau

SEQ ID NO: 18644 - RNA, 18 nt, artificial
  Chemically synthesized
gcgagaacauugaugacu

SEQ ID NO: 18645 - RNA, 18 nt, artificial
  Chemically synthesized
gguucaguauuauguagu

SEQ ID NO: 18646 - RNA, 18 nt, artificial
  Chemically synthesized
ggagaagggaaguugaac

SEQ ID NO: 18647 - RNA, 18 nt, artificial
  Chemically synthesized
ggcaagcccugcaagaau

SEQ ID NO: 18648 - RNA, 18 nt, artificial
  Chemically synthesized
ggaccuggagaccaagaa

SEQ ID NO: 18649 - RNA, 18 nt, artificial
  Chemically synthesized
agaccaacaucaacgagu

SEQ ID NO: 18650 - RNA, 18 nt, artificial
  Chemically synthesized
cagguucaguauuaugua

SEQ ID NO: 18651 - RNA, 18 nt, artificial
  Chemically synthesized
agccuauggcagaaaaaa

SEQ ID NO: 18652 - RNA, 18 nt, artificial
  Chemically synthesized
ggaaguugaacgagcaua

SEQ ID NO: 18653 - RNA, 18 nt, artificial
  Chemically synthesized
gcgagaacauugaugacu

SEQ ID NO: 18654 - RNA, 18 nt, artificial
  Chemically synthesized
ggguccaccaguuugaau

SEQ ID NO: 18655 - RNA, 18 nt, artificial
  Chemically synthesized
ggcgccacgugugagaau

SEQ ID NO: 18656 - RNA, 18 nt, artificial
  Chemically synthesized
ggaugaaaagauucuucu

SEQ ID NO: 18657 - RNA, 18 nt, artificial
  Chemically synthesized
gggaguuccagugcaucu

SEQ ID NO: 18658 - RNA, 18 nt, artificial
  Chemically synthesized
gauccacugugagaacaa

SEQ ID NO: 18659 - RNA, 18 nt, artificial
  Chemically synthesized
gccacaaaacuuacagau

SEQ ID NO: 18660 - RNA, 18 nt, artificial
  Chemically synthesized
ggaccuggagaccaagaa

SEQ ID NO: 18661 - RNA, 18 nt, artificial
  Chemically synthesized
ggugagaccugccugaau

SEQ ID NO: 18662 - RNA, 18 nt, artificial
  Chemically synthesized
ggauuaauuugcaucuga

SEQ ID NO: 18663 - RNA, 18 nt, artificial
  Chemically synthesized
gggugugcacugugagau

SEQ ID NO: 18664 - RNA, 18 nt, artificial
  Chemically synthesized
caaugagugugaauccaa

SEQ ID NO: 18665 - RNA, 18 nt, artificial
  Chemically synthesized
gggcaagaagguccgcaa

SEQ ID NO: 18666 - RNA, 18 nt, artificial
  Chemically synthesized
ggagaagggaaguugaac

SEQ ID NO: 18667 - RNA, 18 nt, artificial
  Chemically synthesized
ggagaagcugcauccaga

SEQ ID NO: 18668 - RNA, 18 nt, artificial
  Chemically synthesized
caagcaugcuugugaaaa

SEQ ID NO: 18669 - RNA, 18 nt, artificial
  Chemically synthesized
gcggauuaauuugcaucu

SEQ ID NO: 18670 - RNA, 18 nt, artificial
  Chemically synthesized
agaccaacaucaacgagu

SEQ ID NO: 18671 - RNA, 18 nt, artificial
  Chemically synthesized
gccuauggcagaaaaaau

SEQ ID NO: 18672 - RNA, 18 nt, artificial
  Chemically synthesized
gcgacaagguguugacgu

SEQ ID NO: 18673 - RNA, 18 nt, artificial
  Chemically synthesized
ccuuugugcuucuguucu

SEQ ID NO: 18674 - RNA, 18 nt, artificial
  Chemically synthesized
ggguggagugggaccaac

SEQ ID NO: 18675 - RNA, 18 nt, artificial
  Chemically synthesized
gggacaucacggaucaua

SEQ ID NO: 18676 - RNA, 18 nt, artificial
  Chemically synthesized
gagugugcguccaaccca

SEQ ID NO: 18677 - RNA, 18 nt, artificial
  Chemically synthesized
gaguguaguuuacagaaa

SEQ ID NO: 18678 - RNA, 18 nt, artificial
  Chemically synthesized
ggcaggaugucaacgagu

SEQ ID NO: 18679 - RNA, 18 nt, artificial
  Chemically synthesized
ggugcagccacaaaacuu

SEQ ID NO: 18680 - RNA, 18 nt, artificial
  Chemically synthesized
ggucaguacuguaccgag

SEQ ID NO: 18681 - RNA, 18 nt, artificial
  Chemically synthesized
ggacaagaucaaugaguu

SEQ ID NO: 18682 - RNA, 18 nt, artificial
  Chemically synthesized
ccacaaaacuuacagaug

SEQ ID NO: 18683 - RNA, 18 nt, artificial
  Chemically synthesized
gucccaagauguugauuu

SEQ ID NO: 18684 - RNA, 18 nt, artificial
  Chemically synthesized
ggaaacaacugcaagaac

SEQ ID NO: 18685 - RNA, 18 nt, artificial
  Chemically synthesized
ggaagaacugcacgcagu

SEQ ID NO: 18686 - RNA, 18 nt, artificial
  Chemically synthesized
guuucagguucaguauua

SEQ ID NO: 18687 - RNA, 18 nt, artificial
  Chemically synthesized
gacugcagcgagaacauu

SEQ ID NO: 18688 - RNA, 18 nt, artificial
  Chemically synthesized
cgugcagagugagaccgu

SEQ ID NO: 18689 - RNA, 18 nt, artificial
  Chemically synthesized
ggguccaccaguuugaau

SEQ ID NO: 18690 - RNA, 18 nt, artificial
  Chemically synthesized
gcaggugcagccacaaaa

SEQ ID NO: 18691 - RNA, 18 nt, artificial
  Chemically synthesized
ggcgccacgugugagaau

SEQ ID NO: 18692 - RNA, 18 nt, artificial
  Chemically synthesized
gccagaaccuugugcacu

SEQ ID NO: 18693 - RNA, 18 nt, artificial
  Chemically synthesized
agaucaaugaguuccagu

SEQ ID NO: 18694 - RNA, 18 nt, artificial
  Chemically synthesized
gggcggguccaccaguuu

SEQ ID NO: 18695 - RNA, 18 nt, artificial
  Chemically synthesized
gagcuuccugaguggaga

SEQ ID NO: 18696 - RNA, 18 nt, artificial
  Chemically synthesized
aggucaacacagacgagu

SEQ ID NO: 18697 - RNA, 18 nt, artificial
  Chemically synthesized
ugauguuggagaagggaa

SEQ ID NO: 18698 - RNA, 18 nt, artificial
  Chemically synthesized
cgacgauuguccaggaaa

SEQ ID NO: 18699 - RNA, 18 nt, artificial
  Chemically synthesized
cagguucaguauuaugua

SEQ ID NO: 18700 - RNA, 18 nt, artificial
  Chemically synthesized
ccuucuacugcgaguguc

SEQ ID NO: 18701 - RNA, 18 nt, artificial
  Chemically synthesized
ggacaagaucaaugaguu

SEQ ID NO: 18702 - RNA, 18 nt, artificial
  Chemically synthesized
cugcgagaccaacaucaa

SEQ ID NO: 18703 - RNA, 18 nt, artificial
  Chemically synthesized
gccacaaaacuuacagau

SEQ ID NO: 18704 - RNA, 18 nt, artificial
  Chemically synthesized
gcaccugucuggacaaga

SEQ ID NO: 18705 - RNA, 18 nt, artificial
  Chemically synthesized
gagcauguguaacaucaa

SEQ ID NO: 18706 - RNA, 18 nt, artificial
  Chemically synthesized
ggugagaccugccugaau

SEQ ID NO: 18707 - RNA, 18 nt, artificial
  Chemically synthesized
ggacggacccaacacuua

SEQ ID NO: 18708 - RNA, 18 nt, artificial
  Chemically synthesized
ggacaagaucgauggcua

SEQ ID NO: 18709 - RNA, 18 nt, artificial
  Chemically synthesized
gggugugcacugugagau

SEQ ID NO: 18710 - RNA, 18 nt, artificial
  Chemically synthesized
ggagauugacaaccggca

SEQ ID NO: 18711 - RNA, 18 nt, artificial
  Chemically synthesized
gcgugaacaccuacaacu

SEQ ID NO: 18712 - RNA, 18 nt, artificial
  Chemically synthesized
aggucgacaucaacgagu

SEQ ID NO: 18713 - RNA, 18 nt, artificial
  Chemically synthesized
gacugugcggagcaugua

SEQ ID NO: 18714 - RNA, 18 nt, artificial
  Chemically synthesized
ggguucaucugcaagugc

SEQ ID NO: 18715 - RNA, 18 nt, artificial
  Chemically synthesized
cgagcauaguccaaaaag

SEQ ID NO: 18716 - RNA, 18 nt, artificial
  Chemically synthesized
ggaaguugaacgagcaua

SEQ ID NO: 18717 - RNA, 18 nt, artificial
  Chemically synthesized
gccuauggcagaaaaaau

SEQ ID NO: 18718 - RNA, 18 nt, artificial
  Chemically synthesized
ggucaaugcgaguggcug

SEQ ID NO: 18719 - RNA, 18 nt, artificial
  Chemically synthesized
gaccaacugugacaucaa

SEQ ID NO: 18720 - RNA, 18 nt, artificial
  Chemically synthesized
aggaaaauaucgacgauu

SEQ ID NO: 18721 - RNA, 18 nt, artificial
  Chemically synthesized
gcccguucuugaaaugua

SEQ ID NO: 18722 - RNA, 18 nt, artificial
  Chemically synthesized
uggacaagaucaaugagu

SEQ ID NO: 18723 - RNA, 18 nt, artificial
  Chemically synthesized
gggugagguugacgccga

SEQ ID NO: 18724 - RNA, 18 nt, artificial
  Chemically synthesized
caguuugaauggucaaug

SEQ ID NO: 18725 - RNA, 18 nt, artificial
  Chemically synthesized
agaucaaccuggaugacu

SEQ ID NO: 18726 - RNA, 18 nt, artificial
  Chemically synthesized
agaucgacgucaacgagu

SEQ ID NO: 18727 - RNA, 18 nt, artificial
  Chemically synthesized
guguuuuguaggagacuu

SEQ ID NO: 18728 - RNA, 18 nt, artificial
  Chemically synthesized
ggucaaugagugcaacag

SEQ ID NO: 18729 - RNA, 18 nt, artificial
  Chemically synthesized
ggcaggaugucaacgagu

SEQ ID NO: 18730 - RNA, 18 nt, artificial
  Chemically synthesized
agaacaacagggaggaga

SEQ ID NO: 18731 - RNA, 18 nt, artificial
  Chemically synthesized
gccacauccuggacuaca

SEQ ID NO: 18732 - RNA, 18 nt, artificial
  Chemically synthesized
gaccuggagaccaagaag

SEQ ID NO: 18733 - RNA, 18 nt, artificial
  Chemically synthesized
agacaugaccaguggcua

SEQ ID NO: 18734 - RNA, 18 nt, artificial
  Chemically synthesized
gggacgaggaccuggaga

SEQ ID NO: 18735 - RNA, 18 nt, artificial
  Chemically synthesized
gagugugaauccaacccu

SEQ ID NO: 18736 - RNA, 18 nt, artificial
  Chemically synthesized
ggcacuuucugugaggag

SEQ ID NO: 18737 - RNA, 18 nt, artificial
  Chemically synthesized
gagaaaacaagcaaguuc

SEQ ID NO: 18738 - RNA, 18 nt, artificial
  Chemically synthesized
ccaccacugcgagaccaa

SEQ ID NO: 18739 - RNA, 18 nt, artificial
  Chemically synthesized
cgcacaaggugucuucca

SEQ ID NO: 18740 - RNA, 18 nt, artificial
  Chemically synthesized
acaucaacaucgaugagu

SEQ ID NO: 18741 - RNA, 18 nt, artificial
  Chemically synthesized
ggucaaugagugcaacag

SEQ ID NO: 18742 - RNA, 18 nt, artificial
  Chemically synthesized
ccgccuuugugcuucugu

SEQ ID NO: 18743 - RNA, 18 nt, artificial
  Chemically synthesized
ggcaaaugcuggcagacc

SEQ ID NO: 18744 - RNA, 18 nt, artificial
  Chemically synthesized
ggacaggucaguacugua

SEQ ID NO: 18745 - RNA, 18 nt, artificial
  Chemically synthesized
gguccaccaguuugaaug

SEQ ID NO: 18746 - RNA, 18 nt, artificial
  Chemically synthesized
ggaagaacugcacgcagu

SEQ ID NO: 18747 - RNA, 18 nt, artificial
  Chemically synthesized
gacugcagcgagaacauu

SEQ ID NO: 18748 - RNA, 18 nt, artificial
  Chemically synthesized
gggcagaccugugagguc

SEQ ID NO: 18749 - RNA, 18 nt, artificial
  Chemically synthesized
gauccacugugagaacaa

SEQ ID NO: 18750 - RNA, 18 nt, artificial
  Chemically synthesized
ggauccacugugagaaca

SEQ ID NO: 18751 - RNA, 18 nt, artificial
  Chemically synthesized
agccacaaaacuuacaga

SEQ ID NO: 18752 - RNA, 18 nt, artificial
  Chemically synthesized
cgagaacauugaugacug

SEQ ID NO: 18753 - RNA, 18 nt, artificial
  Chemically synthesized
ggcgagaccgccuugcac

SEQ ID NO: 18754 - RNA, 18 nt, artificial
  Chemically synthesized
gaagggaaguugaacgag

SEQ ID NO: 18755 - RNA, 18 nt, artificial
  Chemically synthesized
aguacgauguggacgagu

SEQ ID NO: 18756 - RNA, 18 nt, artificial
  Chemically synthesized
ggccgugcagagugagac

SEQ ID NO: 18757 - RNA, 18 nt, artificial
  Chemically synthesized
cgugcagagugagaccgu

SEQ ID NO: 18758 - RNA, 18 nt, artificial
  Chemically synthesized
ugauguuggagaagggaa

SEQ ID NO: 18759 - RNA, 18 nt, artificial
  Chemically synthesized
ggacaucacggaucauau

SEQ ID NO: 18760 - RNA, 18 nt, artificial
  Chemically synthesized
cuaccuggagauugacaa

SEQ ID NO: 18761 - RNA, 18 nt, artificial
  Chemically synthesized
cugaggagaucgacgagu

SEQ ID NO: 18762 - RNA, 18 nt, artificial
  Chemically synthesized
gcaugucaaacaugagau

SEQ ID NO: 18763 - RNA, 18 nt, artificial
  Chemically synthesized
gccuccuucuacugcgag

SEQ ID NO: 18764 - RNA, 18 nt, artificial
  Chemically synthesized
ggacgaccagacagacca

SEQ ID NO: 18765 - RNA, 18 nt, artificial
  Chemically synthesized
cggagcauguacccgaga

SEQ ID NO: 18766 - RNA, 18 nt, artificial
  Chemically synthesized
gccagaaccuugugcacu

SEQ ID NO: 18767 - RNA, 18 nt, artificial
  Chemically synthesized
agaucaaugaguuccagu

SEQ ID NO: 18768 - RNA, 18 nt, artificial
  Chemically synthesized
gguggagugggaccaacu

SEQ ID NO: 18769 - RNA, 18 nt, artificial
  Chemically synthesized
gggacgucagacuuggcu

SEQ ID NO: 18770 - RNA, 18 nt, artificial
  Chemically synthesized
agaucaacguggacgacu

SEQ ID NO: 18771 - RNA, 18 nt, artificial
  Chemically synthesized
ccacaaaacuuacagaug

SEQ ID NO: 18772 - RNA, 18 nt, artificial
  Chemically synthesized
ccaguuugaauggucaau

SEQ ID NO: 18773 - RNA, 18 nt, artificial
  Chemically synthesized
ggucaguacuguaccgag

SEQ ID NO: 18774 - RNA, 18 nt, artificial
  Chemically synthesized
caaugagugugaauccaa

SEQ ID NO: 18775 - RNA, 18 nt, artificial
  Chemically synthesized
gggagggcagcuacgaga

SEQ ID NO: 18776 - RNA, 18 nt, artificial
  Chemically synthesized
gcggaaggccagugcaac

SEQ ID NO: 18777 - RNA, 18 nt, artificial
  Chemically synthesized
ggcgcauccugccagaac

SEQ ID NO: 18778 - RNA, 18 nt, artificial
  Chemically synthesized
ggacaucgaugagugcga

SEQ ID NO: 18779 - RNA, 18 nt, artificial
  Chemically synthesized
ggacugcagcgagaacau

SEQ ID NO: 18780 - RNA, 18 nt, artificial
  Chemically synthesized
ggcuggccuuugagacug

SEQ ID NO: 18781 - RNA, 18 nt, artificial
  Chemically synthesized
gaugguuucuugcaagca

SEQ ID NO: 18782 - RNA, 18 nt, artificial
  Chemically synthesized
ggaccaacugugacauca

SEQ ID NO: 18783 - RNA, 18 nt, artificial
  Chemically synthesized
gggcaagaagguccgcaa

SEQ ID NO: 18784 - RNA, 18 nt, artificial
  Chemically synthesized
cuggagaccaagaaguuc

SEQ ID NO: 18785 - RNA, 18 nt, artificial
  Chemically synthesized
guuggagaagggaaguug

SEQ ID NO: 18786 - RNA, 18 nt, artificial
  Chemically synthesized
ggagaagcugcauccaga

SEQ ID NO: 18787 - RNA, 18 nt, artificial
  Chemically synthesized
cacccaugguaccaauca

SEQ ID NO: 18788 - RNA, 18 nt, artificial
  Chemically synthesized
aggucaacacagacgagu

SEQ ID NO: 18789 - RNA, 18 nt, artificial
  Chemically synthesized
ccggaaccgagccacaga

SEQ ID NO: 18790 - RNA, 18 nt, artificial
  Chemically synthesized
ggcuacuccugcaagugc

SEQ ID NO: 18791 - RNA, 18 nt, artificial
  Chemically synthesized
ggcucuguguggacgcgg

SEQ ID NO: 18792 - RNA, 18 nt, artificial
  Chemically synthesized
gaacgagcauaguccaaa

SEQ ID NO: 18793 - RNA, 18 nt, artificial
  Chemically synthesized
agaguguaguuuacagaa

SEQ ID NO: 18794 - RNA, 18 nt, artificial
  Chemically synthesized
ccuccuucuacugcgagu

SEQ ID NO: 18795 - RNA, 18 nt, artificial
  Chemically synthesized
gcauguguaacaucaaca

SEQ ID NO: 18796 - RNA, 18 nt, artificial
  Chemically synthesized
cccuguacgaccaguacu

SEQ ID NO: 18797 - RNA, 18 nt, artificial
  Chemically synthesized
ggcuuugacugccagcgu

SEQ ID NO: 18798 - RNA, 18 nt, artificial
  Chemically synthesized
gccgcugccuggacaaga

SEQ ID NO: 18799 - RNA, 18 nt, artificial
  Chemically synthesized
cgggauccacugugagaa

SEQ ID NO: 18800 - RNA, 18 nt, artificial
  Chemically synthesized
gcaaagacaugaccagug

SEQ ID NO: 18801 - RNA, 18 nt, artificial
  Chemically synthesized
gggcuacacaggcagcua

SEQ ID NO: 18802 - RNA, 18 nt, artificial
  Chemically synthesized
gacagccagugcaacuca

SEQ ID NO: 18803 - RNA, 18 nt, artificial
  Chemically synthesized
cagccugcagugcaacaa

SEQ ID NO: 18804 - RNA, 18 nt, artificial
  Chemically synthesized
cugcaagaauggugccaa

SEQ ID NO: 18805 - RNA, 18 nt, artificial
  Chemically synthesized
ggagagccgagccaggca

SEQ ID NO: 18806 - RNA, 18 nt, artificial
  Chemically synthesized
cagcgagaacauugauga

SEQ ID NO: 18807 - RNA, 18 nt, artificial
  Chemically synthesized
ccugcaaagacaugacca

SEQ ID NO: 18808 - RNA, 18 nt, artificial
  Chemically synthesized
ggaaacaacugcaagaac

SEQ ID NO: 18809 - RNA, 18 nt, artificial
  Chemically synthesized
ggaaguacuucagugacg

SEQ ID NO: 18810 - RNA, 18 nt, artificial
  Chemically synthesized
aggagaagcugcauccag

SEQ ID NO: 18811 - RNA, 18 nt, artificial
  Chemically synthesized
caacgagugugccaguga

SEQ ID NO: 18812 - RNA, 18 nt, artificial
  Chemically synthesized
gcaucaauggcuucaccu

SEQ ID NO: 18813 - RNA, 18 nt, artificial
  Chemically synthesized
gggcuucacugggcaucu

SEQ ID NO: 18814 - RNA, 18 nt, artificial
  Chemically synthesized
cacaaggugucuuccaga

SEQ ID NO: 18815 - RNA, 18 nt, artificial
  Chemically synthesized
caaugagugcaacagcaa

SEQ ID NO: 18816 - RNA, 18 nt, artificial
  Chemically synthesized
caucaugcaugucaaaca

SEQ ID NO: 18817 - RNA, 18 nt, artificial
  Chemically synthesized
gggcacguguauugacga

SEQ ID NO: 18818 - RNA, 18 nt, artificial
  Chemically synthesized
ccgcacgcggauuaauuu

SEQ ID NO: 18819 - RNA, 18 nt, artificial
  Chemically synthesized
ccaacaucaacgagugug

SEQ ID NO: 18820 - RNA, 18 nt, artificial
  Chemically synthesized
gccggagcuuccugagug

SEQ ID NO: 18821 - RNA, 18 nt, artificial
  Chemically synthesized
ggaugaaaagauucuucu

SEQ ID NO: 18822 - RNA, 18 nt, artificial
  Chemically synthesized
gcgugaacaccuacaacu

SEQ ID NO: 18823 - RNA, 18 nt, artificial
  Chemically synthesized
gcgacaacgccuaccucu

SEQ ID NO: 18824 - RNA, 18 nt, artificial
  Chemically synthesized
ggacuaugagagcuucuc

SEQ ID NO: 18825 - RNA, 18 nt, artificial
  Chemically synthesized
guguucucggagugugua

SEQ ID NO: 18826 - RNA, 18 nt, artificial
  Chemically synthesized
gggcaucugugccaguac

SEQ ID NO: 18827 - RNA, 18 nt, artificial
  Chemically synthesized
aggucgacaucaacgagu

SEQ ID NO: 18828 - RNA, 18 nt, artificial
  Chemically synthesized
gccuguggaagcaaggag

SEQ ID NO: 18829 - RNA, 18 nt, artificial
  Chemically synthesized
cgcagugcuuccagagug

SEQ ID NO: 18830 - RNA, 18 nt, artificial
  Chemically synthesized
gcagagugagaccgugga

SEQ ID NO: 18831 - RNA, 18 nt, artificial
  Chemically synthesized
ccgucaucuccgacuuca

SEQ ID NO: 18832 - RNA, 18 nt, artificial
  Chemically synthesized
cgaggacuaugagagcuu

SEQ ID NO: 18833 - RNA, 18 nt, artificial
  Chemically synthesized
gggaguuccagugcaucu

SEQ ID NO: 18834 - RNA, 18 nt, artificial
  Chemically synthesized
gaaucuuuguuucagguu

SEQ ID NO: 18835 - RNA, 18 nt, artificial
  Chemically synthesized
cuuccuuucccaagccuu

SEQ ID NO: 18836 - RNA, 18 nt, artificial
  Chemically synthesized
cgucuaccuggagauuga

SEQ ID NO: 18837 - RNA, 18 nt, artificial
  Chemically synthesized
agguggacaucgaugagu

SEQ ID NO: 18838 - RNA, 18 nt, artificial
  Chemically synthesized
gaaccugcagccagcaaa

SEQ ID NO: 18839 - RNA, 18 nt, artificial
  Chemically synthesized
cugugacaucaacaacaa

SEQ ID NO: 18840 - RNA, 18 nt, artificial
  Chemically synthesized
gagucuguugugugucau

SEQ ID NO: 18841 - RNA, 18 nt, artificial
  Chemically synthesized
ggaguuccagugcaucug

SEQ ID NO: 18842 - RNA, 18 nt, artificial
  Chemically synthesized
ggcccugaauuucacugu

SEQ ID NO: 18843 - RNA, 18 nt, artificial
  Chemically synthesized
ggcgugaacaccuacaac

SEQ ID NO: 18844 - RNA, 18 nt, artificial
  Chemically synthesized
ggacgagugcucacccag

SEQ ID NO: 18845 - RNA, 18 nt, artificial
  Chemically synthesized
cggcuacagugggcgcaa

SEQ ID NO: 18846 - RNA, 18 nt, artificial
  Chemically synthesized
ggccggagcuuccugagu

SEQ ID NO: 18847 - RNA, 18 nt, artificial
  Chemically synthesized
ccacugcgagaccaacau

SEQ ID NO: 18848 - RNA, 18 nt, artificial
  Chemically synthesized
ggaagaagucccaggacg

SEQ ID NO: 18849 - RNA, 18 nt, artificial
  Chemically synthesized
agaacugugaggaaaaua

SEQ ID NO: 18850 - RNA, 18 nt, artificial
  Chemically synthesized
gcugcaaaggcaagcccu

SEQ ID NO: 18851 - RNA, 18 nt, artificial
  Chemically synthesized
aggaaaauaucgacgauu

SEQ ID NO: 18852 - RNA, 18 nt, artificial
  Chemically synthesized
agccugcagugcaacaac

SEQ ID NO: 18853 - RNA, 18 nt, artificial
  Chemically synthesized
gguuuuccuacguaggau

SEQ ID NO: 18854 - RNA, 18 nt, artificial
  Chemically synthesized
ggagugcaggcaauccga

SEQ ID NO: 18855 - RNA, 18 nt, artificial
  Chemically synthesized
gcggcaccugcaaagaca

SEQ ID NO: 18856 - RNA, 18 nt, artificial
  Chemically synthesized
uggagaagggaaguugaa

SEQ ID NO: 18857 - RNA, 18 nt, artificial
  Chemically synthesized
ggcuaacaaagauaugca

SEQ ID NO: 18858 - RNA, 18 nt, artificial
  Chemically synthesized
ggaccugugagcccacau

SEQ ID NO: 18859 - RNA, 18 nt, artificial
  Chemically synthesized
augguuucuugcaagcau

SEQ ID NO: 18860 - RNA, 18 nt, artificial
  Chemically synthesized
ccgaggauguggacgagu

SEQ ID NO: 18861 - RNA, 18 nt, artificial
  Chemically synthesized
ccugcagccagcaaacau

SEQ ID NO: 18862 - RNA, 18 nt, artificial
  Chemically synthesized
cgaugucaaugagugcga

SEQ ID NO: 18863 - RNA, 18 nt, artificial
  Chemically synthesized
cacugugagaacaacacg

SEQ ID NO: 18864 - RNA, 18 nt, artificial
  Chemically synthesized
ggguuuuccuacguagga

SEQ ID NO: 18865 - RNA, 18 nt, artificial
  Chemically synthesized
ccuucuacugcgaguguc

SEQ ID NO: 18866 - RNA, 18 nt, artificial
  Chemically synthesized
cgaugagugugcgggcaa

SEQ ID NO: 18867 - RNA, 18 nt, artificial
  Chemically synthesized
agaucaaccuggaugacu

SEQ ID NO: 18868 - RNA, 18 nt, artificial
  Chemically synthesized
cgcaagcccagcagcaaa

SEQ ID NO: 18869 - RNA, 18 nt, artificial
  Chemically synthesized
gcaggugcagccacaaaa

SEQ ID NO: 18870 - RNA, 18 nt, artificial
  Chemically synthesized
gccucaacggguacaagu

SEQ ID NO: 18871 - RNA, 18 nt, artificial
  Chemically synthesized
gaaugagucuguugugug

SEQ ID NO: 18872 - RNA, 18 nt, artificial
  Chemically synthesized
gcaaguucugagagccag

SEQ ID NO: 18873 - RNA, 18 nt, artificial
  Chemically synthesized
agaucgacgucaacgagu

SEQ ID NO: 18874 - RNA, 18 nt, artificial
  Chemically synthesized
ggcugucccggcugcaga

SEQ ID NO: 18875 - RNA, 18 nt, artificial
  Chemically synthesized
guaccaaucaugaaucuu

SEQ ID NO: 18876 - RNA, 18 nt, artificial
  Chemically synthesized
ggacgagugcucacccag

SEQ ID NO: 18877 - RNA, 18 nt, artificial
  Chemically synthesized
gcggguucaucugcaagu

SEQ ID NO: 18878 - RNA, 18 nt, artificial
  Chemically synthesized
gccagaacugugaggaaa

SEQ ID NO: 18879 - RNA, 18 nt, artificial
  Chemically synthesized
ccaggguuuuccuacgua

SEQ ID NO: 18880 - RNA, 18 nt, artificial
  Chemically synthesized
caacgagugugcguccaa

SEQ ID NO: 18881 - RNA, 18 nt, artificial
  Chemically synthesized
cguguuuuguaggagacu

SEQ ID NO: 18882 - RNA, 18 nt, artificial
  Chemically synthesized
guguuuuguaggagacuu

SEQ ID NO: 18883 - RNA, 18 nt, artificial
  Chemically synthesized
gugagaccguggagccgc

SEQ ID NO: 18884 - RNA, 18 nt, artificial
  Chemically synthesized
ggcggugcacacuauucu

SEQ ID NO: 18885 - RNA, 18 nt, artificial
  Chemically synthesized
ggacgagugugccagcac

SEQ ID NO: 18886 - RNA, 18 nt, artificial
  Chemically synthesized
gcaccugcaaagacauga

SEQ ID NO: 18887 - RNA, 18 nt, artificial
  Chemically synthesized
gguucugccugaccugga

SEQ ID NO: 18888 - RNA, 18 nt, artificial
  Chemically synthesized
ccagcaugcagucccaga

SEQ ID NO: 18889 - RNA, 18 nt, artificial
  Chemically synthesized
cgcugacggaguacaagu

SEQ ID NO: 18890 - RNA, 18 nt, artificial
  Chemically synthesized
agaccugugaggucgaca

SEQ ID NO: 18891 - RNA, 18 nt, artificial
  Chemically synthesized
gagacuugccagagccgg

SEQ ID NO: 18892 - RNA, 18 nt, artificial
  Chemically synthesized
gcugcaacagcgcggagu

SEQ ID NO: 18893 - RNA, 18 nt, artificial
  Chemically synthesized
gugucuuccagauccuga

SEQ ID NO: 18894 - RNA, 18 nt, artificial
  Chemically synthesized
ggagacgggcaacagcga

SEQ ID NO: 18895 - RNA, 18 nt, artificial
  Chemically synthesized
cgcaguugugcuccugaa

SEQ ID NO: 18896 - RNA, 18 nt, artificial
  Chemically synthesized
ccaacaucaacgagugcu

SEQ ID NO: 18897 - RNA, 18 nt, artificial
  Chemically synthesized
gagccuuuuuaaaacaca

SEQ ID NO: 18898 - RNA, 18 nt, artificial
  Chemically synthesized
gaguggagagccgagcca

SEQ ID NO: 18899 - RNA, 18 nt, artificial
  Chemically synthesized
gcaaguucugagagccag

SEQ ID NO: 18900 - RNA, 18 nt, artificial
  Chemically synthesized
cugugacagccagugcaa

SEQ ID NO: 18901 - RNA, 18 nt, artificial
  Chemically synthesized
gguugacgccgacugcau

SEQ ID NO: 18902 - RNA, 18 nt, artificial
  Chemically synthesized
acaucaacaucgaugagu

SEQ ID NO: 18903 - RNA, 18 nt, artificial
  Chemically synthesized
cugugaggucgacaucaa

SEQ ID NO: 18904 - RNA, 18 nt, artificial
  Chemically synthesized
gaggcauccuacccuuuu

SEQ ID NO: 18905 - RNA, 18 nt, artificial
  Chemically synthesized
cccucaacuucaaugacc

SEQ ID NO: 18906 - RNA, 18 nt, artificial
  Chemically synthesized
gccacgugugagaaugac

SEQ ID NO: 18907 - RNA, 18 nt, artificial
  Chemically synthesized
ggacgacaaccagaauga

SEQ ID NO: 18908 - RNA, 18 nt, artificial
  Chemically synthesized
caaagauaugcagaacaa

SEQ ID NO: 18909 - RNA, 18 nt, artificial
  Chemically synthesized
gggcgagaccgccuugca

SEQ ID NO: 18910 - RNA, 18 nt, artificial
  Chemically synthesized
gcggauuaauuugcaucu

SEQ ID NO: 18911 - RNA, 18 nt, artificial
  Chemically synthesized
ccgcgaugcucccagccc

SEQ ID NO: 18912 - RNA, 18 nt, artificial
  Chemically synthesized
caacaaugagugugaauc

SEQ ID NO: 18913 - RNA, 18 nt, artificial
  Chemically synthesized
ggacugcguggacagcua

SEQ ID NO: 18914 - RNA, 18 nt, artificial
  Chemically synthesized
gaccaguacugcaaggac

SEQ ID NO: 18915 - RNA, 18 nt, artificial
  Chemically synthesized
gccuguuaggagaagcug

SEQ ID NO: 18916 - RNA, 18 nt, artificial
  Chemically synthesized
gucaaugagugcgacuca

SEQ ID NO: 18917 - RNA, 18 nt, artificial
  Chemically synthesized
cccaagugcuuuaacaac

SEQ ID NO: 18918 - RNA, 18 nt, artificial
  Chemically synthesized
gcccugaauuucacugug

SEQ ID NO: 18919 - RNA, 18 nt, artificial
  Chemically synthesized
aguacaaccuggugcgca

SEQ ID NO: 18920 - RNA, 18 nt, artificial
  Chemically synthesized
ggcgcagcugcacuucau

SEQ ID NO: 18921 - RNA, 18 nt, artificial
  Chemically synthesized
uguuucagguucaguauu

SEQ ID NO: 18922 - RNA, 18 nt, artificial
  Chemically synthesized
caaguauagccuauggca

SEQ ID NO: 18923 - RNA, 18 nt, artificial
  Chemically synthesized
caaggugucuuccagauc

SEQ ID NO: 18924 - RNA, 18 nt, artificial
  Chemically synthesized
cgacgauuguccaggaaa

SEQ ID NO: 18925 - RNA, 18 nt, artificial
  Chemically synthesized
ggagcauguguaacauca

SEQ ID NO: 18926 - RNA, 18 nt, artificial
  Chemically synthesized
gugcagccacaaaacuua

SEQ ID NO: 18927 - RNA, 18 nt, artificial
  Chemically synthesized
ggguacaagugcaacugc

SEQ ID NO: 18928 - RNA, 18 nt, artificial
  Chemically synthesized
cgcggauuaauuugcauc

SEQ ID NO: 18929 - RNA, 18 nt, artificial
  Chemically synthesized
cgagcauaguccaaaaag

SEQ ID NO: 18930 - RNA, 18 nt, artificial
  Chemically synthesized
ccagcagcagcaaagccu

SEQ ID NO: 18931 - RNA, 18 nt, artificial
  Chemically synthesized
ccuggagaccaagaaguu

SEQ ID NO: 18932 - RNA, 18 nt, artificial
  Chemically synthesized
ccagaacugugaggaaaa

SEQ ID NO: 18933 - RNA, 18 nt, artificial
  Chemically synthesized
ggcggguccaccaguuug

SEQ ID NO: 18934 - RNA, 18 nt, artificial
  Chemically synthesized
ggugcugcugucccgcaa

SEQ ID NO: 18935 - RNA, 18 nt, artificial
  Chemically synthesized
ccgcagcccaguuccuga

SEQ ID NO: 18936 - RNA, 18 nt, artificial
  Chemically synthesized
aggacugcagcgagaaca

SEQ ID NO: 18937 - RNA, 18 nt, artificial
  Chemically synthesized
cugcgagaccaacaucaa

SEQ ID NO: 18938 - RNA, 18 nt, artificial
  Chemically synthesized
gaaaauguguucucggag

SEQ ID NO: 18939 - RNA, 18 nt, artificial
  Chemically synthesized
ccaaaugccugccagaac

SEQ ID NO: 18940 - RNA, 18 nt, artificial
  Chemically synthesized
ugcggaaggccagugcaa

SEQ ID NO: 18941 - RNA, 18 nt, artificial
  Chemically synthesized
ggacgaguacaaccuggu

SEQ ID NO: 18942 - RNA, 18 nt, artificial
  Chemically synthesized
gccagaguggacagguca

SEQ ID NO: 18943 - RNA, 18 nt, artificial
  Chemically synthesized
ccgccagaguggacaggu

SEQ ID NO: 18944 - RNA, 18 nt, artificial
  Chemically synthesized
ggcagacccacacccagu

SEQ ID NO: 18945 - RNA, 18 nt, artificial
  Chemically synthesized
aggucaguacuguaccga

SEQ ID NO: 18946 - RNA, 18 nt, artificial
  Chemically synthesized
cguguauugacgacguug

SEQ ID NO: 18947 - RNA, 18 nt, artificial
  Chemically synthesized
accuggagaccaagaagu

SEQ ID NO: 18948 - RNA, 18 nt, artificial
  Chemically synthesized
gcaagaacggcggcaaau

SEQ ID NO: 18949 - RNA, 18 nt, artificial
  Chemically synthesized
gggcgccacgugugagaa

SEQ ID NO: 18950 - RNA, 18 nt, artificial
  Chemically synthesized
gcaacugcgagaccgaca

SEQ ID NO: 18951 - RNA, 18 nt, artificial
  Chemically synthesized
gccagagccgggcacauu

SEQ ID NO: 18952 - RNA, 18 nt, artificial
  Chemically synthesized
aguacgauguggacgagu

SEQ ID NO: 18953 - RNA, 18 nt, artificial
  Chemically synthesized
gagcauguguaacaucaa

SEQ ID NO: 18954 - RNA, 18 nt, artificial
  Chemically synthesized
aggucaaugagugcaaca

SEQ ID NO: 18955 - RNA, 18 nt, artificial
  Chemically synthesized
ggguucaucugcaagugc

SEQ ID NO: 18956 - RNA, 18 nt, artificial
  Chemically synthesized
ggagcagauuuuugcaau

SEQ ID NO: 18957 - RNA, 18 nt, artificial
  Chemically synthesized
gaugcgagaucgacguca

SEQ ID NO: 18958 - RNA, 18 nt, artificial
  Chemically synthesized
ccgugaacaauguggaug

SEQ ID NO: 18959 - RNA, 18 nt, artificial
  Chemically synthesized
ggaguguguaugccaaga

SEQ ID NO: 18960 - RNA, 18 nt, artificial
  Chemically synthesized
gcgucaaugacuuccacu

SEQ ID NO: 18961 - RNA, 18 nt, artificial
  Chemically synthesized
ggaccaggugggcggcua

SEQ ID NO: 18962 - RNA, 18 nt, artificial
  Chemically synthesized
cgccacgugugagaauga

SEQ ID NO: 18963 - RNA, 18 nt, artificial
  Chemically synthesized
gugggcggguccaccagu

SEQ ID NO: 18964 - RNA, 18 nt, artificial
  Chemically synthesized
ggacaucacggaucauau

SEQ ID NO: 18965 - RNA, 18 nt, artificial
  Chemically synthesized
caguuugaauggucaaug

SEQ ID NO: 18966 - RNA, 18 nt, artificial
  Chemically synthesized
cugaggagaucgacgagu

SEQ ID NO: 18967 - RNA, 18 nt, artificial
  Chemically synthesized
ggacggacccaacacuua

SEQ ID NO: 18968 - RNA, 18 nt, artificial
  Chemically synthesized
gggacagccucaacgggu

SEQ ID NO: 18969 - RNA, 18 nt, artificial
  Chemically synthesized
ggacaagaucgauggcua

SEQ ID NO: 18970 - RNA, 18 nt, artificial
  Chemically synthesized
gcaugucaaacaugagau

SEQ ID NO: 18971 - RNA, 18 nt, artificial
  Chemically synthesized
ggaugacugugccagcag

SEQ ID NO: 18972 - RNA, 18 nt, artificial
  Chemically synthesized
gcgcaugcaucacgacau

SEQ ID NO: 18973 - RNA, 18 nt, artificial
  Chemically synthesized
agcacgaugucaaugagu

SEQ ID NO: 18974 - RNA, 18 nt, artificial
  Chemically synthesized
gcaugcuugugaaaaugu

SEQ ID NO: 18975 - RNA, 18 nt, artificial
  Chemically synthesized
agaagguccgcaagccca

SEQ ID NO: 18976 - RNA, 18 nt, artificial
  Chemically synthesized
gaaucuuuguuucagguu

SEQ ID NO: 18977 - RNA, 18 nt, artificial
  Chemically synthesized
cgggauccacugugagaa

SEQ ID NO: 18978 - RNA, 18 nt, artificial
  Chemically synthesized
ggaacuguagaugaugua

SEQ ID NO: 18979 - RNA, 18 nt, artificial
  Chemically synthesized
ggaaacaagugaaagcau

SEQ ID NO: 18980 - RNA, 18 nt, artificial
  Chemically synthesized
cugcagugcuggaaguac

SEQ ID NO: 18981 - RNA, 18 nt, artificial
  Chemically synthesized
cccugaauuucacugugg

SEQ ID NO: 18982 - RNA, 18 nt, artificial
  Chemically synthesized
cgccugacugcacagaga

SEQ ID NO: 18983 - RNA, 18 nt, artificial
  Chemically synthesized
ggcgugcagggcaagaag

SEQ ID NO: 18984 - RNA, 18 nt, artificial
  Chemically synthesized
ccagguuccgaagaagau

SEQ ID NO: 18985 - RNA, 18 nt, artificial
  Chemically synthesized
guccuuugguccuguccc

SEQ ID NO: 18986 - RNA, 18 nt, artificial
  Chemically synthesized
gaguguguaugccaagag

SEQ ID NO: 18987 - RNA, 18 nt, artificial
  Chemically synthesized
ggagauugacaaccggca

SEQ ID NO: 18988 - RNA, 18 nt, artificial
  Chemically synthesized
gguggagugggaccaacu

SEQ ID NO: 18989 - RNA, 18 nt, artificial
  Chemically synthesized
agaucaacguggacgacu

SEQ ID NO: 18990 - RNA, 18 nt, artificial
  Chemically synthesized
gggacgucagacuuggcu

SEQ ID NO: 18991 - RNA, 18 nt, artificial
  Chemically synthesized
gugcacccaugguaccaa

SEQ ID NO: 18992 - RNA, 18 nt, artificial
  Chemically synthesized
ccaguacgauguggacga

SEQ ID NO: 18993 - RNA, 18 nt, artificial
  Chemically synthesized
gaagaacgcuucagacgg

SEQ ID NO: 18994 - RNA, 18 nt, artificial
  Chemically synthesized
ccaguuugaauggucaau

SEQ ID NO: 18995 - RNA, 18 nt, artificial
  Chemically synthesized
gugcagagugagaccgug

SEQ ID NO: 18996 - RNA, 18 nt, artificial
  Chemically synthesized
aggaggacaucaacgagu

SEQ ID NO: 18997 - RNA, 18 nt, artificial
  Chemically synthesized
gcagcgacaagguguuga

SEQ ID NO: 18998 - RNA, 18 nt, artificial
  Chemically synthesized
ggcagugugugcaggccu

SEQ ID NO: 18999 - RNA, 18 nt, artificial
  Chemically synthesized
ggaugacugugccagcag

SEQ ID NO: 19000 - RNA, 18 nt, artificial
  Chemically synthesized
gacccaacugcgagauca

SEQ ID NO: 19001 - RNA, 18 nt, artificial
  Chemically synthesized
ggcacuuucugugaggag

SEQ ID NO: 19002 - RNA, 18 nt, artificial
  Chemically synthesized
gccaggacguggaugagu

SEQ ID NO: 19003 - RNA, 18 nt, artificial
  Chemically synthesized
gcgacgucacccacgagu

SEQ ID NO: 19004 - RNA, 18 nt, artificial
  Chemically synthesized
gcgugagcucagcagcca

SEQ ID NO: 19005 - RNA, 18 nt, artificial
  Chemically synthesized
ggucaacacagacgagug

SEQ ID NO: 19006 - RNA, 18 nt, artificial
  Chemically synthesized
ggcaucaugcaugucaaa

SEQ ID NO: 19007 - RNA, 18 nt, artificial
  Chemically synthesized
gggcuucagcggucccaa

SEQ ID NO: 19008 - RNA, 18 nt, artificial
  Chemically synthesized
acaucaacaacaaugagu

SEQ ID NO: 19009 - RNA, 18 nt, artificial
  Chemically synthesized
caguugugcuccugaaga

SEQ ID NO: 19010 - RNA, 18 nt, artificial
  Chemically synthesized
cgcugaucgaggaggcgu

SEQ ID NO: 19011 - RNA, 18 nt, artificial
  Chemically synthesized
agcaaguucugagagcca

SEQ ID NO: 19012 - RNA, 18 nt, artificial
  Chemically synthesized
gcugcauccagaggcaaa

SEQ ID NO: 19013 - RNA, 18 nt, artificial
  Chemically synthesized
ggaucauauggaccgccu

SEQ ID NO: 19014 - RNA, 18 nt, artificial
  Chemically synthesized
gacugugcggagcaugua

SEQ ID NO: 19015 - RNA, 18 nt, artificial
  Chemically synthesized
ggcaagaagguccgcaag

SEQ ID NO: 19016 - RNA, 18 nt, artificial
  Chemically synthesized
gcaucaugcaugucaaac

SEQ ID NO: 19017 - RNA, 18 nt, artificial
  Chemically synthesized
gcgaguccgucaucaaug

SEQ ID NO: 19018 - RNA, 18 nt, artificial
  Chemically synthesized
cgggcaagugcaucaaca

SEQ ID NO: 19019 - RNA, 18 nt, artificial
  Chemically synthesized
cguagaugaccugggcaa

SEQ ID NO: 19020 - RNA, 18 nt, artificial
  Chemically synthesized
gguccaccaguuugaaug

SEQ ID NO: 19021 - RNA, 18 nt, artificial
  Chemically synthesized
ccuccuucuacugcgagu

SEQ ID NO: 19022 - RNA, 18 nt, artificial
  Chemically synthesized
cuugaaauguaggcauca

SEQ ID NO: 19023 - RNA, 18 nt, artificial
  Chemically synthesized
cccaguaccgcugcgagu

SEQ ID NO: 19024 - RNA, 18 nt, artificial
  Chemically synthesized
gaguggacaggucaguac

SEQ ID NO: 19025 - RNA, 18 nt, artificial
  Chemically synthesized
cccuguacgaccaguacu

SEQ ID NO: 19026 - RNA, 18 nt, artificial
  Chemically synthesized
gcauauggguuagauguu

SEQ ID NO: 19027 - RNA, 18 nt, artificial
  Chemically synthesized
ggcuuugacugccagcgu

SEQ ID NO: 19028 - RNA, 18 nt, artificial
  Chemically synthesized
ggcggcuacuccugcaag

SEQ ID NO: 19029 - RNA, 18 nt, artificial
  Chemically synthesized
gagccacagaccuggaug

SEQ ID NO: 19030 - RNA, 18 nt, artificial
  Chemically synthesized
ccgcaguugugcuccuga

SEQ ID NO: 19031 - RNA, 18 nt, artificial
  Chemically synthesized
ccagaugcgucccaagau

SEQ ID NO: 19032 - RNA, 18 nt, artificial
  Chemically synthesized
caagggcagaccugugag

SEQ ID NO: 19033 - RNA, 18 nt, artificial
  Chemically synthesized
ugcuggaaguacuucagu

SEQ ID NO: 19034 - RNA, 18 nt, artificial
  Chemically synthesized
caucaacgagugcguucu

SEQ ID NO: 19035 - RNA, 18 nt, artificial
  Chemically synthesized
gaaacaagugaaagcaua

SEQ ID NO: 19036 - RNA, 18 nt, artificial
  Chemically synthesized
ccuggacgaccagacaga

SEQ ID NO: 19037 - RNA, 18 nt, artificial
  Chemically synthesized
gaccaacugugacaucaa

SEQ ID NO: 19038 - RNA, 18 nt, artificial
  Chemically synthesized
aggucugcagccugcagu

SEQ ID NO: 19039 - RNA, 18 nt, artificial
  Chemically synthesized
ggcaaaugcuggcagacc

SEQ ID NO: 19040 - RNA, 18 nt, artificial
  Chemically synthesized
gccaccucaacgacgcau

SEQ ID NO: 19041 - RNA, 18 nt, artificial
  Chemically synthesized
agaccgacaucgacgacu

SEQ ID NO: 19042 - RNA, 18 nt, artificial
  Chemically synthesized
gcaagaagguccgcaagc

SEQ ID NO: 19043 - RNA, 18 nt, artificial
  Chemically synthesized
ccugcacaaccagacaga

SEQ ID NO: 19044 - RNA, 18 nt, artificial
  Chemically synthesized
gcagcugcacuucaugua

SEQ ID NO: 19045 - RNA, 18 nt, artificial
  Chemically synthesized
gcccguucuugaaaugua

SEQ ID NO: 19046 - RNA, 18 nt, artificial
  Chemically synthesized
gaagggaaguugaacgag

SEQ ID NO: 19047 - RNA, 18 nt, artificial
  Chemically synthesized
gagagcuccugcuucaac

SEQ ID NO: 19048 - RNA, 18 nt, artificial
  Chemically synthesized
ccacugugagaacaacac

SEQ ID NO: 19049 - RNA, 18 nt, artificial
  Chemically synthesized
ccaucgucuaccuggaga

SEQ ID NO: 19050 - RNA, 18 nt, artificial
  Chemically synthesized
gggugagguugacgccga

SEQ ID NO: 19051 - RNA, 18 nt, artificial
  Chemically synthesized
ccagcacgaugucaauga

SEQ ID NO: 19052 - RNA, 18 nt, artificial
  Chemically synthesized
agaucgauggcuacgagu

SEQ ID NO: 19053 - RNA, 18 nt, artificial
  Chemically synthesized
ggagcuuccugaguggag

SEQ ID NO: 19054 - RNA, 18 nt, artificial
  Chemically synthesized
gggcagaccugugagguc

SEQ ID NO: 19055 - RNA, 18 nt, artificial
  Chemically synthesized
gcaucaauggcuucaccu

SEQ ID NO: 19056 - RNA, 18 nt, artificial
  Chemically synthesized
ccgugaccgcagcccagu

SEQ ID NO: 19057 - RNA, 18 nt, artificial
  Chemically synthesized
cagugagggacgucagac

SEQ ID NO: 19058 - RNA, 18 nt, artificial
  Chemically synthesized
cgaggaccuggagaccaa

SEQ ID NO: 19059 - RNA, 18 nt, artificial
  Chemically synthesized
ggagcauguacccgagag

SEQ ID NO: 19060 - RNA, 18 nt, artificial
  Chemically synthesized
cugccagaccaacaucaa

SEQ ID NO: 19061 - RNA, 18 nt, artificial
  Chemically synthesized
gaucaaugaguuccagug

SEQ ID NO: 19062 - RNA, 18 nt, artificial
  Chemically synthesized
ggguacaagugcgacugu

SEQ ID NO: 19063 - RNA, 18 nt, artificial
  Chemically synthesized
gcacagacggcaucaaca

SEQ ID NO: 19064 - RNA, 18 nt, artificial
  Chemically synthesized
ggcgagaccgccuugcac

SEQ ID NO: 19065 - RNA, 18 nt, artificial
  Chemically synthesized
gcgagaucaaccuggaug

SEQ ID NO: 19066 - RNA, 18 nt, artificial
  Chemically synthesized
cgccuuugugcuucuguu

SEQ ID NO: 19067 - RNA, 18 nt, artificial
  Chemically synthesized
caagaucaaugaguucca

SEQ ID NO: 19068 - RNA, 18 nt, artificial
  Chemically synthesized
gcaagaacgccgggacau

SEQ ID NO: 19069 - RNA, 18 nt, artificial
  Chemically synthesized
caugcaugucaaacauga

SEQ ID NO: 19070 - RNA, 18 nt, artificial
  Chemically synthesized
agaacaacagggaggaga

SEQ ID NO: 19071 - RNA, 18 nt, artificial
  Chemically synthesized
aguucugagagccagggu

SEQ ID NO: 19072 - RNA, 18 nt, artificial
  Chemically synthesized
ggccgugcagagugagac

SEQ ID NO: 19073 - RNA, 18 nt, artificial
  Chemically synthesized
gugugagaaugacgcucg

SEQ ID NO: 19074 - RNA, 18 nt, artificial
  Chemically synthesized
ccgcugcacaguagccuu

SEQ ID NO: 19075 - RNA, 18 nt, artificial
  Chemically synthesized
gccacauccuggacuaca

SEQ ID NO: 19076 - RNA, 18 nt, artificial
  Chemically synthesized
agacaugaccaguggcua

SEQ ID NO: 19077 - RNA, 18 nt, artificial
  Chemically synthesized
ugucugaggucaaugagu

SEQ ID NO: 19078 - RNA, 18 nt, artificial
  Chemically synthesized
gguggacaucgaugagug

SEQ ID NO: 19079 - RNA, 18 nt, artificial
  Chemically synthesized
ggcugcaaaggcaagccc

SEQ ID NO: 19080 - RNA, 18 nt, artificial
  Chemically synthesized
aggcaagcccugcaagaa

SEQ ID NO: 19081 - RNA, 18 nt, artificial
  Chemically synthesized
gccgagccaggcagacgu

SEQ ID NO: 19082 - RNA, 18 nt, artificial
  Chemically synthesized
ccucaacgacgcaugcau

SEQ ID NO: 19083 - RNA, 18 nt, artificial
  Chemically synthesized
ggaaaauaucgacgauug

SEQ ID NO: 19084 - RNA, 18 nt, artificial
  Chemically synthesized
ccuggagaccaagaaguu

SEQ ID NO: 19085 - RNA, 18 nt, artificial
  Chemically synthesized
agaagaugcuccagcaac

SEQ ID NO: 19086 - RNA, 18 nt, artificial
  Chemically synthesized
gggcuacacagggagcau

SEQ ID NO: 19087 - RNA, 18 nt, artificial
  Chemically synthesized
ccugcagugcaacaacca

SEQ ID NO: 19088 - RNA, 18 nt, artificial
  Chemically synthesized
cggacugcguggacagcu

SEQ ID NO: 19089 - RNA, 18 nt, artificial
  Chemically synthesized
ccagccugcacaaccaga

SEQ ID NO: 19090 - RNA, 18 nt, artificial
  Chemically synthesized
aggugcagccacaaaacu

SEQ ID NO: 19091 - RNA, 18 nt, artificial
  Chemically synthesized
ggaggacgcgggcaacaa

SEQ ID NO: 19092 - RNA, 18 nt, artificial
  Chemically synthesized
aggcagacgugcagccac

SEQ ID NO: 19093 - RNA, 18 nt, artificial
  Chemically synthesized
uggagaagggaaguugaa

SEQ ID NO: 19094 - RNA, 18 nt, artificial
  Chemically synthesized
ccaccacugcgagaccaa

SEQ ID NO: 19095 - RNA, 18 nt, artificial
  Chemically synthesized
cgcacaaggugucuucca

SEQ ID NO: 19096 - RNA, 18 nt, artificial
  Chemically synthesized
gcugcuggacgaguacaa

SEQ ID NO: 19097 - RNA, 18 nt, artificial
  Chemically synthesized
agccucaccuggugcaga

SEQ ID NO: 19098 - RNA, 18 nt, artificial
  Chemically synthesized
cccagguuccgaagaaga

SEQ ID NO: 19099 - RNA, 18 nt, artificial
  Chemically synthesized
gguccgagggcgucucca

SEQ ID NO: 19100 - RNA, 18 nt, artificial
  Chemically synthesized
ggucgacaucaacgagug

SEQ ID NO: 19101 - RNA, 18 nt, artificial
  Chemically synthesized
guucugagagccaggguu

SEQ ID NO: 19102 - RNA, 18 nt, artificial
  Chemically synthesized
cgggcaacaaggucugca

SEQ ID NO: 19103 - RNA, 18 nt, artificial
  Chemically synthesized
gacuaugccugcagcugu

SEQ ID NO: 19104 - RNA, 18 nt, artificial
  Chemically synthesized
cgcucaugaucgccuccu

SEQ ID NO: 19105 - RNA, 18 nt, artificial
  Chemically synthesized
cagcuacgagaccgccaa

SEQ ID NO: 19106 - RNA, 18 nt, artificial
  Chemically synthesized
gaacugugaggaaaauau

SEQ ID NO: 19107 - RNA, 18 nt, artificial
  Chemically synthesized
cggauuaauuugcaucug

SEQ ID NO: 19108 - RNA, 18 nt, artificial
  Chemically synthesized
ccaacauccaggacaaca

SEQ ID NO: 19109 - RNA, 18 nt, artificial
  Chemically synthesized
gugagggacgucagacuu

SEQ ID NO: 19110 - RNA, 18 nt, artificial
  Chemically synthesized
ccaccugccuggaccaga

SEQ ID NO: 19111 - RNA, 18 nt, artificial
  Chemically synthesized
ggcugcuggacgaguaca

SEQ ID NO: 19112 - RNA, 18 nt, artificial
  Chemically synthesized
gcgggaagugugaagcgg

SEQ ID NO: 19113 - RNA, 18 nt, artificial
  Chemically synthesized
ggcuggccuuugagacug

SEQ ID NO: 19114 - RNA, 18 nt, artificial
  Chemically synthesized
gggcaugaccagaugcgu

SEQ ID NO: 19115 - RNA, 18 nt, artificial
  Chemically synthesized
gcuggaggaccucaucaa

SEQ ID NO: 19116 - RNA, 18 nt, artificial
  Chemically synthesized
ggcggcaccugcaaagac

SEQ ID NO: 19117 - RNA, 18 nt, artificial
  Chemically synthesized
agugcaacaaccacgcgu

SEQ ID NO: 19118 - RNA, 18 nt, artificial
  Chemically synthesized
agaacaacacgccugacu

SEQ ID NO: 19119 - RNA, 18 nt, artificial
  Chemically synthesized
cgacgcacaaggugucuu

SEQ ID NO: 19120 - RNA, 18 nt, artificial
  Chemically synthesized
ccggcaggaugucaacga

SEQ ID NO: 19121 - RNA, 18 nt, artificial
  Chemically synthesized
ggcuacgugugcaccugc

SEQ ID NO: 19122 - RNA, 18 nt, artificial
  Chemically synthesized
cuuccugaguggagagcc

SEQ ID NO: 19123 - RNA, 18 nt, artificial
  Chemically synthesized
cuuuguuucagguucagu

SEQ ID NO: 19124 - RNA, 18 nt, artificial
  Chemically synthesized
gcacgaugucaaugagug

SEQ ID NO: 19125 - RNA, 18 nt, artificial
  Chemically synthesized
ggaggcauccuacccuuu

SEQ ID NO: 19126 - RNA, 18 nt, artificial
  Chemically synthesized
gcagccacaaaacuuaca

SEQ ID NO: 19127 - RNA, 18 nt, artificial
  Chemically synthesized
ggugaacugcucugagga

SEQ ID NO: 19128 - RNA, 18 nt, artificial
  Chemically synthesized
cgaggacuaugagagcuu

SEQ ID NO: 19129 - RNA, 18 nt, artificial
  Chemically synthesized
gacaagguguugacguug

SEQ ID NO: 19130 - RNA, 18 nt, artificial
  Chemically synthesized
ggaccugguggacgagug

SEQ ID NO: 19131 - RNA, 18 nt, artificial
  Chemically synthesized
gggcuggacugugcggag

SEQ ID NO: 19132 - RNA, 18 nt, artificial
  Chemically synthesized
agcagaaccugcagccag

SEQ ID NO: 19133 - RNA, 18 nt, artificial
  Chemically synthesized
gcagcaaaggccuggccu

SEQ ID NO: 19134 - RNA, 18 nt, artificial
  Chemically synthesized
ccgugcagagugagaccg

SEQ ID NO: 19135 - RNA, 18 nt, artificial
  Chemically synthesized
caacgagugcguucugag

SEQ ID NO: 19136 - RNA, 18 nt, artificial
  Chemically synthesized
ggcgcaacugcgagaccg

SEQ ID NO: 19137 - RNA, 18 nt, artificial
  Chemically synthesized
ggacaggucaguacugua

SEQ ID NO: 19138 - RNA, 18 nt, artificial
  Chemically synthesized
cuuccuuucccaagccuu

SEQ ID NO: 19139 - RNA, 18 nt, artificial
  Chemically synthesized
gccggagcagcugcgcaa

SEQ ID NO: 19140 - RNA, 18 nt, artificial
  Chemically synthesized
ugccaagagugcacccau

SEQ ID NO: 19141 - RNA, 18 nt, artificial
  Chemically synthesized
gcggaaggccagugcaac

SEQ ID NO: 19142 - RNA, 18 nt, artificial
  Chemically synthesized
agguggacaucgaugagu

SEQ ID NO: 19143 - RNA, 18 nt, artificial
  Chemically synthesized
cugucugaggucaaugag

SEQ ID NO: 19144 - RNA, 18 nt, artificial
  Chemically synthesized
gcugcacaguagccuugc

SEQ ID NO: 19145 - RNA, 18 nt, artificial
  Chemically synthesized
ggaccucaaggcacggag

SEQ ID NO: 19146 - RNA, 18 nt, artificial
  Chemically synthesized
agccugcacaaccagaca

SEQ ID NO: 19147 - RNA, 18 nt, artificial
  Chemically synthesized
ccaccacagccgcaccuu

SEQ ID NO: 19148 - RNA, 18 nt, artificial
  Chemically synthesized
gggcacucagggugugca

SEQ ID NO: 19149 - RNA, 18 nt, artificial
  Chemically synthesized
ccacgugugagaaugacg

SEQ ID NO: 19150 - RNA, 18 nt, artificial
  Chemically synthesized
cugcgagaccgacaucga

SEQ ID NO: 19151 - RNA, 18 nt, artificial
  Chemically synthesized
cgcaguugugcuccugaa

SEQ ID NO: 19152 - RNA, 18 nt, artificial
  Chemically synthesized
ccagcaccguccugggcu

SEQ ID NO: 19153 - RNA, 18 nt, artificial
  Chemically synthesized
cggcgcagcugcacuuca

SEQ ID NO: 19154 - RNA, 18 nt, artificial
  Chemically synthesized
gaaccaauacaacccucu

SEQ ID NO: 19155 - RNA, 18 nt, artificial
  Chemically synthesized
gagcuuccugaguggaga

SEQ ID NO: 19156 - RNA, 18 nt, artificial
  Chemically synthesized
gaggcaaacggaggcaaa

SEQ ID NO: 19157 - RNA, 18 nt, artificial
  Chemically synthesized
gagucuguugugugucau

SEQ ID NO: 19158 - RNA, 18 nt, artificial
  Chemically synthesized
cuggagaccaagaaguuc

SEQ ID NO: 19159 - RNA, 18 nt, artificial
  Chemically synthesized
ggcauggugccgaaccaa

SEQ ID NO: 19160 - RNA, 18 nt, artificial
  Chemically synthesized
gcaaagacaugaccagug

SEQ ID NO: 19161 - RNA, 18 nt, artificial
  Chemically synthesized
ggcccugaauuucacugu

SEQ ID NO: 19162 - RNA, 18 nt, artificial
  Chemically synthesized
cuacgagaccgccaaggu

SEQ ID NO: 19163 - RNA, 18 nt, artificial
  Chemically synthesized
cguugguuauacaaguuc

SEQ ID NO: 19164 - RNA, 18 nt, artificial
  Chemically synthesized
ggcuucaaagugucugag

SEQ ID NO: 19165 - RNA, 18 nt, artificial
  Chemically synthesized
caacugugacaucaacaa

SEQ ID NO: 19166 - RNA, 18 nt, artificial
  Chemically synthesized
cgauuguccaggaaacaa

SEQ ID NO: 19167 - RNA, 18 nt, artificial
  Chemically synthesized
cuggaaguacuucaguga

SEQ ID NO: 19168 - RNA, 18 nt, artificial
  Chemically synthesized
guugugcuccugaagaac

SEQ ID NO: 19169 - RNA, 18 nt, artificial
  Chemically synthesized
caauggcugcaaaggcaa

SEQ ID NO: 19170 - RNA, 18 nt, artificial
  Chemically synthesized
ggcccuacgugcccugca

SEQ ID NO: 19171 - RNA, 18 nt, artificial
  Chemically synthesized
ggccggagcuuccugagu

SEQ ID NO: 19172 - RNA, 18 nt, artificial
  Chemically synthesized
ccacugcgagaccaacau

SEQ ID NO: 19173 - RNA, 18 nt, artificial
  Chemically synthesized
gcacguguauugacgacg

SEQ ID NO: 19174 - RNA, 18 nt, artificial
  Chemically synthesized
ggacuaccugggcggcua

SEQ ID NO: 19175 - RNA, 18 nt, artificial
  Chemically synthesized
ggcuacuccugcaagugc

SEQ ID NO: 19176 - RNA, 18 nt, artificial
  Chemically synthesized
agcagaaccugcagccag

SEQ ID NO: 19177 - RNA, 18 nt, artificial
  Chemically synthesized
ggcagacgugcagccacu

SEQ ID NO: 19178 - RNA, 18 nt, artificial
  Chemically synthesized
gcugcaaaggcaagcccu

SEQ ID NO: 19179 - RNA, 18 nt, artificial
  Chemically synthesized
ggcaaagcuggcucaccu

SEQ ID NO: 19180 - RNA, 18 nt, artificial
  Chemically synthesized
gguuuuccuacguaggau

SEQ ID NO: 19181 - RNA, 18 nt, artificial
  Chemically synthesized
ggaccucaucaacucaca

SEQ ID NO: 19182 - RNA, 18 nt, artificial
  Chemically synthesized
cuacguaggaugaaaaga

SEQ ID NO: 19183 - RNA, 18 nt, artificial
  Chemically synthesized
caaugaguuccagugcga

SEQ ID NO: 19184 - RNA, 18 nt, artificial
  Chemically synthesized
cuuugugcuucuguucuu

SEQ ID NO: 19185 - RNA, 18 nt, artificial
  Chemically synthesized
gggcgacgucacccacga

SEQ ID NO: 19186 - RNA, 18 nt, artificial
  Chemically synthesized
ugcaugucaaacaugaga

SEQ ID NO: 19187 - RNA, 18 nt, artificial
  Chemically synthesized
ugcggagcauguacccga

SEQ ID NO: 19188 - RNA, 18 nt, artificial
  Chemically synthesized
ggaaguacuucagugacg

SEQ ID NO: 19189 - RNA, 18 nt, artificial
  Chemically synthesized
ggaccugugagcccacau

SEQ ID NO: 19190 - RNA, 18 nt, artificial
  Chemically synthesized
gcaagggcagaccuguga

SEQ ID NO: 19191 - RNA, 18 nt, artificial
  Chemically synthesized
uguuggagaagggaaguu

SEQ ID NO: 19192 - RNA, 18 nt, artificial
  Chemically synthesized
augguuucuugcaagcau

SEQ ID NO: 19193 - RNA, 18 nt, artificial
  Chemically synthesized
ccgaggauguggacgagu

SEQ ID NO: 19194 - RNA, 18 nt, artificial
  Chemically synthesized
cugugagcccacauccga

SEQ ID NO: 19195 - RNA, 18 nt, artificial
  Chemically synthesized
agaacugcacgcagucuc

SEQ ID NO: 19196 - RNA, 18 nt, artificial
  Chemically synthesized
gggcggguccaccaguuu

SEQ ID NO: 19197 - RNA, 18 nt, artificial
  Chemically synthesized
cccgcugcacaguagccu

SEQ ID NO: 19198 - RNA, 18 nt, artificial
  Chemically synthesized
ccugcagccagcaaacau

SEQ ID NO: 19199 - RNA, 18 nt, artificial
  Chemically synthesized
cuaccuggagauugacaa

SEQ ID NO: 19200 - RNA, 18 nt, artificial
  Chemically synthesized
gggcgcaacugcgagacc

SEQ ID NO: 19201 - RNA, 18 nt, artificial
  Chemically synthesized
cgagaucgacgucaacga

SEQ ID NO: 19202 - RNA, 18 nt, artificial
  Chemically synthesized
ggacgaccagacagacca

SEQ ID NO: 19203 - RNA, 18 nt, artificial
  Chemically synthesized
agaggagccuuuuuaaaa

SEQ ID NO: 19204 - RNA, 18 nt, artificial
  Chemically synthesized
ggcuggucagggaaaucg

SEQ ID NO: 19205 - RNA, 18 nt, artificial
  Chemically synthesized
gccaaaugccugccagaa

SEQ ID NO: 19206 - RNA, 18 nt, artificial
  Chemically synthesized
ggagcauguacccgagag

SEQ ID NO: 19207 - RNA, 18 nt, artificial
  Chemically synthesized
cacaaaacuuacagaugc

SEQ ID NO: 19208 - RNA, 18 nt, artificial
  Chemically synthesized
ugaacugcucugaggaga

SEQ ID NO: 19209 - RNA, 18 nt, artificial
  Chemically synthesized
gccucaacggguacaagu

SEQ ID NO: 19210 - RNA, 18 nt, artificial
  Chemically synthesized
gagugggaccaacuguga

SEQ ID NO: 19211 - RNA, 18 nt, artificial
  Chemically synthesized
agcgcaugcaucacgaca

SEQ ID NO: 19212 - RNA, 18 nt, artificial
  Chemically synthesized
gccugcacaaccagacag

SEQ ID NO: 19213 - RNA, 18 nt, artificial
  Chemically synthesized
agaacauugaugacugug

SEQ ID NO: 19214 - RNA, 18 nt, artificial
  Chemically synthesized
cgugugagaaugacgcuc

SEQ ID NO: 19215 - RNA, 18 nt, artificial
  Chemically synthesized
gagaccaacaucaacgag

SEQ ID NO: 19216 - RNA, 18 nt, artificial
  Chemically synthesized
gcuggacgaguacaaccu

SEQ ID NO: 19217 - RNA, 18 nt, artificial
  Chemically synthesized
cauccuggacuacagcuu

SEQ ID NO: 19218 - RNA, 18 nt, artificial
  Chemically synthesized
gcgcauccugccagaaca

SEQ ID NO: 19219 - RNA, 18 nt, artificial
  Chemically synthesized
gcggguucaucugcaagu

SEQ ID NO: 19220 - RNA, 18 nt, artificial
  Chemically synthesized
gacccaacacuuacaccu

SEQ ID NO: 19221 - RNA, 18 nt, artificial
  Chemically synthesized
ggaccacaggacccaacu

SEQ ID NO: 19222 - RNA, 18 nt, artificial
  Chemically synthesized
aaaugauguuggagaagg

SEQ ID NO: 19223 - RNA, 18 nt, artificial
  Chemically synthesized
cuggacgaguacaaccug

SEQ ID NO: 19224 - RNA, 18 nt, artificial
  Chemically synthesized
ggugacugcucccucaac

SEQ ID NO: 19225 - RNA, 18 nt, artificial
  Chemically synthesized
gauguuggagaagggaag

SEQ ID NO: 19226 - RNA, 18 nt, artificial
  Chemically synthesized
cgaggucaacacagacga

SEQ ID NO: 19227 - RNA, 18 nt, artificial
  Chemically synthesized
acgacaaccagaaugagu

SEQ ID NO: 19228 - RNA, 18 nt, artificial
  Chemically synthesized
cccagaacugcgugcagc

SEQ ID NO: 19229 - RNA, 18 nt, artificial
  Chemically synthesized
gaacuguagaugauguau

SEQ ID NO: 19230 - RNA, 18 nt, artificial
  Chemically synthesized
ggcuacaacugcgugugu

SEQ ID NO: 19231 - RNA, 18 nt, artificial
  Chemically synthesized
gcuggacugugcggagca

SEQ ID NO: 19232 - RNA, 18 nt, artificial
  Chemically synthesized
aggaccugguggacgagu

SEQ ID NO: 19233 - RNA, 18 nt, artificial
  Chemically synthesized
cgcugacggaguacaagu

SEQ ID NO: 19234 - RNA, 18 nt, artificial
  Chemically synthesized
uggguggagugggaccaa

SEQ ID NO: 19235 - RNA, 18 nt, artificial
  Chemically synthesized
agguucaguauuauguag

SEQ ID NO: 19236 - RNA, 18 nt, artificial
  Chemically synthesized
gucaaacaugagaugugu

SEQ ID NO: 19237 - RNA, 18 nt, artificial
  Chemically synthesized
agaguggacaggucagua

SEQ ID NO: 19238 - RNA, 18 nt, artificial
  Chemically synthesized
ggacccaacugcgagauc

SEQ ID NO: 19239 - RNA, 18 nt, artificial
  Chemically synthesized
gggauccacugugagaac

SEQ ID NO: 19240 - RNA, 18 nt, artificial
  Chemically synthesized
gccagugucugcagggcu

SEQ ID NO: 19241 - RNA, 18 nt, artificial
  Chemically synthesized
gcauaguccaaaaagcuc

SEQ ID NO: 19242 - RNA, 18 nt, artificial
  Chemically synthesized
guucuugaaauguaggca

SEQ ID NO: 19243 - RNA, 18 nt, artificial
  Chemically synthesized
gcagcgagaacauugaug

SEQ ID NO: 19244 - RNA, 18 nt, artificial
  Chemically synthesized
ccugugaggucgacauca

SEQ ID NO: 19245 - RNA, 18 nt, artificial
  Chemically synthesized
gcugcaacagcgcggagu

SEQ ID NO: 19246 - RNA, 18 nt, artificial
  Chemically synthesized
auccaacccuugugucaa

SEQ ID NO: 19247 - RNA, 18 nt, artificial
  Chemically synthesized
ccgcaagcccagcagcaa

SEQ ID NO: 19248 - RNA, 18 nt, artificial
  Chemically synthesized
ccaacaucaacgagugug

SEQ ID NO: 19249 - RNA, 18 nt, artificial
  Chemically synthesized
cagaccaacaucaacgag

SEQ ID NO: 19250 - RNA, 18 nt, artificial
  Chemically synthesized
gggagcauguguaacauc

SEQ ID NO: 19251 - RNA, 18 nt, artificial
  Chemically synthesized
cacgcggauuaauuugca

SEQ ID NO: 19252 - RNA, 18 nt, artificial
  Chemically synthesized
ggacaucgaugagugcga

SEQ ID NO: 19253 - RNA, 18 nt, artificial
  Chemically synthesized
ccggcuuccuuucccaag

SEQ ID NO: 19254 - RNA, 18 nt, artificial
  Chemically synthesized
ugaucuacaugaggaacu

SEQ ID NO: 19255 - RNA, 18 nt, artificial
  Chemically synthesized
ggucacacacggaggcau

SEQ ID NO: 19256 - RNA, 18 nt, artificial
  Chemically synthesized
cgcagucucugcagugcu

SEQ ID NO: 19257 - RNA, 18 nt, artificial
  Chemically synthesized
ccaacaucaacgagugcu

SEQ ID NO: 19258 - RNA, 18 nt, artificial
  Chemically synthesized
caacgagugcuccagcca

SEQ ID NO: 19259 - RNA, 18 nt, artificial
  Chemically synthesized
ggagcgcaugcaucacga

SEQ ID NO: 19260 - RNA, 18 nt, artificial
  Chemically synthesized
agaugcuccagcaacaca

SEQ ID NO: 19261 - RNA, 18 nt, artificial
  Chemically synthesized
guauuauguaguuguucg

SEQ ID NO: 19262 - RNA, 18 nt, artificial
  Chemically synthesized
cccacacccaguaccgcu

SEQ ID NO: 19263 - RNA, 18 nt, artificial
  Chemically synthesized
gccggagcuuccugagug

SEQ ID NO: 19264 - RNA, 18 nt, artificial
  Chemically synthesized
gaaccgagccacagaccu

SEQ ID NO: 19265 - RNA, 18 nt, artificial
  Chemically synthesized
ggugccgaaccaauacaa

SEQ ID NO: 19266 - RNA, 18 nt, artificial
  Chemically synthesized
gcaucaacacgcugggcu

SEQ ID NO: 19267 - RNA, 18 nt, artificial
  Chemically synthesized
cagccacaaaacuuacag

SEQ ID NO: 19268 - RNA, 18 nt, artificial
  Chemically synthesized
agaaaacaagcaaguucu

SEQ ID NO: 19269 - RNA, 18 nt, artificial
  Chemically synthesized
gguugacgccgacugcau

SEQ ID NO: 19270 - RNA, 18 nt, artificial
  Chemically synthesized
gaggcauccuacccuuuu

SEQ ID NO: 19271 - RNA, 18 nt, artificial
  Chemically synthesized
gcgccacgugugagaaug

SEQ ID NO: 19272 - RNA, 18 nt, artificial
  Chemically synthesized
ggacgucagacuuggcuc

SEQ ID NO: 19273 - RNA, 18 nt, artificial
  Chemically synthesized
ggcagacuaugccugcag

SEQ ID NO: 19274 - RNA, 18 nt, artificial
  Chemically synthesized
gacaagaucaaugaguuc

SEQ ID NO: 19275 - RNA, 18 nt, artificial
  Chemically synthesized
gagccaggguuuuccuac

SEQ ID NO: 19276 - RNA, 18 nt, artificial
  Chemically synthesized
ccgacuucaucuaccagg

SEQ ID NO: 19277 - RNA, 18 nt, artificial
  Chemically synthesized
cgagugccgugcugguca

SEQ ID NO: 19278 - RNA, 18 nt, artificial
  Chemically synthesized
caggcagacgugcagcca

SEQ ID NO: 19279 - RNA, 18 nt, artificial
  Chemically synthesized
acaacaaugagugugaau

SEQ ID NO: 19280 - RNA, 18 nt, artificial
  Chemically synthesized
gguggaccgcagaggcgu

SEQ ID NO: 19281 - RNA, 18 nt, artificial
  Chemically synthesized
gcguggacagcuacacgu

SEQ ID NO: 19282 - RNA, 18 nt, artificial
  Chemically synthesized
cccguguuuuguaggaga

SEQ ID NO: 19283 - RNA, 18 nt, artificial
  Chemically synthesized
cgcagugcuuccagagug

SEQ ID NO: 19284 - RNA, 18 nt, artificial
  Chemically synthesized
agagugagaccguggagc

SEQ ID NO: 19285 - RNA, 18 nt, artificial
  Chemically synthesized
gucugaggucaaugagug

SEQ ID NO: 19286 - RNA, 18 nt, artificial
  Chemically synthesized
gucagacuuggcucagcu

SEQ ID NO: 19287 - RNA, 18 nt, artificial
  Chemically synthesized
gcagacccacacccagua

SEQ ID NO: 19288 - RNA, 18 nt, artificial
  Chemically synthesized
gcuuccuuucccaagccu

SEQ ID NO: 19289 - RNA, 18 nt, artificial
  Chemically synthesized
cgacgucaacgccguaga

SEQ ID NO: 19290 - RNA, 18 nt, artificial
  Chemically synthesized
ggccagaacugugaggaa

SEQ ID NO: 19291 - RNA, 18 nt, artificial
  Chemically synthesized
gccuguggaagcaaggag

SEQ ID NO: 19292 - RNA, 18 nt, artificial
  Chemically synthesized
ggcgcagcugcacuucau

SEQ ID NO: 19293 - RNA, 18 nt, artificial
  Chemically synthesized
uggagugggaccaacugu

SEQ ID NO: 19294 - RNA, 18 nt, artificial
  Chemically synthesized
ccggaggccuucaaguaa

SEQ ID NO: 19295 - RNA, 18 nt, artificial
  Chemically synthesized
ugugagaacaacacgccu

SEQ ID NO: 19296 - RNA, 18 nt, artificial
  Chemically synthesized
ggagaucgacgagugccu

SEQ ID NO: 19297 - RNA, 18 nt, artificial
  Chemically synthesized
cgccuuugugcuucuguu

SEQ ID NO: 19298 - RNA, 18 nt, artificial
  Chemically synthesized
caagcaaguucugagagc

SEQ ID NO: 19299 - RNA, 18 nt, artificial
  Chemically synthesized
gccugacugcacagagag

SEQ ID NO: 19300 - RNA, 18 nt, artificial
  Chemically synthesized
gcacggacugcguggaca

SEQ ID NO: 19301 - RNA, 18 nt, artificial
  Chemically synthesized
ggacguccgcggcuccau

SEQ ID NO: 19302 - RNA, 18 nt, artificial
  Chemically synthesized
ugaggucaaugagugcaa

SEQ ID NO: 19303 - RNA, 18 nt, artificial
  Chemically synthesized
cugcagcgagaacauuga

SEQ ID NO: 19304 - RNA, 18 nt, artificial
  Chemically synthesized
ccaguggcuacgugugca

SEQ ID NO: 19305 - RNA, 18 nt, artificial
  Chemically synthesized
gcgcaacugcgagaccga

SEQ ID NO: 19306 - RNA, 18 nt, artificial
  Chemically synthesized
gcgugugugucaacggcu

SEQ ID NO: 19307 - RNA, 18 nt, artificial
  Chemically synthesized
ccagcagcagcaaagccu

SEQ ID NO: 19308 - RNA, 18 nt, artificial
  Chemically synthesized
ggcuacacaggcagcuac

SEQ ID NO: 19309 - RNA, 18 nt, artificial
  Chemically synthesized
ugcgagaccaacaucaac

SEQ ID NO: 19310 - RNA, 18 nt, artificial
  Chemically synthesized
ccguggacucccuggagu

SEQ ID NO: 19311 - RNA, 18 nt, artificial
  Chemically synthesized
ggacuaugagagcuucuc

SEQ ID NO: 19312 - RNA, 18 nt, artificial
  Chemically synthesized
guugguuauacaaguucu

SEQ ID NO: 19313 - RNA, 18 nt, artificial
  Chemically synthesized
gaaaugauguuggagaag

SEQ ID NO: 19314 - RNA, 18 nt, artificial
  Chemically synthesized
gggcuacacaggcagcua

SEQ ID NO: 19315 - RNA, 18 nt, artificial
  Chemically synthesized
cccaagauguugauuuuu

SEQ ID NO: 19316 - RNA, 18 nt, artificial
  Chemically synthesized
cugagggcuucaaagugu

SEQ ID NO: 19317 - RNA, 18 nt, artificial
  Chemically synthesized
gggcaucugugccaguac

SEQ ID NO: 19318 - RNA, 18 nt, artificial
  Chemically synthesized
gacagccagugcaacuca

SEQ ID NO: 19319 - RNA, 18 nt, artificial
  Chemically synthesized
caugcaugauggcacgac

SEQ ID NO: 19320 - RNA, 18 nt, artificial
  Chemically synthesized
ggaguuccagugcaucug

SEQ ID NO: 19321 - RNA, 18 nt, artificial
  Chemically synthesized
cuaccugggcagccucaa

SEQ ID NO: 19322 - RNA, 18 nt, artificial
  Chemically synthesized
ggcagacuaugccugcag

SEQ ID NO: 19323 - RNA, 18 nt, artificial
  Chemically synthesized
cagccugcagugcaacaa

SEQ ID NO: 19324 - RNA, 18 nt, artificial
  Chemically synthesized
ggacggcaucaauggcuu

SEQ ID NO: 19325 - RNA, 18 nt, artificial
  Chemically synthesized
cugcaagaauggugccaa

SEQ ID NO: 19326 - RNA, 18 nt, artificial
  Chemically synthesized
ggacgaguacaaccuggu

SEQ ID NO: 19327 - RNA, 18 nt, artificial
  Chemically synthesized
ggagagccgagccaggca

SEQ ID NO: 19328 - RNA, 18 nt, artificial
  Chemically synthesized
ccgccagaguggacaggu

SEQ ID NO: 19329 - RNA, 18 nt, artificial
  Chemically synthesized
caagaucgauggcuacga

SEQ ID NO: 19330 - RNA, 18 nt, artificial
  Chemically synthesized
cagcgagaacauugauga

SEQ ID NO: 19331 - RNA, 18 nt, artificial
  Chemically synthesized
gagugugccugccugcca

SEQ ID NO: 19332 - RNA, 18 nt, artificial
  Chemically synthesized
ccgcgugcugcacaccaa

SEQ ID NO: 19333 - RNA, 18 nt, artificial
  Chemically synthesized
gggcaacagcgaggaaga

SEQ ID NO: 19334 - RNA, 18 nt, artificial
  Chemically synthesized
ggcgccagccugcacaac

SEQ ID NO: 19335 - RNA, 18 nt, artificial
  Chemically synthesized
gguucaucugcaagugcc

SEQ ID NO: 19336 - RNA, 18 nt, artificial
  Chemically synthesized
ccagcgugcggaaggcca

SEQ ID NO: 19337 - RNA, 18 nt, artificial
  Chemically synthesized
ccucgcagugcuuccaga

SEQ ID NO: 19338 - RNA, 18 nt, artificial
  Chemically synthesized
cagguuccgaagaagaug

SEQ ID NO: 19339 - RNA, 18 nt, artificial
  Chemically synthesized
cggccacugugacagcca

SEQ ID NO: 19340 - RNA, 18 nt, artificial
  Chemically synthesized
gcauguacccgagaggcu

SEQ ID NO: 19341 - RNA, 18 nt, artificial
  Chemically synthesized
ccugcaaagacaugacca

SEQ ID NO: 19342 - RNA, 18 nt, artificial
  Chemically synthesized
gcaagaacggcggcaaau

SEQ ID NO: 19343 - RNA, 18 nt, artificial
  Chemically synthesized
gccgccgccgugaacaau

SEQ ID NO: 19344 - RNA, 18 nt, artificial
  Chemically synthesized
ggaagaagucccaggacg

SEQ ID NO: 19345 - RNA, 18 nt, artificial
  Chemically synthesized
gcaagaauggugccaagu

SEQ ID NO: 19346 - RNA, 18 nt, artificial
  Chemically synthesized
gccuggcggugcacacua

SEQ ID NO: 19347 - RNA, 18 nt, artificial
  Chemically synthesized
caaugagugcgacucaca

SEQ ID NO: 19348 - RNA, 18 nt, artificial
  Chemically synthesized
cugcagugcaacaaccac

SEQ ID NO: 19349 - RNA, 18 nt, artificial
  Chemically synthesized
cccaacugcgagaucaac

SEQ ID NO: 19350 - RNA, 18 nt, artificial
  Chemically synthesized
aggcaauccgaggacuau

SEQ ID NO: 19351 - RNA, 18 nt, artificial
  Chemically synthesized
gccacgugguggaccgca

SEQ ID NO: 19352 - RNA, 18 nt, artificial
  Chemically synthesized
gccagagccgggcacauu

SEQ ID NO: 19353 - RNA, 18 nt, artificial
  Chemically synthesized
cugugaggaggacaucaa

SEQ ID NO: 19354 - RNA, 18 nt, artificial
  Chemically synthesized
ugugcacugugagaucaa

SEQ ID NO: 19355 - RNA, 18 nt, artificial
  Chemically synthesized
ugcaaagacaugaccagu

SEQ ID NO: 19356 - RNA, 18 nt, artificial
  Chemically synthesized
ccugaagaacgcuucaga

SEQ ID NO: 19357 - RNA, 18 nt, artificial
  Chemically synthesized
gagugcaggcaauccgag

SEQ ID NO: 19358 - RNA, 18 nt, artificial
  Chemically synthesized
gcacauugagcugugcaa

SEQ ID NO: 19359 - RNA, 18 nt, artificial
  Chemically synthesized
caacgagugugccaguga

SEQ ID NO: 19360 - RNA, 18 nt, artificial
  Chemically synthesized
gaccuggacgaccagaca

SEQ ID NO: 19361 - RNA, 18 nt, artificial
  Chemically synthesized
ggacugugcggagcaugu

SEQ ID NO: 19362 - RNA, 18 nt, artificial
  Chemically synthesized
cgcuacucacgcucugau

SEQ ID NO: 19363 - RNA, 18 nt, artificial
  Chemically synthesized
cacugugagaacaacacg

SEQ ID NO: 19364 - RNA, 18 nt, artificial
  Chemically synthesized
gcagaaaaaaugucugua

SEQ ID NO: 19365 - RNA, 18 nt, artificial
  Chemically synthesized
acgucaacgagugcgucu

SEQ ID NO: 19366 - RNA, 18 nt, artificial
  Chemically synthesized
guguaacaucaacaucga

SEQ ID NO: 19367 - RNA, 18 nt, artificial
  Chemically synthesized
gcgucaaugacuuccacu

SEQ ID NO: 19368 - RNA, 18 nt, artificial
  Chemically synthesized
gccagaacgacgccaccu

SEQ ID NO: 19369 - RNA, 18 nt, artificial
  Chemically synthesized
gccuuagccgcccaugca

SEQ ID NO: 19370 - RNA, 18 nt, artificial
  Chemically synthesized
gcuccagcaacacagccu

SEQ ID NO: 19371 - RNA, 18 nt, artificial
  Chemically synthesized
aguugaacgagcauaguc

SEQ ID NO: 19372 - RNA, 18 nt, artificial
  Chemically synthesized
ccuggacaagaucaauga

SEQ ID NO: 19373 - RNA, 18 nt, artificial
  Chemically synthesized
cuuucugugaggaggaca

SEQ ID NO: 19374 - RNA, 18 nt, artificial
  Chemically synthesized
gcgagaccaacaucaacg

SEQ ID NO: 19375 - RNA, 18 nt, artificial
  Chemically synthesized
cgcugggcagccucaaca

SEQ ID NO: 19376 - RNA, 18 nt, artificial
  Chemically synthesized
gggagugcaggcaauccg

SEQ ID NO: 19377 - RNA, 18 nt, artificial
  Chemically synthesized
gagccaggcagacgugca

SEQ ID NO: 19378 - RNA, 18 nt, artificial
  Chemically synthesized
ccagguagaaacuuuuau

SEQ ID NO: 19379 - RNA, 18 nt, artificial
  Chemically synthesized
gugugucaugccagugag

SEQ ID NO: 19380 - RNA, 18 nt, artificial
  Chemically synthesized
caacgaguguggccagaa

SEQ ID NO: 19381 - RNA, 18 nt, artificial
  Chemically synthesized
agaaccuugugcacuggu

SEQ ID NO: 19382 - RNA, 18 nt, artificial
  Chemically synthesized
ggaggcaccugccacaac

SEQ ID NO: 19383 - RNA, 18 nt, artificial
  Chemically synthesized
ggcacgacgccacugauc

SEQ ID NO: 19384 - RNA, 18 nt, artificial
  Chemically synthesized
gccacaacgaggucggcu

SEQ ID NO: 19385 - RNA, 18 nt, artificial
  Chemically synthesized
gcgcaugcaucacgacau

SEQ ID NO: 19386 - RNA, 18 nt, artificial
  Chemically synthesized
agcacgaugucaaugagu

SEQ ID NO: 19387 - RNA, 18 nt, artificial
  Chemically synthesized
ggauguggacgagugcca

SEQ ID NO: 19388 - RNA, 18 nt, artificial
  Chemically synthesized
gcaugcuugugaaaaugu

SEQ ID NO: 19389 - RNA, 18 nt, artificial
  Chemically synthesized
gggcaccugucuggacaa

SEQ ID NO: 19390 - RNA, 18 nt, artificial
  Chemically synthesized
ccugcaagaacgccggga

SEQ ID NO: 19391 - RNA, 18 nt, artificial
  Chemically synthesized
gggcggcuacuccugcaa

SEQ ID NO: 19392 - RNA, 18 nt, artificial
  Chemically synthesized
caaugagugcaacagcaa

SEQ ID NO: 19393 - RNA, 18 nt, artificial
  Chemically synthesized
gcuucacugggcaucugu

SEQ ID NO: 19394 - RNA, 18 nt, artificial
  Chemically synthesized
agccugcagugcaacaac

SEQ ID NO: 19395 - RNA, 18 nt, artificial
  Chemically synthesized
gggcaaguccgcccugca

SEQ ID NO: 19396 - RNA, 18 nt, artificial
  Chemically synthesized
gcuccaacugcgacacca

SEQ ID NO: 19397 - RNA, 18 nt, artificial
  Chemically synthesized
ggacagccucaacgggua

SEQ ID NO: 19398 - RNA, 18 nt, artificial
  Chemically synthesized
caaaggcaagcccugcaa

SEQ ID NO: 19399 - RNA, 18 nt, artificial
  Chemically synthesized
cggcgugaacaccuacaa

SEQ ID NO: 19400 - RNA, 18 nt, artificial
  Chemically synthesized
agggcagaccugugaggu

SEQ ID NO: 19401 - RNA, 18 nt, artificial
  Chemically synthesized
cugcgaguccgucaucaa

SEQ ID NO: 19402 - RNA, 18 nt, artificial
  Chemically synthesized
cccugucccagaugauga

SEQ ID NO: 19403 - RNA, 18 nt, artificial
  Chemically synthesized
ccagguuccgaagaagau

SEQ ID NO: 19404 - RNA, 18 nt, artificial
  Chemically synthesized
gggcacguguauugacga

SEQ ID NO: 19405 - RNA, 18 nt, artificial
  Chemically synthesized
ggaccgcgacaacgccua

SEQ ID NO: 19406 - RNA, 18 nt, artificial
  Chemically synthesized
ccaagugcuuuaacaacg

SEQ ID NO: 19407 - RNA, 18 nt, artificial
  Chemically synthesized
cgagaccaacaucaacga

SEQ ID NO: 19408 - RNA, 18 nt, artificial
  Chemically synthesized
ccuggagauugacaaccg

SEQ ID NO: 19409 - RNA, 18 nt, artificial
  Chemically synthesized
gccacugugacagccagu

SEQ ID NO: 19410 - RNA, 18 nt, artificial
  Chemically synthesized
cagcccaguuccugacgc

SEQ ID NO: 19411 - RNA, 18 nt, artificial
  Chemically synthesized
ggacgaggaccuggagac

SEQ ID NO: 19412 - RNA, 18 nt, artificial
  Chemically synthesized
gguuagauguugccaugu

SEQ ID NO: 19413 - RNA, 18 nt, artificial
  Chemically synthesized
ggacguggaugagugcuc

SEQ ID NO: 19414 - RNA, 18 nt, artificial
  Chemically synthesized
gggaaguugaacgagcau

SEQ ID NO: 19415 - RNA, 18 nt, artificial
  Chemically synthesized
ggcggagggagcuggacc

SEQ ID NO: 19416 - RNA, 18 nt, artificial
  Chemically synthesized
gcggagugcgagugggac

SEQ ID NO: 19417 - RNA, 18 nt, artificial
  Chemically synthesized
ggcuacagugggcgcaac

SEQ ID NO: 19418 - RNA, 18 nt, artificial
  Chemically synthesized
aggaggacaucaacgagu

SEQ ID NO: 19419 - RNA, 18 nt, artificial
  Chemically synthesized
gagugagaccguggagcc

SEQ ID NO: 19420 - RNA, 18 nt, artificial
  Chemically synthesized
ggcagugugugcaggccu

SEQ ID NO: 19421 - RNA, 18 nt, artificial
  Chemically synthesized
acccaacugcgagaucaa

SEQ ID NO: 19422 - RNA, 18 nt, artificial
  Chemically synthesized
caagaauggugccaagug

SEQ ID NO: 19423 - RNA, 18 nt, artificial
  Chemically synthesized
caugaaucuuuguuucag

SEQ ID NO: 19424 - RNA, 18 nt, artificial
  Chemically synthesized
cgucaacgccguagauga

SEQ ID NO: 19425 - RNA, 18 nt, artificial
  Chemically synthesized
cggagcuuccugagugga

SEQ ID NO: 19426 - RNA, 18 nt, artificial
  Chemically synthesized
gggucacacacggaggca

SEQ ID NO: 19427 - RNA, 18 nt, artificial
  Chemically synthesized
gguccgcaagcccagcag

SEQ ID NO: 19428 - RNA, 18 nt, artificial
  Chemically synthesized
gccaggacguggaugagu

SEQ ID NO: 19429 - RNA, 18 nt, artificial
  Chemically synthesized
gcgacgucacccacgagu

SEQ ID NO: 19430 - RNA, 18 nt, artificial
  Chemically synthesized
gguggugguggugcugau

SEQ ID NO: 19431 - RNA, 18 nt, artificial
  Chemically synthesized
gcaccugcguggacggca

SEQ ID NO: 19432 - RNA, 18 nt, artificial
  Chemically synthesized
gcaacaaggucugcagcc

SEQ ID NO: 19433 - RNA, 18 nt, artificial
  Chemically synthesized
ccuucuaccguugccugu

SEQ ID NO: 19434 - RNA, 18 nt, artificial
  Chemically synthesized
cugugaggaaaauaucga

SEQ ID NO: 19435 - RNA, 18 nt, artificial
  Chemically synthesized
ccaacugcgagaucaacc

SEQ ID NO: 19436 - RNA, 18 nt, artificial
  Chemically synthesized
gugagaccguggagccgc

SEQ ID NO: 19437 - RNA, 18 nt, artificial
  Chemically synthesized
ggacgagugugccagcac

SEQ ID NO: 19438 - RNA, 18 nt, artificial
  Chemically synthesized
gaacauugaugacugugc

SEQ ID NO: 19439 - RNA, 18 nt, artificial
  Chemically synthesized
uccugaguggagagccga

SEQ ID NO: 19440 - RNA, 18 nt, artificial
  Chemically synthesized
gaaacaacugcaagaacg

SEQ ID NO: 19441 - RNA, 18 nt, artificial
  Chemically synthesized
gaggcugcuggacgagua

SEQ ID NO: 19442 - RNA, 18 nt, artificial
  Chemically synthesized
uguuggagaagggaaguu

SEQ ID NO: 19443 - RNA, 18 nt, artificial
  Chemically synthesized
acaucaacaacaaugagu

SEQ ID NO: 19444 - RNA, 18 nt, artificial
  Chemically synthesized
caggcaauccgaggacua

SEQ ID NO: 19445 - RNA, 18 nt, artificial
  Chemically synthesized
cgcugaucgaggaggcgu

SEQ ID NO: 19446 - RNA, 18 nt, artificial
  Chemically synthesized
gcagagugagaccgugga

SEQ ID NO: 19447 - RNA, 18 nt, artificial
  Chemically synthesized
guuucuugcaagcaugcu

SEQ ID NO: 19448 - RNA, 18 nt, artificial
  Chemically synthesized
gccuguuaggagaagcug

SEQ ID NO: 19449 - RNA, 18 nt, artificial
  Chemically synthesized
ggaucauauggaccgccu

SEQ ID NO: 19450 - RNA, 18 nt, artificial
  Chemically synthesized
gcccugaauuucacugug

SEQ ID NO: 19451 - RNA, 18 nt, artificial
  Chemically synthesized
gguuccgaagaagaugcu

SEQ ID NO: 19452 - RNA, 18 nt, artificial
  Chemically synthesized
gcuccuaccgcugcgucu

SEQ ID NO: 19453 - RNA, 18 nt, artificial
  Chemically synthesized
cgaagaagaugcuccagc

SEQ ID NO: 19454 - RNA, 18 nt, artificial
  Chemically synthesized
cgucuaccuggagauuga

SEQ ID NO: 19455 - RNA, 18 nt, artificial
  Chemically synthesized
gucaucaauggcugcaaa

SEQ ID NO: 19456 - RNA, 18 nt, artificial
  Chemically synthesized
cgacguugccggguacaa

SEQ ID NO: 19457 - RNA, 18 nt, artificial
  Chemically synthesized
gccuggagacgggcaaca

SEQ ID NO: 19458 - RNA, 18 nt, artificial
  Chemically synthesized
cggaggcauccuacccuu

SEQ ID NO: 19459 - RNA, 18 nt, artificial
  Chemically synthesized
cggcuggccuuugagacu

SEQ ID NO: 19460 - RNA, 18 nt, artificial
  Chemically synthesized
gugacagccagugcaacu

SEQ ID NO: 19461 - RNA, 18 nt, artificial
  Chemically synthesized
gaacugcucugaggagau

SEQ ID NO: 19462 - RNA, 18 nt, artificial
  Chemically synthesized
gggacgaggaccuggaga

SEQ ID NO: 19463 - RNA, 18 nt, artificial
  Chemically synthesized
gaaccugcagccagcaaa

SEQ ID NO: 19464 - RNA, 18 nt, artificial
  Chemically synthesized
caauguggaugccgcagu

SEQ ID NO: 19465 - RNA, 18 nt, artificial
  Chemically synthesized
ucuacaugaggaacugua

SEQ ID NO: 19466 - RNA, 18 nt, artificial
  Chemically synthesized
ggcucuugugccacaucc

SEQ ID NO: 19467 - RNA, 18 nt, artificial
  Chemically synthesized
uccacugugagaacaaca

SEQ ID NO: 19468 - RNA, 18 nt, artificial
  Chemically synthesized
gcaacagcuccuuccacu

SEQ ID NO: 19469 - RNA, 18 nt, artificial
  Chemically synthesized
gagaccgccuugcaccug

SEQ ID NO: 19470 - RNA, 18 nt, artificial
  Chemically synthesized
gccugacugcacagagag

SEQ ID NO: 19471 - RNA, 18 nt, artificial
  Chemically synthesized
caugaaucuuuguuucag

SEQ ID NO: 19472 - RNA, 18 nt, artificial
  Chemically synthesized
gccagugcaacucagccg

SEQ ID NO: 19473 - RNA, 18 nt, artificial
  Chemically synthesized
gugugugcacggaagggu

SEQ ID NO: 19474 - RNA, 18 nt, artificial
  Chemically synthesized
ccuucgagugccaguguc

SEQ ID NO: 19475 - RNA, 18 nt, artificial
  Chemically synthesized
gcaccugcgaccugcuca

SEQ ID NO: 19476 - RNA, 18 nt, artificial
  Chemically synthesized
gguccgcaagcccagcag

SEQ ID NO: 19477 - RNA, 18 nt, artificial
  Chemically synthesized
gcuacaacugcgugugug

SEQ ID NO: 19478 - RNA, 18 nt, artificial
  Chemically synthesized
gcacaaggugucuuccag

SEQ ID NO: 19479 - RNA, 18 nt, artificial
  Chemically synthesized
cuccaacugcgacaccaa

SEQ ID NO: 19480 - RNA, 18 nt, artificial
  Chemically synthesized
cacccaguaccgcugcga

SEQ ID NO: 19481 - RNA, 18 nt, artificial
  Chemically synthesized
caugguaccaaucaugaa

SEQ ID NO: 19482 - RNA, 18 nt, artificial
  Chemically synthesized
gugagcccacauccgaga

SEQ ID NO: 19483 - RNA, 18 nt, artificial
  Chemically synthesized
ugagaaaacaagcaaguu

SEQ ID NO: 19484 - RNA, 18 nt, artificial
  Chemically synthesized
cccaacugccagaaccuu

SEQ ID NO: 19485 - RNA, 18 nt, artificial
  Chemically synthesized
gcuucaccggccagaacu

SEQ ID NO: 19486 - RNA, 18 nt, artificial
  Chemically synthesized
cccaguaccgcugcgagu

SEQ ID NO: 19487 - RNA, 18 nt, artificial
  Chemically synthesized
cccucaacuucaaugacc

SEQ ID NO: 19488 - RNA, 18 nt, artificial
  Chemically synthesized
gccacgugugagaaugac

SEQ ID NO: 19489 - RNA, 18 nt, artificial
  Chemically synthesized
ccaccaguuugaaugguc

SEQ ID NO: 19490 - RNA, 18 nt, artificial
  Chemically synthesized
gcgagaccgccuugcacc

SEQ ID NO: 19491 - RNA, 18 nt, artificial
  Chemically synthesized
gcauauggguuagauguu

SEQ ID NO: 19492 - RNA, 18 nt, artificial
  Chemically synthesized
ggagugggaccaacugug

SEQ ID NO: 19493 - RNA, 18 nt, artificial
  Chemically synthesized
ugguggugguggugcuga

SEQ ID NO: 19494 - RNA, 18 nt, artificial
  Chemically synthesized
guggaugagugcucgcug

SEQ ID NO: 19495 - RNA, 18 nt, artificial
  Chemically synthesized
cagacuuggcucagcucg

SEQ ID NO: 19496 - RNA, 18 nt, artificial
  Chemically synthesized
cccucaaccaccugccug

SEQ ID NO: 19497 - RNA, 18 nt, artificial
  Chemically synthesized
ccgcgaugcucccagccc

SEQ ID NO: 19498 - RNA, 18 nt, artificial
  Chemically synthesized
caacaaugagugugaauc

SEQ ID NO: 19499 - RNA, 18 nt, artificial
  Chemically synthesized
ccgcaugcaugauggcac

SEQ ID NO: 19500 - RNA, 18 nt, artificial
  Chemically synthesized
ugugacaucaacaacaau

SEQ ID NO: 19501 - RNA, 18 nt, artificial
  Chemically synthesized
cuucaagcgugacgcaca

SEQ ID NO: 19502 - RNA, 18 nt, artificial
  Chemically synthesized
ccagaugcgucccaagau

SEQ ID NO: 19503 - RNA, 18 nt, artificial
  Chemically synthesized
cucggaguguguaugcca

SEQ ID NO: 19504 - RNA, 18 nt, artificial
  Chemically synthesized
gaccaguacugcaaggac

SEQ ID NO: 19505 - RNA, 18 nt, artificial
  Chemically synthesized
cggcuacagugggcgcaa

SEQ ID NO: 19506 - RNA, 18 nt, artificial
  Chemically synthesized
ggccuuuacugcgacgug

SEQ ID NO: 19507 - RNA, 18 nt, artificial
  Chemically synthesized
ugcuggaaguacuucagu

SEQ ID NO: 19508 - RNA, 18 nt, artificial
  Chemically synthesized
guacgauguggacgagug

SEQ ID NO: 19509 - RNA, 18 nt, artificial
  Chemically synthesized
cacgcugacggaguacaa

SEQ ID NO: 19510 - RNA, 18 nt, artificial
  Chemically synthesized
cccaagugcuuuaacaac

SEQ ID NO: 19511 - RNA, 18 nt, artificial
  Chemically synthesized
ccgugggcugcguccuuu

SEQ ID NO: 19512 - RNA, 18 nt, artificial
  Chemically synthesized
cguguauugacgacguug

SEQ ID NO: 19513 - RNA, 18 nt, artificial
  Chemically synthesized
cccaacacuuacaccugu

SEQ ID NO: 19514 - RNA, 18 nt, artificial
  Chemically synthesized
cugagaaaacaagcaagu

SEQ ID NO: 19515 - RNA, 18 nt, artificial
  Chemically synthesized
gcuggaccacuuugccaa

SEQ ID NO: 19516 - RNA, 18 nt, artificial
  Chemically synthesized
uggaaguacuucagugac

SEQ ID NO: 19517 - RNA, 18 nt, artificial
  Chemically synthesized
aggacuaugagagcuucu

SEQ ID NO: 19518 - RNA, 18 nt, artificial
  Chemically synthesized
aggucugcagccugcagu

SEQ ID NO: 19519 - RNA, 18 nt, artificial
  Chemically synthesized
gcauggacgucaaugucc

SEQ ID NO: 19520 - RNA, 18 nt, artificial
  Chemically synthesized
ggugcugcuggaccacuu

SEQ ID NO: 19521 - RNA, 18 nt, artificial
  Chemically synthesized
cgcacgcggauuaauuug

SEQ ID NO: 19522 - RNA, 18 nt, artificial
  Chemically synthesized
ggagugcaggcaauccga

SEQ ID NO: 19523 - RNA, 18 nt, artificial
  Chemically synthesized
ggcuggcaagggcagacc

SEQ ID NO: 19524 - RNA, 18 nt, artificial
  Chemically synthesized
gccaccucaacgacgcau

SEQ ID NO: 19525 - RNA, 18 nt, artificial
  Chemically synthesized
agaccaagaaguuccggu

SEQ ID NO: 19526 - RNA, 18 nt, artificial
  Chemically synthesized
agaccgacaucgacgacu

SEQ ID NO: 19527 - RNA, 18 nt, artificial
  Chemically synthesized
agggcaagaagguccgca

SEQ ID NO: 19528 - RNA, 18 nt, artificial
  Chemically synthesized
gcuggaaguacuucagug

SEQ ID NO: 19529 - RNA, 18 nt, artificial
  Chemically synthesized
cgacaaccagaaugagug

SEQ ID NO: 19530 - RNA, 18 nt, artificial
  Chemically synthesized
ggcuaacaaagauaugca

SEQ ID NO: 19531 - RNA, 18 nt, artificial
  Chemically synthesized
ugaccaguggcuacgugu

SEQ ID NO: 19532 - RNA, 18 nt, artificial
  Chemically synthesized
cgagccacagaccuggau

SEQ ID NO: 19533 - RNA, 18 nt, artificial
  Chemically synthesized
caaggugucuuccagauc

SEQ ID NO: 19534 - RNA, 18 nt, artificial
  Chemically synthesized
agcaggugcagccacaaa

SEQ ID NO: 19535 - RNA, 18 nt, artificial
  Chemically synthesized
ggguacaagugcaacugc

SEQ ID NO: 19536 - RNA, 18 nt, artificial
  Chemically synthesized
cgaugucaaugagugcga

SEQ ID NO: 19537 - RNA, 18 nt, artificial
  Chemically synthesized
uguucucggaguguguau

SEQ ID NO: 19538 - RNA, 18 nt, artificial
  Chemically synthesized
gccaccacugcgagacca

SEQ ID NO: 19539 - RNA, 18 nt, artificial
  Chemically synthesized
cccugagggcuucaaagu

SEQ ID NO: 19540 - RNA, 18 nt, artificial
  Chemically synthesized
ggccuuugagacuggccc

SEQ ID NO: 19541 - RNA, 18 nt, artificial
  Chemically synthesized
agugaucuacaugaggaa

SEQ ID NO: 19542 - RNA, 18 nt, artificial
  Chemically synthesized
ccgugaacaauguggaug

SEQ ID NO: 19543 - RNA, 18 nt, artificial
  Chemically synthesized
accacugcgagaccaaca

SEQ ID NO: 19544 - RNA, 18 nt, artificial
  Chemically synthesized
agaucgauggcuacgagu

SEQ ID NO: 19545 - RNA, 18 nt, artificial
  Chemically synthesized
gggugugcacugcgaggu

SEQ ID NO: 19546 - RNA, 18 nt, artificial
  Chemically synthesized
gcacaguagccuugcugc

SEQ ID NO: 19547 - RNA, 18 nt, artificial
  Chemically synthesized
ccacugugacagccagug

SEQ ID NO: 19548 - RNA, 18 nt, artificial
  Chemically synthesized
cgaugagugugcgggcaa

SEQ ID NO: 19549 - RNA, 18 nt, artificial
  Chemically synthesized
guaggagacuugccagag

SEQ ID NO: 19550 - RNA, 18 nt, artificial
  Chemically synthesized
guacgaccaguacugcaa

SEQ ID NO: 19551 - RNA, 18 nt, artificial
  Chemically synthesized
cgcaagcccagcagcaaa

SEQ ID NO: 19552 - RNA, 18 nt, artificial
  Chemically synthesized
gcuacgagggugugcacu

SEQ ID NO: 19553 - RNA, 18 nt, artificial
  Chemically synthesized
gggcaucgggcaccugaa

SEQ ID NO: 19554 - RNA, 18 nt, artificial
  Chemically synthesized
ccugagggcuucaaagug

SEQ ID NO: 19555 - RNA, 18 nt, artificial
  Chemically synthesized
ccaaaugccugccagaac

SEQ ID NO: 19556 - RNA, 18 nt, artificial
  Chemically synthesized
ugugugucaugccaguga

SEQ ID NO: 19557 - RNA, 18 nt, artificial
  Chemically synthesized
cauguguaacaucaacau

SEQ ID NO: 19558 - RNA, 18 nt, artificial
  Chemically synthesized
ccguguggccuccuucua

SEQ ID NO: 19559 - RNA, 18 nt, artificial
  Chemically synthesized
ccaacugccagaaccuug

SEQ ID NO: 19560 - RNA, 18 nt, artificial
  Chemically synthesized
augucaaacaugagaugu

SEQ ID NO: 19561 - RNA, 18 nt, artificial
  Chemically synthesized
ccgaggacuaugagagcu

SEQ ID NO: 19562 - RNA, 18 nt, artificial
  Chemically synthesized
acaccaacguggucuuca

SEQ ID NO: 19563 - RNA, 18 nt, artificial
  Chemically synthesized
gaccugugaggucgacau

SEQ ID NO: 19564 - RNA, 18 nt, artificial
  Chemically synthesized
gccggguacaagugcaac

SEQ ID NO: 19565 - RNA, 18 nt, artificial
  Chemically synthesized
gaauuucacugugggcgg

SEQ ID NO: 19566 - RNA, 18 nt, artificial
  Chemically synthesized
ggcggcaaaugcuggcag

SEQ ID NO: 19567 - RNA, 18 nt, artificial
  Chemically synthesized
aguugugcuccugaagaa

SEQ ID NO: 19568 - RNA, 18 nt, artificial
  Chemically synthesized
caacgagugugcguccaa

SEQ ID NO: 19569 - RNA, 18 nt, artificial
  Chemically synthesized
ccaggguuuuccuacgua

SEQ ID NO: 19570 - RNA, 18 nt, artificial
  Chemically synthesized
caaggaccacuucagcga

SEQ ID NO: 19571 - RNA, 18 nt, artificial
  Chemically synthesized
cggaggccuucaaguaaa

SEQ ID NO: 19572 - RNA, 18 nt, artificial
  Chemically synthesized
ggguacaagugcgacugu

SEQ ID NO: 19573 - RNA, 18 nt, artificial
  Chemically synthesized
gaggaacuguagaugaug

SEQ ID NO: 19574 - RNA, 18 nt, artificial
  Chemically synthesized
caucugugccaguacgau

SEQ ID NO: 19575 - RNA, 18 nt, artificial
  Chemically synthesized
gguaccaaucaugaaucu

SEQ ID NO: 19576 - RNA, 18 nt, artificial
  Chemically synthesized
ccuggaugccgcugaccu

SEQ ID NO: 19577 - RNA, 18 nt, artificial
  Chemically synthesized
gcaagaacgccgggacau

SEQ ID NO: 19578 - RNA, 18 nt, artificial
  Chemically synthesized
gcaccugcaaagacauga

SEQ ID NO: 19579 - RNA, 18 nt, artificial
  Chemically synthesized
gucaaugagugcaacagc

SEQ ID NO: 19580 - RNA, 18 nt, artificial
  Chemically synthesized
gcuggcaagggcagaccu

SEQ ID NO: 19581 - RNA, 18 nt, artificial
  Chemically synthesized
ggacaaugccugccucac

SEQ ID NO: 19582 - RNA, 18 nt, artificial
  Chemically synthesized
accaguuugaauggucaa

SEQ ID NO: 19583 - RNA, 18 nt, artificial
  Chemically synthesized
accucagccugcacagug

SEQ ID NO: 19584 - RNA, 18 nt, artificial
  Chemically synthesized
ggcuuugccgccacggag

SEQ ID NO: 19585 - RNA, 18 nt, artificial
  Chemically synthesized
caccaacguggucuucaa

SEQ ID NO: 19586 - RNA, 18 nt, artificial
  Chemically synthesized
cccugaauuucacugugg

SEQ ID NO: 19587 - RNA, 18 nt, artificial
  Chemically synthesized
cuugugaaaauguguucu

SEQ ID NO: 19588 - RNA, 18 nt, artificial
  Chemically synthesized
gugaccgcagcccaguuc

SEQ ID NO: 19589 - RNA, 18 nt, artificial
  Chemically synthesized
gcccguggcacccagaac

SEQ ID NO: 19590 - RNA, 18 nt, artificial
  Chemically synthesized
ggcgugcagggcaagaag

SEQ ID NO: 19591 - RNA, 18 nt, artificial
  Chemically synthesized
ccgcugcacaguagccuu

SEQ ID NO: 19592 - RNA, 18 nt, artificial
  Chemically synthesized
ccgacugcauggacguca

SEQ ID NO: 19593 - RNA, 18 nt, artificial
  Chemically synthesized
gguucugccugaccugga

SEQ ID NO: 19594 - RNA, 18 nt, artificial
  Chemically synthesized
ugucugaggucaaugagu

SEQ ID NO: 19595 - RNA, 18 nt, artificial
  Chemically synthesized
guguaugccaagagugca

SEQ ID NO: 19596 - RNA, 18 nt, artificial
  Chemically synthesized
agggugugcacugugaga

SEQ ID NO: 19597 - RNA, 18 nt, artificial
  Chemically synthesized
gccugaccuggacgacca

SEQ ID NO: 19598 - RNA, 18 nt, artificial
  Chemically synthesized
cugaauggcgggaagugu

SEQ ID NO: 19599 - RNA, 18 nt, artificial
  Chemically synthesized
aauaccaaguauagccua

SEQ ID NO: 19600 - RNA, 18 nt, artificial
  Chemically synthesized
gcuccuucgagugccagu

SEQ ID NO: 19601 - RNA, 18 nt, artificial
  Chemically synthesized
aaaugauguuggagaagg

SEQ ID NO: 19602 - RNA, 18 nt, artificial
  Chemically synthesized
gccgagccaggcagacgu

SEQ ID NO: 19603 - RNA, 18 nt, artificial
  Chemically synthesized
ccucaacgacgcaugcau

SEQ ID NO: 19604 - RNA, 18 nt, artificial
  Chemically synthesized
aguguguaugccaagagu

SEQ ID NO: 19605 - RNA, 18 nt, artificial
  Chemically synthesized
gccgcaccuuggcgugag

SEQ ID NO: 19606 - RNA, 18 nt, artificial
  Chemically synthesized
gggcuacacagggagcau

SEQ ID NO: 19607 - RNA, 18 nt, artificial
  Chemically synthesized
gugagaacaacacgccug

SEQ ID NO: 19608 - RNA, 18 nt, artificial
  Chemically synthesized
gcagcagcaaagccugca

SEQ ID NO: 19609 - RNA, 18 nt, artificial
  Chemically synthesized
ggagacgggcaacagcga

SEQ ID NO: 19610 - RNA, 18 nt, artificial
  Chemically synthesized
ccagauccugauccggaa

SEQ ID NO: 19611 - RNA, 18 nt, artificial
  Chemically synthesized
aguggacaggucaguacu

SEQ ID NO: 19612 - RNA, 18 nt, artificial
  Chemically synthesized
cucgcugggcagccucaa

SEQ ID NO: 19613 - RNA, 18 nt, artificial
  Chemically synthesized
gaggcguggcagacuaug

SEQ ID NO: 19614 - RNA, 18 nt, artificial
  Chemically synthesized
gcugggcagccucaacau

SEQ ID NO: 19615 - RNA, 18 nt, artificial
  Chemically synthesized
gugcagagugagaccgug

SEQ ID NO: 19616 - RNA, 18 nt, artificial
  Chemically synthesized
gggcuuugccgccacgga

SEQ ID NO: 19617 - RNA, 18 nt, artificial
  Chemically synthesized
cggcgugcagggcaagaa

SEQ ID NO: 19618 - RNA, 18 nt, artificial
  Chemically synthesized
cacugcgagaccaacauc

SEQ ID NO: 19619 - RNA, 18 nt, artificial
  Chemically synthesized
acgccuaccucugcuucu

SEQ ID NO: 19620 - RNA, 18 nt, artificial
  Chemically synthesized
cugaagaacgcuucagac

SEQ ID NO: 19621 - RNA, 18 nt, artificial
  Chemically synthesized
uggcaagggcagaccugu

SEQ ID NO: 19622 - RNA, 18 nt, artificial
  Chemically synthesized
gaguggagagccgagcca

SEQ ID NO: 19623 - RNA, 18 nt, artificial
  Chemically synthesized
gcagcccaguuccugacg

SEQ ID NO: 19624 - RNA, 18 nt, artificial
  Chemically synthesized
gagaagggaaguugaacg

SEQ ID NO: 19625 - RNA, 18 nt, artificial
  Chemically synthesized
ggcuacagcugcaccugc

SEQ ID NO: 19626 - RNA, 18 nt, artificial
  Chemically synthesized
cuuccagagugccaccga

SEQ ID NO: 19627 - RNA, 18 nt, artificial
  Chemically synthesized
cugugacagccagugcaa

SEQ ID NO: 19628 - RNA, 18 nt, artificial
  Chemically synthesized
gagcccacauccgagagc

SEQ ID NO: 19629 - RNA, 18 nt, artificial
  Chemically synthesized
ggacgucaauguccgcgg

SEQ ID NO: 19630 - RNA, 18 nt, artificial
  Chemically synthesized
gacaucaacaacaaugag

SEQ ID NO: 19631 - RNA, 18 nt, artificial
  Chemically synthesized
gcucccugguggcagcga

SEQ ID NO: 19632 - RNA, 18 nt, artificial
  Chemically synthesized
gacuaugccugcagcugu

SEQ ID NO: 19633 - RNA, 18 nt, artificial
  Chemically synthesized
ggccuguggaagcaagga

SEQ ID NO: 19634 - RNA, 18 nt, artificial
  Chemically synthesized
gccugugccagcauggag

SEQ ID NO: 19635 - RNA, 18 nt, artificial
  Chemically synthesized
cgcucaugaucgccuccu

SEQ ID NO: 19636 - RNA, 18 nt, artificial
  Chemically synthesized
gaacugugaggaaaauau

SEQ ID NO: 19637 - RNA, 18 nt, artificial
  Chemically synthesized
ugcagcgagaacauugau

SEQ ID NO: 19638 - RNA, 18 nt, artificial
  Chemically synthesized
cugugaggucgacaucaa

SEQ ID NO: 19639 - RNA, 18 nt, artificial
  Chemically synthesized
gugagggacgucagacuu

SEQ ID NO: 19640 - RNA, 18 nt, artificial
  Chemically synthesized
gagaccaagaaguuccgg

SEQ ID NO: 19641 - RNA, 18 nt, artificial
  Chemically synthesized
ggacgacaaccagaauga

SEQ ID NO: 19642 - RNA, 18 nt, artificial
  Chemically synthesized
ggcacauugagcugugca

SEQ ID NO: 19643 - RNA, 18 nt, artificial
  Chemically synthesized
acccaugguaccaaucau

SEQ ID NO: 19644 - RNA, 18 nt, artificial
  Chemically synthesized
caaagauaugcagaacaa

SEQ ID NO: 19645 - RNA, 18 nt, artificial
  Chemically synthesized
gcgagaucgacgucaacg

SEQ ID NO: 19646 - RNA, 18 nt, artificial
  Chemically synthesized
uccuucuacugcgagugu

SEQ ID NO: 19647 - RNA, 18 nt, artificial
  Chemically synthesized
gggcgagaccgccuugca

SEQ ID NO: 19648 - RNA, 18 nt, artificial
  Chemically synthesized
ccaacguggucuucaagc

SEQ ID NO: 19649 - RNA, 18 nt, artificial
  Chemically synthesized
ggaggacaucaacgagug

SEQ ID NO: 19650 - RNA, 18 nt, artificial
  Chemically synthesized
gccaaaugccugccagaa

SEQ ID NO: 19651 - RNA, 18 nt, artificial
  Chemically synthesized
uucugagaaaacaagcaa

SEQ ID NO: 19652 - RNA, 18 nt, artificial
  Chemically synthesized
gcacugugagaucaacgu

SEQ ID NO: 19653 - RNA, 18 nt, artificial
  Chemically synthesized
gaugagugcucgcugggu

SEQ ID NO: 19654 - RNA, 18 nt, artificial
  Chemically synthesized
cggagcauguacccgaga

SEQ ID NO: 19655 - RNA, 18 nt, artificial
  Chemically synthesized
ggacugcguggacagcua

SEQ ID NO: 19656 - RNA, 18 nt, artificial
  Chemically synthesized
gggugaacugcucugagg

SEQ ID NO: 19657 - RNA, 18 nt, artificial
  Chemically synthesized
cuccuucuacugcgagug

SEQ ID NO: 19658 - RNA, 18 nt, artificial
  Chemically synthesized
gggcaugaccagaugcgu

SEQ ID NO: 19659 - RNA, 18 nt, artificial
  Chemically synthesized
gggccaccacugcgagac

SEQ ID NO: 19660 - RNA, 18 nt, artificial
  Chemically synthesized
agugcaacaaccacgcgu

SEQ ID NO: 19661 - RNA, 18 nt, artificial
  Chemically synthesized
agaacaacacgccugacu

SEQ ID NO: 19662 - RNA, 18 nt, artificial
  Chemically synthesized
gaucgauggcuacgagug

SEQ ID NO: 19663 - RNA, 18 nt, artificial
  Chemically synthesized
gucaaugagugcgacuca

SEQ ID NO: 19664 - RNA, 18 nt, artificial
  Chemically synthesized
guccuuugguccuguccc

SEQ ID NO: 19665 - RNA, 18 nt, artificial
  Chemically synthesized
guggcuacgugugcaccu

SEQ ID NO: 19666 - RNA, 18 nt, artificial
  Chemically synthesized
cgacgcacaaggugucuu

SEQ ID NO: 19667 - RNA, 18 nt, artificial
  Chemically synthesized
cugacggaguacaagugc

SEQ ID NO: 19668 - RNA, 18 nt, artificial
  Chemically synthesized
gcacgcagucucugcagu

SEQ ID NO: 19669 - RNA, 18 nt, artificial
  Chemically synthesized
ggcgggaagugugaagcg

SEQ ID NO: 19670 - RNA, 18 nt, artificial
  Chemically synthesized
aguacaaccuggugcgca

SEQ ID NO: 19671 - RNA, 18 nt, artificial
  Chemically synthesized
ggagggcagcuacgagac

SEQ ID NO: 19672 - RNA, 18 nt, artificial
  Chemically synthesized
gcagcuacgagaccgcca

SEQ ID NO: 19673 - RNA, 18 nt, artificial
  Chemically synthesized
agcaugcagucccagauc

SEQ ID NO: 19674 - RNA, 18 nt, artificial
  Chemically synthesized
gauuuuugcaauaccaag

SEQ ID NO: 19675 - RNA, 18 nt, artificial
  Chemically synthesized
ggagacuugccagagccg

SEQ ID NO: 19676 - RNA, 18 nt, artificial
  Chemically synthesized
aggaagaagucccaggac

SEQ ID NO: 19677 - RNA, 18 nt, artificial
  Chemically synthesized
gccgcgugcugcacacca

SEQ ID NO: 19678 - RNA, 18 nt, artificial
  Chemically synthesized
ucagguucaguauuaugu

SEQ ID NO: 19679 - RNA, 18 nt, artificial
  Chemically synthesized
guuccagugcaucugcau

SEQ ID NO: 19680 - RNA, 18 nt, artificial
  Chemically synthesized
caaguauagccuauggca

SEQ ID NO: 19681 - RNA, 18 nt, artificial
  Chemically synthesized
cacgugugagaaugacgc

SEQ ID NO: 19682 - RNA, 18 nt, artificial
  Chemically synthesized
ccaccgacguggccgcau

SEQ ID NO: 19683 - RNA, 18 nt, artificial
  Chemically synthesized
cccuggguggagugggac

SEQ ID NO: 19684 - RNA, 18 nt, artificial
  Chemically synthesized
cuauucugagaaaacaag

SEQ ID NO: 19685 - RNA, 18 nt, artificial
  Chemically synthesized
cuacgagugugccuguga

SEQ ID NO: 19686 - RNA, 18 nt, artificial
  Chemically synthesized
gguacaagugcgacugug

SEQ ID NO: 19687 - RNA, 18 nt, artificial
  Chemically synthesized
gucccagaugaugagcua

SEQ ID NO: 19688 - RNA, 18 nt, artificial
  Chemically synthesized
ccgacuucaucuaccagg

SEQ ID NO: 19689 - RNA, 18 nt, artificial
  Chemically synthesized
ggcaagaagguccgcaag

SEQ ID NO: 19690 - RNA, 18 nt, artificial
  Chemically synthesized
gcagcaaaggccuggccu

SEQ ID NO: 19691 - RNA, 18 nt, artificial
  Chemically synthesized
guaggaugaaaagauucu

SEQ ID NO: 19692 - RNA, 18 nt, artificial
  Chemically synthesized
gcgaguccgucaucaaug

SEQ ID NO: 19693 - RNA, 18 nt, artificial
  Chemically synthesized
gugacaucaacaacaaug

SEQ ID NO: 19694 - RNA, 18 nt, artificial
  Chemically synthesized
gugcagccacaaaacuua

SEQ ID NO: 19695 - RNA, 18 nt, artificial
  Chemically synthesized
cacagagagcuccugcuu

SEQ ID NO: 19696 - RNA, 18 nt, artificial
  Chemically synthesized
caucacggaucauaugga

SEQ ID NO: 19697 - RNA, 18 nt, artificial
  Chemically synthesized
ccagugagggacgucaga

SEQ ID NO: 19698 - RNA, 18 nt, artificial
  Chemically synthesized
ugccaagagugcacccau

SEQ ID NO: 19699 - RNA, 18 nt, artificial
  Chemically synthesized
gcgcgucaaugacuucca

SEQ ID NO: 19700 - RNA, 18 nt, artificial
  Chemically synthesized
ccuggugcagacccagca

SEQ ID NO: 19701 - RNA, 18 nt, artificial
  Chemically synthesized
gccuuuacugcgacgugc

SEQ ID NO: 19702 - RNA, 18 nt, artificial
  Chemically synthesized
caugauggcacgacgcca

SEQ ID NO: 19703 - RNA, 18 nt, artificial
  Chemically synthesized
ggcaauccgaggacuaug

SEQ ID NO: 19704 - RNA, 18 nt, artificial
  Chemically synthesized
gccuuugugcuucuguuc

SEQ ID NO: 19705 - RNA, 18 nt, artificial
  Chemically synthesized
aguucuuggucccuccag

SEQ ID NO: 19706 - RNA, 18 nt, artificial
  Chemically synthesized
cagcaugcagucccagau

SEQ ID NO: 19707 - RNA, 18 nt, artificial
  Chemically synthesized
ggcuacacagggagcaug

SEQ ID NO: 19708 - RNA, 18 nt, artificial
  Chemically synthesized
caacugcgagaccgacau

SEQ ID NO: 19709 - RNA, 18 nt, artificial
  Chemically synthesized
gggcgucugugugcgcuc

SEQ ID NO: 19710 - RNA, 18 nt, artificial
  Chemically synthesized
caguagccuugcugccag

SEQ ID NO: 19711 - RNA, 18 nt, artificial
  Chemically synthesized
agauguugccauguguuu

SEQ ID NO: 19712 - RNA, 18 nt, artificial
  Chemically synthesized
gccagcaagaagaagcgg

SEQ ID NO: 19713 - RNA, 18 nt, artificial
  Chemically synthesized
cccugaagaacgcuucag

SEQ ID NO: 19714 - RNA, 18 nt, artificial
  Chemically synthesized
gggagggcagcuacgaga

SEQ ID NO: 19715 - RNA, 18 nt, artificial
  Chemically synthesized
caacguggacgacugcaa

SEQ ID NO: 19716 - RNA, 18 nt, artificial
  Chemically synthesized
ccaccacagccgcaccuu

SEQ ID NO: 19717 - RNA, 18 nt, artificial
  Chemically synthesized
gggcaagugcaucaacac

SEQ ID NO: 19718 - RNA, 18 nt, artificial
  Chemically synthesized
ggugcugcugucccgcaa

SEQ ID NO: 19719 - RNA, 18 nt, artificial
  Chemically synthesized
gccuccucgcagugcuuc

SEQ ID NO: 19720 - RNA, 18 nt, artificial
  Chemically synthesized
ccgcagcccaguuccuga

SEQ ID NO: 19721 - RNA, 18 nt, artificial
  Chemically synthesized
guguguaugccaagagug

SEQ ID NO: 19722 - RNA, 18 nt, artificial
  Chemically synthesized
gcgugcggaaggccagug

SEQ ID NO: 19723 - RNA, 18 nt, artificial
  Chemically synthesized
guggagugggaccaacug

SEQ ID NO: 19724 - RNA, 18 nt, artificial
  Chemically synthesized
ccagaccaacaucaacga

SEQ ID NO: 19725 - RNA, 18 nt, artificial
  Chemically synthesized
auguguucucggagugug

SEQ ID NO: 19726 - RNA, 18 nt, artificial
  Chemically synthesized
gcgaccugcucacgcuga

SEQ ID NO: 19727 - RNA, 18 nt, artificial
  Chemically synthesized
ggccgucaucuccgacuu

SEQ ID NO: 19728 - RNA, 18 nt, artificial
  Chemically synthesized
ugcggaaggccagugcaa

SEQ ID NO: 19729 - RNA, 18 nt, artificial
  Chemically synthesized
gagccacagaccuggaug

SEQ ID NO: 19730 - RNA, 18 nt, artificial
  Chemically synthesized
ccagcaccguccugggcu

SEQ ID NO: 19731 - RNA, 18 nt, artificial
  Chemically synthesized
ggcaagugcaucaacacg

SEQ ID NO: 19732 - RNA, 18 nt, artificial
  Chemically synthesized
gccagaguggacagguca

SEQ ID NO: 19733 - RNA, 18 nt, artificial
  Chemically synthesized
agacgagugugccagcag

SEQ ID NO: 19734 - RNA, 18 nt, artificial
  Chemically synthesized
gaaccagggcacguguau

SEQ ID NO: 19735 - RNA, 18 nt, artificial
  Chemically synthesized
agccgagccaggcagacg

SEQ ID NO: 19736 - RNA, 18 nt, artificial
  Chemically synthesized
ggcuucaccggccagaac

SEQ ID NO: 19737 - RNA, 18 nt, artificial
  Chemically synthesized
ggacuggugaggacugca

SEQ ID NO: 19738 - RNA, 18 nt, artificial
  Chemically synthesized
aggucaguacuguaccga

SEQ ID NO: 19739 - RNA, 18 nt, artificial
  Chemically synthesized
ccagcagucuccguccgu

SEQ ID NO: 19740 - RNA, 18 nt, artificial
  Chemically synthesized
gacgacaaccagaaugag

SEQ ID NO: 19741 - RNA, 18 nt, artificial
  Chemically synthesized
acaucaacgagugugcgu

SEQ ID NO: 19742 - RNA, 18 nt, artificial
  Chemically synthesized
cuacgagaccgccaaggu

SEQ ID NO: 19743 - RNA, 18 nt, artificial
  Chemically synthesized
cugcuggacgaguacaac

SEQ ID NO: 19744 - RNA, 18 nt, artificial
  Chemically synthesized
cgcugggcuccuucgagu

SEQ ID NO: 19745 - RNA, 18 nt, artificial
  Chemically synthesized
ggcagcauggccagcucu

SEQ ID NO: 19746 - RNA, 18 nt, artificial
  Chemically synthesized
ccugcacuccucagggca

SEQ ID NO: 19747 - RNA, 18 nt, artificial
  Chemically synthesized
ggaaccgagccacagacc

SEQ ID NO: 19748 - RNA, 18 nt, artificial
  Chemically synthesized
gagagcuucuccuguguc

SEQ ID NO: 19749 - RNA, 18 nt, artificial
  Chemically synthesized
cgucagacuuggcucagc

SEQ ID NO: 19750 - RNA, 18 nt, artificial
  Chemically synthesized
caagggcagaccugugag

SEQ ID NO: 19751 - RNA, 18 nt, artificial
  Chemically synthesized
agugaaagcauauggguu

SEQ ID NO: 19752 - RNA, 18 nt, artificial
  Chemically synthesized
gcgggagcucagccgcgu

SEQ ID NO: 19753 - RNA, 18 nt, artificial
  Chemically synthesized
gcccaacccgugucacaa

SEQ ID NO: 19754 - RNA, 18 nt, artificial
  Chemically synthesized
gugcggaaggccagugca

SEQ ID NO: 19755 - RNA, 18 nt, artificial
  Chemically synthesized
gugccaguacgaugugga

SEQ ID NO: 19756 - RNA, 18 nt, artificial
  Chemically synthesized
gcuucaaagugucugagg

SEQ ID NO: 19757 - RNA, 18 nt, artificial
  Chemically synthesized
aggucaaugagugcaaca

SEQ ID NO: 19758 - RNA, 18 nt, artificial
  Chemically synthesized
ggcagacgugcagccacu

SEQ ID NO: 19759 - RNA, 18 nt, artificial
  Chemically synthesized
gcccaguuccugacgccc

SEQ ID NO: 19760 - RNA, 18 nt, artificial
  Chemically synthesized
gggaccugugagcccaca

SEQ ID NO: 19761 - RNA, 18 nt, artificial
  Chemically synthesized
caacaaggucugcagccu

SEQ ID NO: 19762 - RNA, 18 nt, artificial
  Chemically synthesized
cgucaucaauggcugcaa

SEQ ID NO: 19763 - RNA, 18 nt, artificial
  Chemically synthesized
cgucccaagauguugauu

SEQ ID NO: 19764 - RNA, 18 nt, artificial
  Chemically synthesized
gcaucaacacggccuucu

SEQ ID NO: 19765 - RNA, 18 nt, artificial
  Chemically synthesized
ccuacaagaucgaggccg

SEQ ID NO: 19766 - RNA, 18 nt, artificial
  Chemically synthesized
cccucgcccugccagaac

SEQ ID NO: 19767 - RNA, 18 nt, artificial
  Chemically synthesized
ccggaaccgagccacaga

SEQ ID NO: 19768 - RNA, 18 nt, artificial
  Chemically synthesized
gcgccagccugcacaacc

SEQ ID NO: 19769 - RNA, 18 nt, artificial
  Chemically synthesized
cggugacugcucccucaa

SEQ ID NO: 19770 - RNA, 18 nt, artificial
  Chemically synthesized
ccuggccuguggaagcaa

SEQ ID NO: 19771 - RNA, 18 nt, artificial
  Chemically synthesized
ggcugcggcuccuacagg

SEQ ID NO: 19772 - RNA, 18 nt, artificial
  Chemically synthesized
cuuugugcuucuguucuu

SEQ ID NO: 19773 - RNA, 18 nt, artificial
  Chemically synthesized
cacccagccucaccuggu

SEQ ID NO: 19774 - RNA, 18 nt, artificial
  Chemically synthesized
cgccacgugugagaauga

SEQ ID NO: 19775 - RNA, 18 nt, artificial
  Chemically synthesized
ggaccaggugggcggcua

SEQ ID NO: 19776 - RNA, 18 nt, artificial
  Chemically synthesized
gcaccuggaugccgcuga

SEQ ID NO: 19777 - RNA, 18 nt, artificial
  Chemically synthesized
gaguguggccagaagccc

SEQ ID NO: 19778 - RNA, 18 nt, artificial
  Chemically synthesized
cuuaaugaaugagucugu

SEQ ID NO: 19779 - RNA, 18 nt, artificial
  Chemically synthesized
accugugugugcacggaa

SEQ ID NO: 19780 - RNA, 18 nt, artificial
  Chemically synthesized
cccaacaccuacaagugc

SEQ ID NO: 19781 - RNA, 18 nt, artificial
  Chemically synthesized
gccaguacgauguggacg

SEQ ID NO: 19782 - RNA, 18 nt, artificial
  Chemically synthesized
ccggcaguggacucagca

SEQ ID NO: 19783 - RNA, 18 nt, artificial
  Chemically synthesized
ggcagcuacugugaggac

SEQ ID NO: 19784 - RNA, 18 nt, artificial
  Chemically synthesized
ugagaacaacacgccuga

SEQ ID NO: 19785 - RNA, 18 nt, artificial
  Chemically synthesized
accuggagauugacaacc

SEQ ID NO: 19786 - RNA, 18 nt, artificial
  Chemically synthesized
gggcuucacugggcaucu

SEQ ID NO: 19787 - RNA, 18 nt, artificial
  Chemically synthesized
ccugcgaccugcucacgc

SEQ ID NO: 19788 - RNA, 18 nt, artificial
  Chemically synthesized
ccagggcacguguauuga

SEQ ID NO: 19789 - RNA, 18 nt, artificial
  Chemically synthesized
gggccaacugcacggacu

SEQ ID NO: 19790 - RNA, 18 nt, artificial
  Chemically synthesized
ccuugugcacugguguga

SEQ ID NO: 19791 - RNA, 18 nt, artificial
  Chemically synthesized
gcuggacuggugaggacu

SEQ ID NO: 19792 - RNA, 18 nt, artificial
  Chemically synthesized
guaggagacuugccagag

SEQ ID NO: 19793 - RNA, 18 nt, artificial
  Chemically synthesized
cgggcuggacugugcgga

SEQ ID NO: 19794 - RNA, 18 nt, artificial
  Chemically synthesized
gugugaauccaacccuug

SEQ ID NO: 19795 - RNA, 18 nt, artificial
  Chemically synthesized
cggaggaagaagucccag

SEQ ID NO: 19796 - RNA, 18 nt, artificial
  Chemically synthesized
cugucuggacaagaucga

SEQ ID NO: 19797 - RNA, 18 nt, artificial
  Chemically synthesized
aggaaacaacugcaagaa

SEQ ID NO: 19798 - RNA, 18 nt, artificial
  Chemically synthesized
ggugcagacccagcaggu

SEQ ID NO: 19799 - RNA, 18 nt, artificial
  Chemically synthesized
cgcacugcgagguggaca

SEQ ID NO: 19800 - RNA, 18 nt, artificial
  Chemically synthesized
agacgagugugccagcag

SEQ ID NO: 19801 - RNA, 18 nt, artificial
  Chemically synthesized
cagggagcauguguaaca

SEQ ID NO: 19802 - RNA, 18 nt, artificial
  Chemically synthesized
agaagguccgcaagccca

SEQ ID NO: 19803 - RNA, 18 nt, artificial
  Chemically synthesized
ggcuaccugucagacgug

SEQ ID NO: 19804 - RNA, 18 nt, artificial
  Chemically synthesized
gaccagugguccagcucg

SEQ ID NO: 19805 - RNA, 18 nt, artificial
  Chemically synthesized
agaaaugauguuggagaa

SEQ ID NO: 19806 - RNA, 18 nt, artificial
  Chemically synthesized
guccaacccaugucugaa

SEQ ID NO: 19807 - RNA, 18 nt, artificial
  Chemically synthesized
auaccaaguauagccuau

SEQ ID NO: 19808 - RNA, 18 nt, artificial
  Chemically synthesized
gccugaauggcgggaagu

SEQ ID NO: 19809 - RNA, 18 nt, artificial
  Chemically synthesized
ccacgagugugccugccu

SEQ ID NO: 19810 - RNA, 18 nt, artificial
  Chemically synthesized
cgugcagggcaagaaggu

SEQ ID NO: 19811 - RNA, 18 nt, artificial
  Chemically synthesized
gccagaagcccgggcuuu

SEQ ID NO: 19812 - RNA, 18 nt, artificial
  Chemically synthesized
gaucaaugaguuccagug

SEQ ID NO: 19813 - RNA, 18 nt, artificial
  Chemically synthesized
gugagaaugacgcucgua

SEQ ID NO: 19814 - RNA, 18 nt, artificial
  Chemically synthesized
guucucggaguguguaug

SEQ ID NO: 19815 - RNA, 18 nt, artificial
  Chemically synthesized
gacguugccggguacaag

SEQ ID NO: 19816 - RNA, 18 nt, artificial
  Chemically synthesized
ugcgcagcgacaaggugu

SEQ ID NO: 19817 - RNA, 18 nt, artificial
  Chemically synthesized
gcaggaugucaacgagug

SEQ ID NO: 19818 - RNA, 18 nt, artificial
  Chemically synthesized
cacguguauugacgacgu

SEQ ID NO: 19819 - RNA, 18 nt, artificial
  Chemically synthesized
gcacucagggugugcacu

SEQ ID NO: 19820 - RNA, 18 nt, artificial
  Chemically synthesized
cauccuggacuacagcuu

SEQ ID NO: 19821 - RNA, 18 nt, artificial
  Chemically synthesized
gcuggacgaguacaaccu

SEQ ID NO: 19822 - RNA, 18 nt, artificial
  Chemically synthesized
gcaaguccgcccugcacu

SEQ ID NO: 19823 - RNA, 18 nt, artificial
  Chemically synthesized
cggcuacgagggugugca

SEQ ID NO: 19824 - RNA, 18 nt, artificial
  Chemically synthesized
ggugaggacugcagcgag

SEQ ID NO: 19825 - RNA, 18 nt, artificial
  Chemically synthesized
gacccaacacuuacaccu

SEQ ID NO: 19826 - RNA, 18 nt, artificial
  Chemically synthesized
gcaagaagguccgcaagc

SEQ ID NO: 19827 - RNA, 18 nt, artificial
  Chemically synthesized
ccagugucugcagggcua

SEQ ID NO: 19828 - RNA, 18 nt, artificial
  Chemically synthesized
gcguggacggcaucaacu

SEQ ID NO: 19829 - RNA, 18 nt, artificial
  Chemically synthesized
ccaagugccuggacggac

SEQ ID NO: 19830 - RNA, 18 nt, artificial
  Chemically synthesized
ccaacugccagaccaaca

SEQ ID NO: 19831 - RNA, 18 nt, artificial
  Chemically synthesized
ggcugcaacagcgcggag

SEQ ID NO: 19832 - RNA, 18 nt, artificial
  Chemically synthesized
ggaccacaggacccaacu

SEQ ID NO: 19833 - RNA, 18 nt, artificial
  Chemically synthesized
cagcugcacuucauguac

SEQ ID NO: 19834 - RNA, 18 nt, artificial
  Chemically synthesized
gcgcccugucccagauga

SEQ ID NO: 19835 - RNA, 18 nt, artificial
  Chemically synthesized
ugagaaaacaagcaaguu

SEQ ID NO: 19836 - RNA, 18 nt, artificial
  Chemically synthesized
gagagcuccugcuucaac

SEQ ID NO: 19837 - RNA, 18 nt, artificial
  Chemically synthesized
gguggacaucgaugagug

SEQ ID NO: 19838 - RNA, 18 nt, artificial
  Chemically synthesized
ggacuguggcacuugccu

SEQ ID NO: 19839 - RNA, 18 nt, artificial
  Chemically synthesized
cgggcaacacgcaccacu

SEQ ID NO: 19840 - RNA, 18 nt, artificial
  Chemically synthesized
gcaagcccugcaagaaug

SEQ ID NO: 19841 - RNA, 18 nt, artificial
  Chemically synthesized
uccgcacgcggauuaauu

SEQ ID NO: 19842 - RNA, 18 nt, artificial
  Chemically synthesized
ccacugugagaacaacac

SEQ ID NO: 19843 - RNA, 18 nt, artificial
  Chemically synthesized
ccuggagacgggcaacag

SEQ ID NO: 19844 - RNA, 18 nt, artificial
  Chemically synthesized
gugcagggcaagaagguc

SEQ ID NO: 19845 - RNA, 18 nt, artificial
  Chemically synthesized
gccggcuggccuuugaga

SEQ ID NO: 19846 - RNA, 18 nt, artificial
  Chemically synthesized
acgacaaccagaaugagu

SEQ ID NO: 19847 - RNA, 18 nt, artificial
  Chemically synthesized
cugcgagcaugcgggcaa

SEQ ID NO: 19848 - RNA, 18 nt, artificial
  Chemically synthesized
ggcuacaacugcgugugu

SEQ ID NO: 19849 - RNA, 18 nt, artificial
  Chemically synthesized
ggagcucagccgcgugcu

SEQ ID NO: 19850 - RNA, 18 nt, artificial
  Chemically synthesized
gccuggacggacccaaca

SEQ ID NO: 19851 - RNA, 18 nt, artificial
  Chemically synthesized
ccagcaaacauccagcag

SEQ ID NO: 19852 - RNA, 18 nt, artificial
  Chemically synthesized
gaaccuugugcacuggug

SEQ ID NO: 19853 - RNA, 18 nt, artificial
  Chemically synthesized
ccaguacgauguggacga

SEQ ID NO: 19854 - RNA, 18 nt, artificial
  Chemically synthesized
gcacaaccagacagaccg

SEQ ID NO: 19855 - RNA, 18 nt, artificial
  Chemically synthesized
cuggagauugacaaccgg

SEQ ID NO: 19856 - RNA, 18 nt, artificial
  Chemically synthesized
gcugaccugcgcaugucu

SEQ ID NO: 19857 - RNA, 18 nt, artificial
  Chemically synthesized
caucaacgagugugcguc

SEQ ID NO: 19858 - RNA, 18 nt, artificial
  Chemically synthesized
gugaucuacaugaggaac

SEQ ID NO: 19859 - RNA, 18 nt, artificial
  Chemically synthesized
aggaccugguggacgagu

SEQ ID NO: 19860 - RNA, 18 nt, artificial
  Chemically synthesized
ggcggugacugcucccuc

SEQ ID NO: 19861 - RNA, 18 nt, artificial
  Chemically synthesized
ggcaccugaacguggcgg

SEQ ID NO: 19862 - RNA, 18 nt, artificial
  Chemically synthesized
ggagcagcugcgcaacag

SEQ ID NO: 19863 - RNA, 18 nt, artificial
  Chemically synthesized
gugggugagcgcugugag

SEQ ID NO: 19864 - RNA, 18 nt, artificial
  Chemically synthesized
ugaagaacgcuucagacg

SEQ ID NO: 19865 - RNA, 18 nt, artificial
  Chemically synthesized
gcuccugcacagacggca

SEQ ID NO: 19866 - RNA, 18 nt, artificial
  Chemically synthesized
gcagcgacaagguguuga

SEQ ID NO: 19867 - RNA, 18 nt, artificial
  Chemically synthesized
gucaaacaugagaugugu

SEQ ID NO: 19868 - RNA, 18 nt, artificial
  Chemically synthesized
gcgacaacgccuaccucu

SEQ ID NO: 19869 - RNA, 18 nt, artificial
  Chemically synthesized
cggaggaagaagucccag

SEQ ID NO: 19870 - RNA, 18 nt, artificial
  Chemically synthesized
gggcacuuucugugagga

SEQ ID NO: 19871 - RNA, 18 nt, artificial
  Chemically synthesized
gcggcaaaugcuggcaga

SEQ ID NO: 19872 - RNA, 18 nt, artificial
  Chemically synthesized
gagcauaguccaaaaagc

SEQ ID NO: 19873 - RNA, 18 nt, artificial
  Chemically synthesized
gccuuugagacuggccca

SEQ ID NO: 19874 - RNA, 18 nt, artificial
  Chemically synthesized
acugcaaggaccacuuca

SEQ ID NO: 19875 - RNA, 18 nt, artificial
  Chemically synthesized
gcagaccugugaggucga

SEQ ID NO: 19876 - RNA, 18 nt, artificial
  Chemically synthesized
ugcacaccaacguggucu

SEQ ID NO: 19877 - RNA, 18 nt, artificial
  Chemically synthesized
ccagugcaacucagccgg

SEQ ID NO: 19878 - RNA, 18 nt, artificial
  Chemically synthesized
ggucgacaucaacgagug

SEQ ID NO: 19879 - RNA, 18 nt, artificial
  Chemically synthesized
gcgugagcucagcagcca

SEQ ID NO: 19880 - RNA, 18 nt, artificial
  Chemically synthesized
cgaccaguacugcaagga

SEQ ID NO: 19881 - RNA, 18 nt, artificial
  Chemically synthesized
gggcgccagccugcacaa

SEQ ID NO: 19882 - RNA, 18 nt, artificial
  Chemically synthesized
gaccaguggcuacgugug

SEQ ID NO: 19883 - RNA, 18 nt, artificial
  Chemically synthesized
ggcuacgagugugccugu

SEQ ID NO: 19884 - RNA, 18 nt, artificial
  Chemically synthesized
ccagcaagaagaagcggc

SEQ ID NO: 19885 - RNA, 18 nt, artificial
  Chemically synthesized
cgccacugauccuggcug

SEQ ID NO: 19886 - RNA, 18 nt, artificial
  Chemically synthesized
ugaucuacaugaggaacu

SEQ ID NO: 19887 - RNA, 18 nt, artificial
  Chemically synthesized
cagaccaccggcagugga

SEQ ID NO: 19888 - RNA, 18 nt, artificial
  Chemically synthesized
ccgccgccgugaacaaug

SEQ ID NO: 19889 - RNA, 18 nt, artificial
  Chemically synthesized
gcauggugccgaaccaau

SEQ ID NO: 19890 - RNA, 18 nt, artificial
  Chemically synthesized
ggucacacacggaggcau

SEQ ID NO: 19891 - RNA, 18 nt, artificial
  Chemically synthesized
cgcagucucugcagugcu

SEQ ID NO: 19892 - RNA, 18 nt, artificial
  Chemically synthesized
caaagacaugaccagugg

SEQ ID NO: 19893 - RNA, 18 nt, artificial
  Chemically synthesized
cugucaauggcaaggcca

SEQ ID NO: 19894 - RNA, 18 nt, artificial
  Chemically synthesized
ggcaaguccgcccugcac

SEQ ID NO: 19895 - RNA, 18 nt, artificial
  Chemically synthesized
cgcugguggugguggugc

SEQ ID NO: 19896 - RNA, 18 nt, artificial
  Chemically synthesized
caacugcgugugugucaa

SEQ ID NO: 19897 - RNA, 18 nt, artificial
  Chemically synthesized
cugaccuggacgaccaga

SEQ ID NO: 19898 - RNA, 18 nt, artificial
  Chemically synthesized
gagaacauugaugacugu

SEQ ID NO: 19899 - RNA, 18 nt, artificial
  Chemically synthesized
cacugugagaucaacgug

SEQ ID NO: 19900 - RNA, 18 nt, artificial
  Chemically synthesized
ggcaccugccacaacgag

SEQ ID NO: 19901 - RNA, 18 nt, artificial
  Chemically synthesized
cccacacccaguaccgcu

SEQ ID NO: 19902 - RNA, 18 nt, artificial
  Chemically synthesized
gaaccgagccacagaccu

SEQ ID NO: 19903 - RNA, 18 nt, artificial
  Chemically synthesized
ggugugcacugugagauc

SEQ ID NO: 19904 - RNA, 18 nt, artificial
  Chemically synthesized
gcaucaacacgcugggcu

SEQ ID NO: 19905 - RNA, 18 nt, artificial
  Chemically synthesized
ggaccacuuugccaaccg

SEQ ID NO: 19906 - RNA, 18 nt, artificial
  Chemically synthesized
ggcaucaugcaugucaaa

SEQ ID NO: 19907 - RNA, 18 nt, artificial
  Chemically synthesized
gggcuucagcggucccaa

SEQ ID NO: 19908 - RNA, 18 nt, artificial
  Chemically synthesized
gcaccguccugggcucca

SEQ ID NO: 19909 - RNA, 18 nt, artificial
  Chemically synthesized
aguccgucaucaauggcu

SEQ ID NO: 19910 - RNA, 18 nt, artificial
  Chemically synthesized
gucuguugugugucaugc

SEQ ID NO: 19911 - RNA, 18 nt, artificial
  Chemically synthesized
ucgcagugcuuccagagu

SEQ ID NO: 19912 - RNA, 18 nt, artificial
  Chemically synthesized
gucuggacaagaucgaug

SEQ ID NO: 19913 - RNA, 18 nt, artificial
  Chemically synthesized
gccaguucccggccagca

SEQ ID NO: 19914 - RNA, 18 nt, artificial
  Chemically synthesized
gugagaccugccugaaug

SEQ ID NO: 19915 - RNA, 18 nt, artificial
  Chemically synthesized
gacgcaugcaucagcaac

SEQ ID NO: 19916 - RNA, 18 nt, artificial
  Chemically synthesized
agcaaguucugagagcca

SEQ ID NO: 19917 - RNA, 18 nt, artificial
  Chemically synthesized
ggcagaaaaaaugucugu

SEQ ID NO: 19918 - RNA, 18 nt, artificial
  Chemically synthesized
caacgaguguggccagaa

SEQ ID NO: 19919 - RNA, 18 nt, artificial
  Chemically synthesized
caaggucugcagccugca

SEQ ID NO: 19920 - RNA, 18 nt, artificial
  Chemically synthesized
ggcuccuucgagugccag

SEQ ID NO: 19921 - RNA, 18 nt, artificial
  Chemically synthesized
cugcacagacggcaucaa

SEQ ID NO: 19922 - RNA, 18 nt, artificial
  Chemically synthesized
gccgcugcgaguccguca

SEQ ID NO: 19923 - RNA, 18 nt, artificial
  Chemically synthesized
uggaagaacugcacgcag

SEQ ID NO: 19924 - RNA, 18 nt, artificial
  Chemically synthesized
gcugcauccagaggcaaa

SEQ ID NO: 19925 - RNA, 18 nt, artificial
  Chemically synthesized
cucacacgccgacgucaa

SEQ ID NO: 19926 - RNA, 18 nt, artificial
  Chemically synthesized
ugucaaacaugagaugug

SEQ ID NO: 19927 - RNA, 18 nt, artificial
  Chemically synthesized
gcacgaugucaaugagug

SEQ ID NO: 19928 - RNA, 18 nt, artificial
  Chemically synthesized
ccuggagacgggcaacag

SEQ ID NO: 19929 - RNA, 18 nt, artificial
  Chemically synthesized
cugugagaacaacacgcc

SEQ ID NO: 19930 - RNA, 18 nt, artificial
  Chemically synthesized
cgcggguucaucugcaag

SEQ ID NO: 19931 - RNA, 18 nt, artificial
  Chemically synthesized
ggaugccgcaguugugcu

SEQ ID NO: 19932 - RNA, 18 nt, artificial
  Chemically synthesized
gggacgcacugcgaggug

SEQ ID NO: 19933 - RNA, 18 nt, artificial
  Chemically synthesized
uccucgcccugcaagaac

SEQ ID NO: 19934 - RNA, 18 nt, artificial
  Chemically synthesized
cucccucaacuucaauga

SEQ ID NO: 19935 - RNA, 18 nt, artificial
  Chemically synthesized
ggcacugcgaccagggcu

SEQ ID NO: 19936 - RNA, 18 nt, artificial
  Chemically synthesized
ccagcaaacauccagcag

SEQ ID NO: 19937 - RNA, 18 nt, artificial
  Chemically synthesized
acaacaaugagugugaau

SEQ ID NO: 19938 - RNA, 18 nt, artificial
  Chemically synthesized
gguggaccgcagaggcgu

SEQ ID NO: 19939 - RNA, 18 nt, artificial
  Chemically synthesized
cagaggcguggcagacua

SEQ ID NO: 19940 - RNA, 18 nt, artificial
  Chemically synthesized
gcguggacagcuacacgu

SEQ ID NO: 19941 - RNA, 18 nt, artificial
  Chemically synthesized
aagaaaugauguuggaga

SEQ ID NO: 19942 - RNA, 18 nt, artificial
  Chemically synthesized
ggcuucacugggcaucug

SEQ ID NO: 19943 - RNA, 18 nt, artificial
  Chemically synthesized
cggaaccgagccacagac

SEQ ID NO: 19944 - RNA, 18 nt, artificial
  Chemically synthesized
cgggcaagugcaucaaca

SEQ ID NO: 19945 - RNA, 18 nt, artificial
  Chemically synthesized
ggcgucugugugcgcucu

SEQ ID NO: 19946 - RNA, 18 nt, artificial
  Chemically synthesized
aaaauguguucucggagu

SEQ ID NO: 19947 - RNA, 18 nt, artificial
  Chemically synthesized
cggcaucaauggcuucac

SEQ ID NO: 19948 - RNA, 18 nt, artificial
  Chemically synthesized
cugcagccugcagugcaa

SEQ ID NO: 19949 - RNA, 18 nt, artificial
  Chemically synthesized
cuguaacgagggcuccaa

SEQ ID NO: 19950 - RNA, 18 nt, artificial
  Chemically synthesized
gucagacuuggcucagcu

SEQ ID NO: 19951 - RNA, 18 nt, artificial
  Chemically synthesized
gacaagguguugacguug

SEQ ID NO: 19952 - RNA, 18 nt, artificial
  Chemically synthesized
ggaccugguggacgagug

SEQ ID NO: 19953 - RNA, 18 nt, artificial
  Chemically synthesized
ggacgagugccagcugau

SEQ ID NO: 19954 - RNA, 18 nt, artificial
  Chemically synthesized
ggagcagcugcgcaacag

SEQ ID NO: 19955 - RNA, 18 nt, artificial
  Chemically synthesized
gggcaacaaggucugcag

SEQ ID NO: 19956 - RNA, 18 nt, artificial
  Chemically synthesized
ggacggcgugaacaccua

SEQ ID NO: 19957 - RNA, 18 nt, artificial
  Chemically synthesized
ccaguaccgcugcgagug

SEQ ID NO: 19958 - RNA, 18 nt, artificial
  Chemically synthesized
cugacugcacagagagcu

SEQ ID NO: 19959 - RNA, 18 nt, artificial
  Chemically synthesized
uuuguuucagguucagua

SEQ ID NO: 19960 - RNA, 18 nt, artificial
  Chemically synthesized
cguagaugaccugggcaa

SEQ ID NO: 19961 - RNA, 18 nt, artificial
  Chemically synthesized
gacuaugagagcuucucc

SEQ ID NO: 19962 - RNA, 18 nt, artificial
  Chemically synthesized
gcuccuuccacuuccugc

SEQ ID NO: 19963 - RNA, 18 nt, artificial
  Chemically synthesized
uggagugggaccaacugu

SEQ ID NO: 19964 - RNA, 18 nt, artificial
  Chemically synthesized
gcuucagcgggauccacu

SEQ ID NO: 19965 - RNA, 18 nt, artificial
  Chemically synthesized
gacaucaacgagugcguu

SEQ ID NO: 19966 - RNA, 18 nt, artificial
  Chemically synthesized
ccggcuggccuuugagac

SEQ ID NO: 19967 - RNA, 18 nt, artificial
  Chemically synthesized
ugugagaacaacacgccu

SEQ ID NO: 19968 - RNA, 18 nt, artificial
  Chemically synthesized
gggaccaacugugacauc

SEQ ID NO: 19969 - RNA, 18 nt, artificial
  Chemically synthesized
ggagaucgacgagugccu

SEQ ID NO: 19970 - RNA, 18 nt, artificial
  Chemically synthesized
ugggcaucugugccagua

SEQ ID NO: 19971 - RNA, 18 nt, artificial
  Chemically synthesized
cuggcaagggcagaccug

SEQ ID NO: 19972 - RNA, 18 nt, artificial
  Chemically synthesized
gggcuggacugugcggag

SEQ ID NO: 19973 - RNA, 18 nt, artificial
  Chemically synthesized
gagauugacaaccggcag

SEQ ID NO: 19974 - RNA, 18 nt, artificial
  Chemically synthesized
cccugcccguucuugaaa

SEQ ID NO: 19975 - RNA, 18 nt, artificial
  Chemically synthesized
gugacugcucccucaacu

SEQ ID NO: 19976 - RNA, 18 nt, artificial
  Chemically synthesized
cggagcagcugcgcaaca

SEQ ID NO: 19977 - RNA, 18 nt, artificial
  Chemically synthesized
aagagugcacccauggua

SEQ ID NO: 19978 - RNA, 18 nt, artificial
  Chemically synthesized
ugcgaguccgucaucaau

SEQ ID NO: 19979 - RNA, 18 nt, artificial
  Chemically synthesized
cggguccaccaguuugaa

SEQ ID NO: 19980 - RNA, 18 nt, artificial
  Chemically synthesized
gaggaaaauaucgacgau

SEQ ID NO: 19981 - RNA, 18 nt, artificial
  Chemically synthesized
uggaggaccucaucaacu

SEQ ID NO: 19982 - RNA, 18 nt, artificial
  Chemically synthesized
agagagcuccugcuucaa

SEQ ID NO: 19983 - RNA, 18 nt, artificial
  Chemically synthesized
ccgcugaccugcgcaugu

SEQ ID NO: 19984 - RNA, 18 nt, artificial
  Chemically synthesized
guuccgaagaagaugcuc

SEQ ID NO: 19985 - RNA, 18 nt, artificial
  Chemically synthesized
cugugugcgcucugugga

SEQ ID NO: 19986 - RNA, 18 nt, artificial
  Chemically synthesized
caccugucuggacaagau

SEQ ID NO: 19987 - RNA, 18 nt, artificial
  Chemically synthesized
cauccagaggcaaacgga

SEQ ID NO: 19988 - RNA, 18 nt, artificial
  Chemically synthesized
aguggagagccgagccag

SEQ ID NO: 19989 - RNA, 18 nt, artificial
  Chemically synthesized
ggacguccgcggcuccau

SEQ ID NO: 19990 - RNA, 18 nt, artificial
  Chemically synthesized
gugccagcauggagggcu

SEQ ID NO: 19991 - RNA, 18 nt, artificial
  Chemically synthesized
ccacgugugagaaugacg

SEQ ID NO: 19992 - RNA, 18 nt, artificial
  Chemically synthesized
ccaugguaccaaucauga

SEQ ID NO: 19993 - RNA, 18 nt, artificial
  Chemically synthesized
gcgucuccagcccuccca

SEQ ID NO: 19994 - RNA, 18 nt, artificial
  Chemically synthesized
ggcucaccuuccgcacgc

SEQ ID NO: 19995 - RNA, 18 nt, artificial
  Chemically synthesized
ccaacugugacaucaaca

SEQ ID NO: 19996 - RNA, 18 nt, artificial
  Chemically synthesized
gcgugugugucaacggcu

SEQ ID NO: 19997 - RNA, 18 nt, artificial
  Chemically synthesized
ggaggagcugcgcaagca

SEQ ID NO: 19998 - RNA, 18 nt, artificial
  Chemically synthesized
ggaccucaaggcacggag

SEQ ID NO: 19999 - RNA, 18 nt, artificial
  Chemically synthesized
ccguggacucccuggagu

SEQ ID NO: 20000 - RNA, 18 nt, artificial
  Chemically synthesized
gcuacagugggcgcaacu

SEQ ID NO: 20001 - RNA, 18 nt, artificial
  Chemically synthesized
caucaacaucgaugagug

SEQ ID NO: 20002 - RNA, 18 nt, artificial
  Chemically synthesized
cuggacaagaucaaugag

SEQ ID NO: 20003 - RNA, 18 nt, artificial
  Chemically synthesized
ggacccaacacuuacacc

SEQ ID NO: 20004 - RNA, 18 nt, artificial
  Chemically synthesized
aggacaucaacgagugug

SEQ ID NO: 20005 - RNA, 18 nt, artificial
  Chemically synthesized
agguugacgccgacugca

SEQ ID NO: 20006 - RNA, 18 nt, artificial
  Chemically synthesized
agugugaauccaacccuu

SEQ ID NO: 20007 - RNA, 18 nt, artificial
  Chemically synthesized
cugagggcuucaaagugu

SEQ ID NO: 20008 - RNA, 18 nt, artificial
  Chemically synthesized
ggcuccuaccgcugcguc

SEQ ID NO: 20009 - RNA, 18 nt, artificial
  Chemically synthesized
gcugcucccugguggcag

SEQ ID NO: 20010 - RNA, 18 nt, artificial
  Chemically synthesized
cgaccagaggagccuuuu

SEQ ID NO: 20011 - RNA, 18 nt, artificial
  Chemically synthesized
cuucgagugccagugucu

SEQ ID NO: 20012 - RNA, 18 nt, artificial
  Chemically synthesized
ccaaggaccucaaggcac

SEQ ID NO: 20013 - RNA, 18 nt, artificial
  Chemically synthesized
ggaugucaacgagugugg

SEQ ID NO: 20014 - RNA, 18 nt, artificial
  Chemically synthesized
ggcuacgugugcaccugc

SEQ ID NO: 20015 - RNA, 18 nt, artificial
  Chemically synthesized
cuuccugaguggagagcc

SEQ ID NO: 20016 - RNA, 18 nt, artificial
  Chemically synthesized
gggcuucaaagugucuga

SEQ ID NO: 20017 - RNA, 18 nt, artificial
  Chemically synthesized
gugaacaccuacaacugc

SEQ ID NO: 20018 - RNA, 18 nt, artificial
  Chemically synthesized
ggugcacacuauucugcc

SEQ ID NO: 20019 - RNA, 18 nt, artificial
  Chemically synthesized
cucugaggagaucgacga

SEQ ID NO: 20020 - RNA, 18 nt, artificial
  Chemically synthesized
ggacggcaucaauggcuu

SEQ ID NO: 20021 - RNA, 18 nt, artificial
  Chemically synthesized
agcagauuuuugcaauac

SEQ ID NO: 20022 - RNA, 18 nt, artificial
  Chemically synthesized
gucucugcagugcuggaa

SEQ ID NO: 20023 - RNA, 18 nt, artificial
  Chemically synthesized
agggcugccugcuggaca

SEQ ID NO: 20024 - RNA, 18 nt, artificial
  Chemically synthesized
caguacuguaccgaggau

SEQ ID NO: 20025 - RNA, 18 nt, artificial
  Chemically synthesized
caucaacaacaaugagug

SEQ ID NO: 20026 - RNA, 18 nt, artificial
  Chemically synthesized
caacgagugcgucucgaa

SEQ ID NO: 20027 - RNA, 18 nt, artificial
  Chemically synthesized
caacauccaggacaacau

SEQ ID NO: 20028 - RNA, 18 nt, artificial
  Chemically synthesized
ggcauccuacccuuuucu

SEQ ID NO: 20029 - RNA, 18 nt, artificial
  Chemically synthesized
cgugggugagcgcuguga

SEQ ID NO: 20030 - RNA, 18 nt, artificial
  Chemically synthesized
gguuauacaaguucuugg

SEQ ID NO: 20031 - RNA, 18 nt, artificial
  Chemically synthesized
agugcaacucagccggcu

SEQ ID NO: 20032 - RNA, 18 nt, artificial
  Chemically synthesized
gcagcugcacuucaugua

SEQ ID NO: 20033 - RNA, 18 nt, artificial
  Chemically synthesized
gcauguacccgagaggcu

SEQ ID NO: 20034 - RNA, 18 nt, artificial
  Chemically synthesized
ugcacaguagccuugcug

SEQ ID NO: 20035 - RNA, 18 nt, artificial
  Chemically synthesized
gccgccgccgugaacaau

SEQ ID NO: 20036 - RNA, 18 nt, artificial
  Chemically synthesized
agugcuggaaguacuuca

SEQ ID NO: 20037 - RNA, 18 nt, artificial
  Chemically synthesized
gcaagaauggugccaagu

SEQ ID NO: 20038 - RNA, 18 nt, artificial
  Chemically synthesized
gaacaacacgccugacug

SEQ ID NO: 20039 - RNA, 18 nt, artificial
  Chemically synthesized
gggcaacaaggucugcag

SEQ ID NO: 20040 - RNA, 18 nt, artificial
  Chemically synthesized
ggcuucaaagugucugag

SEQ ID NO: 20041 - RNA, 18 nt, artificial
  Chemically synthesized
gaggucgacaucaacgag

SEQ ID NO: 20042 - RNA, 18 nt, artificial
  Chemically synthesized
ccauggacguccgcggcu

SEQ ID NO: 20043 - RNA, 18 nt, artificial
  Chemically synthesized
cggugagaccugccugaa

SEQ ID NO: 20044 - RNA, 18 nt, artificial
  Chemically synthesized
cgagaucaaccuggauga

SEQ ID NO: 20045 - RNA, 18 nt, artificial
  Chemically synthesized
ccuccuacaucugccacu

SEQ ID NO: 20046 - RNA, 18 nt, artificial
  Chemically synthesized
aggcaauccgaggacuau

SEQ ID NO: 20047 - RNA, 18 nt, artificial
  Chemically synthesized
gcuccaccagcaucaccu

SEQ ID NO: 20048 - RNA, 18 nt, artificial
  Chemically synthesized
acgcggauuaauuugcau

SEQ ID NO: 20049 - RNA, 18 nt, artificial
  Chemically synthesized
ccagcacgaugucaauga

SEQ ID NO: 20050 - RNA, 18 nt, artificial
  Chemically synthesized
ccgacgcacaaggugucu

SEQ ID NO: 20051 - RNA, 18 nt, artificial
  Chemically synthesized
caacgaggucggcuccua

SEQ ID NO: 20052 - RNA, 18 nt, artificial
  Chemically synthesized
ugcaaagacaugaccagu

SEQ ID NO: 20053 - RNA, 18 nt, artificial
  Chemically synthesized
ccgacacccaccugggca

SEQ ID NO: 20054 - RNA, 18 nt, artificial
  Chemically synthesized
ggcggcaccugucaggac

SEQ ID NO: 20055 - RNA, 18 nt, artificial
  Chemically synthesized
agacuaugccugcagcug

SEQ ID NO: 20056 - RNA, 18 nt, artificial
  Chemically synthesized
ugcacuucauguacgugg

SEQ ID NO: 20057 - RNA, 18 nt, artificial
  Chemically synthesized
gggcucuugugccacauc

SEQ ID NO: 20058 - RNA, 18 nt, artificial
  Chemically synthesized
ggcgacgucacccacgag

SEQ ID NO: 20059 - RNA, 18 nt, artificial
  Chemically synthesized
ccgcggguucaucugcaa

SEQ ID NO: 20060 - RNA, 18 nt, artificial
  Chemically synthesized
cagagugagaccguggag

SEQ ID NO: 20061 - RNA, 18 nt, artificial
  Chemically synthesized
ccgcacgcggauuaauuu

SEQ ID NO: 20062 - RNA, 18 nt, artificial
  Chemically synthesized
ggcaaacggaggcaaagc

SEQ ID NO: 20063 - RNA, 18 nt, artificial
  Chemically synthesized
aguggagagccgagccag

SEQ ID NO: 20064 - RNA, 18 nt, artificial
  Chemically synthesized
gagugcgacucacagccc

SEQ ID NO: 20065 - RNA, 18 nt, artificial
  Chemically synthesized
uguggaugccgcaguugu

SEQ ID NO: 20066 - RNA, 18 nt, artificial
  Chemically synthesized
cgcuacucacgcucugau

SEQ ID NO: 20067 - RNA, 18 nt, artificial
  Chemically synthesized
acugcgagaccaacauca

SEQ ID NO: 20068 - RNA, 18 nt, artificial
  Chemically synthesized
gacgagugcucacccagc

SEQ ID NO: 20069 - RNA, 18 nt, artificial
  Chemically synthesized
gccuggacaagaucaaug

SEQ ID NO: 20070 - RNA, 18 nt, artificial
  Chemically synthesized
cgaggaccuggagaccaa

SEQ ID NO: 20071 - RNA, 18 nt, artificial
  Chemically synthesized
gcuacgagaccgccaagg

SEQ ID NO: 20072 - RNA, 18 nt, artificial
  Chemically synthesized
gcugcguccuuugguccu

SEQ ID NO: 20073 - RNA, 18 nt, artificial
  Chemically synthesized
gccaagagugcacccaug

SEQ ID NO: 20074 - RNA, 18 nt, artificial
  Chemically synthesized
cagcgcagaugccaacau

SEQ ID NO: 20075 - RNA, 18 nt, artificial
  Chemically synthesized
gccagaacgacgccaccu

SEQ ID NO: 20076 - RNA, 18 nt, artificial
  Chemically synthesized
aggcaucaugcaugucaa

SEQ ID NO: 20077 - RNA, 18 nt, artificial
  Chemically synthesized
cugugacccuggguggag

SEQ ID NO: 20078 - RNA, 18 nt, artificial
  Chemically synthesized
ggccagcucugguucccu

SEQ ID NO: 20079 - RNA, 18 nt, artificial
  Chemically synthesized
ggcggugcacacuauucu

SEQ ID NO: 20080 - RNA, 18 nt, artificial
  Chemically synthesized
gcuccagcaacacagccu

SEQ ID NO: 20081 - RNA, 18 nt, artificial
  Chemically synthesized
cugccagaccaacaucaa

SEQ ID NO: 20082 - RNA, 18 nt, artificial
  Chemically synthesized
agcgagaacauugaugac

SEQ ID NO: 20083 - RNA, 18 nt, artificial
  Chemically synthesized
agggcaugcuggaggacc

SEQ ID NO: 20084 - RNA, 18 nt, artificial
  Chemically synthesized
acaaguucuuggucccuc

SEQ ID NO: 20085 - RNA, 18 nt, artificial
  Chemically synthesized
gcugcucccugguggcag

SEQ ID NO: 20086 - RNA, 18 nt, artificial
  Chemically synthesized
ccagaaccuugugcacug

SEQ ID NO: 20087 - RNA, 18 nt, artificial
  Chemically synthesized
gccgugcagagugagacc

SEQ ID NO: 20088 - RNA, 18 nt, artificial
  Chemically synthesized
gccagaccaacaucaacg

SEQ ID NO: 20089 - RNA, 18 nt, artificial
  Chemically synthesized
cucccaccagcaugcagu

SEQ ID NO: 20090 - RNA, 18 nt, artificial
  Chemically synthesized
gcacagacggcaucaaca

SEQ ID NO: 20091 - RNA, 18 nt, artificial
  Chemically synthesized
agagcuucuccugugucu

SEQ ID NO: 20092 - RNA, 18 nt, artificial
  Chemically synthesized
uuugaauggucaaugcga

SEQ ID NO: 20093 - RNA, 18 nt, artificial
  Chemically synthesized
guuccagcagucuccguc

SEQ ID NO: 20094 - RNA, 18 nt, artificial
  Chemically synthesized
acauccagcagcagcaaa

SEQ ID NO: 20095 - RNA, 18 nt, artificial
  Chemically synthesized
cgugguucugccugaccu

SEQ ID NO: 20096 - RNA, 18 nt, artificial
  Chemically synthesized
caacccugucaauggcaa

SEQ ID NO: 20097 - RNA, 18 nt, artificial
  Chemically synthesized
caagaucaaugaguucca

SEQ ID NO: 20098 - RNA, 18 nt, artificial
  Chemically synthesized
agcauauggguuagaugu

SEQ ID NO: 20099 - RNA, 18 nt, artificial
  Chemically synthesized
gcaugcagucccagaucg

SEQ ID NO: 20100 - RNA, 18 nt, artificial
  Chemically synthesized
gcauggagggcucugugu

SEQ ID NO: 20101 - RNA, 18 nt, artificial
  Chemically synthesized
ccagguagaaacuuuuau

SEQ ID NO: 20102 - RNA, 18 nt, artificial
  Chemically synthesized
uggacucccuggagucac

SEQ ID NO: 20103 - RNA, 18 nt, artificial
  Chemically synthesized
ggacaucaacgagugugc

SEQ ID NO: 20104 - RNA, 18 nt, artificial
  Chemically synthesized
ggaguacaagugccgcug

SEQ ID NO: 20105 - RNA, 18 nt, artificial
  Chemically synthesized
caugcaugucaaacauga

SEQ ID NO: 20106 - RNA, 18 nt, artificial
  Chemically synthesized
agaaccuugugcacuggu

SEQ ID NO: 20107 - RNA, 18 nt, artificial
  Chemically synthesized
cugcgagaucaaccugga

SEQ ID NO: 20108 - RNA, 18 nt, artificial
  Chemically synthesized
guugugcuccugaagaac

SEQ ID NO: 20109 - RNA, 18 nt, artificial
  Chemically synthesized
gccacaacgaggucggcu

SEQ ID NO: 20110 - RNA, 18 nt, artificial
  Chemically synthesized
gcacgacgccacugaucc

SEQ ID NO: 20111 - RNA, 18 nt, artificial
  Chemically synthesized
cacccagaacugcgugca

SEQ ID NO: 20112 - RNA, 18 nt, artificial
  Chemically synthesized
gcccgcuacucacgcucu

SEQ ID NO: 20113 - RNA, 18 nt, artificial
  Chemically synthesized
ggagccuuagccgcccau

SEQ ID NO: 20114 - RNA, 18 nt, artificial
  Chemically synthesized
agaacauugaugacugug

SEQ ID NO: 20115 - RNA, 18 nt, artificial
  Chemically synthesized
ccagcgcccugucccaga

SEQ ID NO: 20116 - RNA, 18 nt, artificial
  Chemically synthesized
ggcacucagggugugcac

SEQ ID NO: 20117 - RNA, 18 nt, artificial
  Chemically synthesized
cagccucaacggguacaa

SEQ ID NO: 20118 - RNA, 18 nt, artificial
  Chemically synthesized
gugccuggacggacccaa

SEQ ID NO: 20119 - RNA, 18 nt, artificial
  Chemically synthesized
gccucaacggcggcacau

SEQ ID NO: 20120 - RNA, 18 nt, artificial
  Chemically synthesized
agaagggaaguugaacga

SEQ ID NO: 20121 - RNA, 18 nt, artificial
  Chemically synthesized
gcaaggacggcgucgcca

SEQ ID NO: 20122 - RNA, 18 nt, artificial
  Chemically synthesized
cugguggacgagugcuca

SEQ ID NO: 20123 - RNA, 18 nt, artificial
  Chemically synthesized
gcgggauccacugugaga

SEQ ID NO: 20124 - RNA, 18 nt, artificial
  Chemically synthesized
ccggguacaagugcaacu

SEQ ID NO: 20125 - RNA, 18 nt, artificial
  Chemically synthesized
accucaacgacgcaugca

SEQ ID NO: 20126 - RNA, 18 nt, artificial
  Chemically synthesized
cgcccugucccagaugau

SEQ ID NO: 20127 - RNA, 18 nt, artificial
  Chemically synthesized
ugaggaaaauaucgacga

SEQ ID NO: 20128 - RNA, 18 nt, artificial
  Chemically synthesized
gcuucacugggcaucugu

SEQ ID NO: 20129 - RNA, 18 nt, artificial
  Chemically synthesized
cggcuaccugggcagccu

SEQ ID NO: 20130 - RNA, 18 nt, artificial
  Chemically synthesized
gaccaacaucaacgagug

SEQ ID NO: 20131 - RNA, 18 nt, artificial
  Chemically synthesized
cuggacgaguacaaccug

SEQ ID NO: 20132 - RNA, 18 nt, artificial
  Chemically synthesized
ggccagugccugcccuuc

SEQ ID NO: 20133 - RNA, 18 nt, artificial
  Chemically synthesized
cuccgacuucaucuacca

SEQ ID NO: 20134 - RNA, 18 nt, artificial
  Chemically synthesized
gcagaggcguggcagacu

SEQ ID NO: 20135 - RNA, 18 nt, artificial
  Chemically synthesized
agggcagaccugugaggu

SEQ ID NO: 20136 - RNA, 18 nt, artificial
  Chemically synthesized
gagccuuagccgcccaug

SEQ ID NO: 20137 - RNA, 18 nt, artificial
  Chemically synthesized
cggcaccugcaaagacau

SEQ ID NO: 20138 - RNA, 18 nt, artificial
  Chemically synthesized
ccgcgggccugauggcuu

SEQ ID NO: 20139 - RNA, 18 nt, artificial
  Chemically synthesized
ccugcagugcaacaacca

SEQ ID NO: 20140 - RNA, 18 nt, artificial
  Chemically synthesized
aguuccagugcaucugca

SEQ ID NO: 20141 - RNA, 18 nt, artificial
  Chemically synthesized
ggugugacuccucgcccu

SEQ ID NO: 20142 - RNA, 18 nt, artificial
  Chemically synthesized
aucgauggcuacgagugu

SEQ ID NO: 20143 - RNA, 18 nt, artificial
  Chemically synthesized
caugcuugugaaaaugug

SEQ ID NO: 20144 - RNA, 18 nt, artificial
  Chemically synthesized
ggacgcgccggccgucau

SEQ ID NO: 20145 - RNA, 18 nt, artificial
  Chemically synthesized
cccugucaauggcaaggc

SEQ ID NO: 20146 - RNA, 18 nt, artificial
  Chemically synthesized
guaacaucaacaucgaug

SEQ ID NO: 20147 - RNA, 18 nt, artificial
  Chemically synthesized
caggguuuuccuacguag

SEQ ID NO: 20148 - RNA, 18 nt, artificial
  Chemically synthesized
ccucagccugcacagugu

SEQ ID NO: 20149 - RNA, 18 nt, artificial
  Chemically synthesized
cuauggcagaaaaaaugu

SEQ ID NO: 20150 - RNA, 18 nt, artificial
  Chemically synthesized
gccacugugacagccagu

SEQ ID NO: 20151 - RNA, 18 nt, artificial
  Chemically synthesized
ggaggacgcgggcaacaa

SEQ ID NO: 20152 - RNA, 18 nt, artificial
  Chemically synthesized
acgagugcguucugagcc

SEQ ID NO: 20153 - RNA, 18 nt, artificial
  Chemically synthesized
gggcgcaacugcgagacc

SEQ ID NO: 20154 - RNA, 18 nt, artificial
  Chemically synthesized
agggagcauguguaacau

SEQ ID NO: 20155 - RNA, 18 nt, artificial
  Chemically synthesized
cgccgugaacaaugugga

SEQ ID NO: 20156 - RNA, 18 nt, artificial
  Chemically synthesized
caacaacaaugaguguga

SEQ ID NO: 20157 - RNA, 18 nt, artificial
  Chemically synthesized
augcgagaucgacgucaa

SEQ ID NO: 20158 - RNA, 18 nt, artificial
  Chemically synthesized
gcugcuggacgaguacaa

SEQ ID NO: 20159 - RNA, 18 nt, artificial
  Chemically synthesized
caucuccgacuucaucua

SEQ ID NO: 20160 - RNA, 18 nt, artificial
  Chemically synthesized
gaugcuccagcaacacag

SEQ ID NO: 20161 - RNA, 18 nt, artificial
  Chemically synthesized
gucugaggccagcaagaa

SEQ ID NO: 20162 - RNA, 18 nt, artificial
  Chemically synthesized
gagcagauuuuugcaaua

SEQ ID NO: 20163 - RNA, 18 nt, artificial
  Chemically synthesized
gagggugugcacugcgag

SEQ ID NO: 20164 - RNA, 18 nt, artificial
  Chemically synthesized
cccgcaugcaugauggca

SEQ ID NO: 20165 - RNA, 18 nt, artificial
  Chemically synthesized
gguccgagggcgucucca

SEQ ID NO: 20166 - RNA, 18 nt, artificial
  Chemically synthesized
auguguaacaucaacauc

SEQ ID NO: 20167 - RNA, 18 nt, artificial
  Chemically synthesized
cgggcaacaaggucugca

SEQ ID NO: 20168 - RNA, 18 nt, artificial
  Chemically synthesized
cgacgucaacgagugcgu

SEQ ID NO: 20169 - RNA, 18 nt, artificial
  Chemically synthesized
gcaauaccaaguauagcc

SEQ ID NO: 20170 - RNA, 18 nt, artificial
  Chemically synthesized
gguggacgagugcucacc

SEQ ID NO: 20171 - RNA, 18 nt, artificial
  Chemically synthesized
gccgggacagccucaacg

SEQ ID NO: 20172 - RNA, 18 nt, artificial
  Chemically synthesized
gguuagauguugccaugu

SEQ ID NO: 20173 - RNA, 18 nt, artificial
  Chemically synthesized
cagcuacgagaccgccaa

SEQ ID NO: 20174 - RNA, 18 nt, artificial
  Chemically synthesized
caaccaccugccugggau

SEQ ID NO: 20175 - RNA, 18 nt, artificial
  Chemically synthesized
acaugagauguguggacu

SEQ ID NO: 20176 - RNA, 18 nt, artificial
  Chemically synthesized
ccgcauuccggaggccuu

SEQ ID NO: 20177 - RNA, 18 nt, artificial
  Chemically synthesized
cuugugcacuggugugac

SEQ ID NO: 20178 - RNA, 18 nt, artificial
  Chemically synthesized
gauuguccaggaaacaac

SEQ ID NO: 20179 - RNA, 18 nt, artificial
  Chemically synthesized
gguacaagugcaacugcc

SEQ ID NO: 20180 - RNA, 18 nt, artificial
  Chemically synthesized
ccugaauuucacuguggg

SEQ ID NO: 20181 - RNA, 18 nt, artificial
  Chemically synthesized
cgcagaugccaacaucca

SEQ ID NO: 20182 - RNA, 18 nt, artificial
  Chemically synthesized
ccggcuuccuuucccaag

SEQ ID NO: 20183 - RNA, 18 nt, artificial
  Chemically synthesized
agugaucuacaugaggaa

SEQ ID NO: 20184 - RNA, 18 nt, artificial
  Chemically synthesized
agacccacacccaguacc

SEQ ID NO: 20185 - RNA, 18 nt, artificial
  Chemically synthesized
gcacuugccugggucaca

SEQ ID NO: 20186 - RNA, 18 nt, artificial
  Chemically synthesized
ggacggcgucgccaccuu

SEQ ID NO: 20187 - RNA, 18 nt, artificial
  Chemically synthesized
aagauaugcagaacaaca

SEQ ID NO: 20188 - RNA, 18 nt, artificial
  Chemically synthesized
cguguggccuccuucuac

SEQ ID NO: 20189 - RNA, 18 nt, artificial
  Chemically synthesized
gaccugugagcccacauc

SEQ ID NO: 20190 - RNA, 18 nt, artificial
  Chemically synthesized
ccgggcacauugagcugu

SEQ ID NO: 20191 - RNA, 18 nt, artificial
  Chemically synthesized
cugccagcacgaugucaa

SEQ ID NO: 20192 - RNA, 18 nt, artificial
  Chemically synthesized
caccaguuugaaugguca

SEQ ID NO: 20193 - RNA, 18 nt, artificial
  Chemically synthesized
aucaaugaguuccagugc

SEQ ID NO: 20194 - RNA, 18 nt, artificial
  Chemically synthesized
cgugugagaaugacgcuc

SEQ ID NO: 20195 - RNA, 18 nt, artificial
  Chemically synthesized
cugugcggagcauguacc

SEQ ID NO: 20196 - RNA, 18 nt, artificial
  Chemically synthesized
gaggaagaagucccagga

SEQ ID NO: 20197 - RNA, 18 nt, artificial
  Chemically synthesized
cugaaauaggaaacaagu

SEQ ID NO: 20198 - RNA, 18 nt, artificial
  Chemically synthesized
agcauaguccaaaaagcu

SEQ ID NO: 20199 - RNA, 18 nt, artificial
  Chemically synthesized
gggcaucgggcaccugaa

SEQ ID NO: 20200 - RNA, 18 nt, artificial
  Chemically synthesized
cgggcuggcaagggcaga

SEQ ID NO: 20201 - RNA, 18 nt, artificial
  Chemically synthesized
cuucuaccguugccugug

SEQ ID NO: 20202 - RNA, 18 nt, artificial
  Chemically synthesized
gguggugguggugcugau

SEQ ID NO: 20203 - RNA, 18 nt, artificial
  Chemically synthesized
gcuggaggaccucaucaa

SEQ ID NO: 20204 - RNA, 18 nt, artificial
  Chemically synthesized
ccuucuaccguugccugu

SEQ ID NO: 20205 - RNA, 18 nt, artificial
  Chemically synthesized
gugaaagcauauggguua

SEQ ID NO: 20206 - RNA, 18 nt, artificial
  Chemically synthesized
aauccgaggacuaugaga

SEQ ID NO: 20207 - RNA, 18 nt, artificial
  Chemically synthesized
ggcugucccggcugcaga

SEQ ID NO: 20208 - RNA, 18 nt, artificial
  Chemically synthesized
ccggcaggaugucaacga

SEQ ID NO: 20209 - RNA, 18 nt, artificial
  Chemically synthesized
gggcuggcaagggcagac

SEQ ID NO: 20210 - RNA, 18 nt, artificial
  Chemically synthesized
uucuugaaauguaggcau

SEQ ID NO: 20211 - RNA, 18 nt, artificial
  Chemically synthesized
cccuggaagaacugcacg

SEQ ID NO: 20212 - RNA, 18 nt, artificial
  Chemically synthesized
ccgaaccaauacaacccu

SEQ ID NO: 20213 - RNA, 18 nt, artificial
  Chemically synthesized
agaccuggaugcccgcau

SEQ ID NO: 20214 - RNA, 18 nt, artificial
  Chemically synthesized
uggacaagaucgauggcu

SEQ ID NO: 20215 - RNA, 18 nt, artificial
  Chemically synthesized
aguugugcuccugaagaa

SEQ ID NO: 20216 - RNA, 18 nt, artificial
  Chemically synthesized
agcccacauccgagagcc

SEQ ID NO: 20217 - RNA, 18 nt, artificial
  Chemically synthesized
agccagugcaacucagcc

SEQ ID NO: 20218 - RNA, 18 nt, artificial
  Chemically synthesized
acaguagccuugcugcca

SEQ ID NO: 20219 - RNA, 18 nt, artificial
  Chemically synthesized
gcagccacaaaacuuaca

SEQ ID NO: 20220 - RNA, 18 nt, artificial
  Chemically synthesized
cccagaacugcgugcagc

SEQ ID NO: 20221 - RNA, 18 nt, artificial
  Chemically synthesized
gccuggccguggagggca

SEQ ID NO: 20222 - RNA, 18 nt, artificial
  Chemically synthesized
ggugaacugcucugagga

SEQ ID NO: 20223 - RNA, 18 nt, artificial
  Chemically synthesized
cuuugagacuggcccacc

SEQ ID NO: 20224 - RNA, 18 nt, artificial
  Chemically synthesized
ggugcugaugccgccgga

SEQ ID NO: 20225 - RNA, 18 nt, artificial
  Chemically synthesized
ggcuggacuggugaggac

SEQ ID NO: 20226 - RNA, 18 nt, artificial
  Chemically synthesized
cacucagggugugcacug

SEQ ID NO: 20227 - RNA, 18 nt, artificial
  Chemically synthesized
gaucgacgucaacgagug

SEQ ID NO: 20228 - RNA, 18 nt, artificial
  Chemically synthesized
cugaguggagagccgagc

SEQ ID NO: 20229 - RNA, 18 nt, artificial
  Chemically synthesized
cugccugucugaggucaa

SEQ ID NO: 20230 - RNA, 18 nt, artificial
  Chemically synthesized
ccugucugaggucaauga

SEQ ID NO: 20231 - RNA, 18 nt, artificial
  Chemically synthesized
gagccgagccaggcagac

SEQ ID NO: 20232 - RNA, 18 nt, artificial
  Chemically synthesized
cuggacugugcggagcau

SEQ ID NO: 20233 - RNA, 18 nt, artificial
  Chemically synthesized
ugccagugagggacguca

SEQ ID NO: 20234 - RNA, 18 nt, artificial
  Chemically synthesized
agagugcacccaugguac

SEQ ID NO: 20235 - RNA, 18 nt, artificial
  Chemically synthesized
gucugaggucaaugagug

SEQ ID NO: 20236 - RNA, 18 nt, artificial
  Chemically synthesized
cgcccguggcacccagaa

SEQ ID NO: 20237 - RNA, 18 nt, artificial
  Chemically synthesized
gucuccgacugguccgag

SEQ ID NO: 20238 - RNA, 18 nt, artificial
  Chemically synthesized
gcagcuacugugaggacc

SEQ ID NO: 20239 - RNA, 18 nt, artificial
  Chemically synthesized
cgucaucuccgacuucau

SEQ ID NO: 20240 - RNA, 18 nt, artificial
  Chemically synthesized
gguuccgaagaagaugcu

SEQ ID NO: 20241 - RNA, 18 nt, artificial
  Chemically synthesized
cugcgaggucaacacaga

SEQ ID NO: 20242 - RNA, 18 nt, artificial
  Chemically synthesized
ccgugcuggucacaccgg

SEQ ID NO: 20243 - RNA, 18 nt, artificial
  Chemically synthesized
gaugcuccagcaacacag

SEQ ID NO: 20244 - RNA, 18 nt, artificial
  Chemically synthesized
cccguggcacccagaacu

SEQ ID NO: 20245 - RNA, 18 nt, artificial
  Chemically synthesized
gccggagcagcugcgcaa

SEQ ID NO: 20246 - RNA, 18 nt, artificial
  Chemically synthesized
gcauaguccaaaaagcuc

SEQ ID NO: 20247 - RNA, 18 nt, artificial
  Chemically synthesized
ugaaugagucuguugugu

SEQ ID NO: 20248 - RNA, 18 nt, artificial
  Chemically synthesized
cggcuggacuggugagga

SEQ ID NO: 20249 - RNA, 18 nt, artificial
  Chemically synthesized
gagugcgucucgaacccg

SEQ ID NO: 20250 - RNA, 18 nt, artificial
  Chemically synthesized
cggcuggccuuugagacu

SEQ ID NO: 20251 - RNA, 18 nt, artificial
  Chemically synthesized
gagaacaacacgccugac

SEQ ID NO: 20252 - RNA, 18 nt, artificial
  Chemically synthesized
cuuacaccugugugugca

SEQ ID NO: 20253 - RNA, 18 nt, artificial
  Chemically synthesized
ggaugucaacgagugccu

SEQ ID NO: 20254 - RNA, 18 nt, artificial
  Chemically synthesized
guguauugacgacguugc

SEQ ID NO: 20255 - RNA, 18 nt, artificial
  Chemically synthesized
gugacagccagugcaacu

SEQ ID NO: 20256 - RNA, 18 nt, artificial
  Chemically synthesized
ugaggacugcagcgagaa

SEQ ID NO: 20257 - RNA, 18 nt, artificial
  Chemically synthesized
ggcacccagaacugcgug

SEQ ID NO: 20258 - RNA, 18 nt, artificial
  Chemically synthesized
gaacugcucugaggagau

SEQ ID NO: 20259 - RNA, 18 nt, artificial
  Chemically synthesized
uggguuagauguugccau

SEQ ID NO: 20260 - RNA, 18 nt, artificial
  Chemically synthesized
gucugugugcgcucugug

SEQ ID NO: 20261 - RNA, 18 nt, artificial
  Chemically synthesized
ggaaggccagugcaaccc

SEQ ID NO: 20262 - RNA, 18 nt, artificial
  Chemically synthesized
gcggcuacuccugcaagu

SEQ ID NO: 20263 - RNA, 18 nt, artificial
  Chemically synthesized
gcagccagcaaacaucca

SEQ ID NO: 20264 - RNA, 18 nt, artificial
  Chemically synthesized
gguggcaccugcguggac

SEQ ID NO: 20265 - RNA, 18 nt, artificial
  Chemically synthesized
agccugcacaaccagaca

SEQ ID NO: 20266 - RNA, 18 nt, artificial
  Chemically synthesized
gggugcugcugucccgca

SEQ ID NO: 20267 - RNA, 18 nt, artificial
  Chemically synthesized
cacugugacagccagugc

SEQ ID NO: 20268 - RNA, 18 nt, artificial
  Chemically synthesized
cugcgaccagggcugcaa

SEQ ID NO: 20269 - RNA, 18 nt, artificial
  Chemically synthesized
gggcacucagggugugca

SEQ ID NO: 20270 - RNA, 18 nt, artificial
  Chemically synthesized
cugcgagaccgacaucga

SEQ ID NO: 20271 - RNA, 18 nt, artificial
  Chemically synthesized
cugcgugcagcgcgucaa

SEQ ID NO: 20272 - RNA, 18 nt, artificial
  Chemically synthesized
accugguggacgagugcu

SEQ ID NO: 20273 - RNA, 18 nt, artificial
  Chemically synthesized
ugggcagccucaacaucc

SEQ ID NO: 20274 - RNA, 18 nt, artificial
  Chemically synthesized
ggcuuccuuucccaagcc

SEQ ID NO: 20275 - RNA, 18 nt, artificial
  Chemically synthesized
ccagauccugauccggaa

SEQ ID NO: 20276 - RNA, 18 nt, artificial
  Chemically synthesized
gcagcgcgucaaugacuu

SEQ ID NO: 20277 - RNA, 18 nt, artificial
  Chemically synthesized
aauguguucucggagugu

SEQ ID NO: 20278 - RNA, 18 nt, artificial
  Chemically synthesized
cagcccucccaccagcau

SEQ ID NO: 20279 - RNA, 18 nt, artificial
  Chemically synthesized
gugccgugcuggucacac

SEQ ID NO: 20280 - RNA, 18 nt, artificial
  Chemically synthesized
cggcgugcagggcaagaa

SEQ ID NO: 20281 - RNA, 18 nt, artificial
  Chemically synthesized
ccgcuacucacgcucuga

SEQ ID NO: 20282 - RNA, 18 nt, artificial
  Chemically synthesized
ccucgccuguggacaaca

SEQ ID NO: 20283 - RNA, 18 nt, artificial
  Chemically synthesized
gaggcaaacggaggcaaa

SEQ ID NO: 20284 - RNA, 18 nt, artificial
  Chemically synthesized
cccaacugccagaaccuu

SEQ ID NO: 20285 - RNA, 18 nt, artificial
  Chemically synthesized
cugcgaggacggcaucaa

SEQ ID NO: 20286 - RNA, 18 nt, artificial
  Chemically synthesized
guggcugcgcagcgacaa

SEQ ID NO: 20287 - RNA, 18 nt, artificial
  Chemically synthesized
uccugauccggaaccgag

SEQ ID NO: 20288 - RNA, 18 nt, artificial
  Chemically synthesized
gcuucaccggccagaacu

SEQ ID NO: 20289 - RNA, 18 nt, artificial
  Chemically synthesized
gcaucugugccaguacga

SEQ ID NO: 20290 - RNA, 18 nt, artificial
  Chemically synthesized
gagggcagcuacgagacc

SEQ ID NO: 20291 - RNA, 18 nt, artificial
  Chemically synthesized
caaugacuuccacugcga

SEQ ID NO: 20292 - RNA, 18 nt, artificial
  Chemically synthesized
ccagcaccucagccugca

SEQ ID NO: 20293 - RNA, 18 nt, artificial
  Chemically synthesized
gaaaugauguuggagaag

SEQ ID NO: 20294 - RNA, 18 nt, artificial
  Chemically synthesized
gucccaacugccagacca

SEQ ID NO: 20295 - RNA, 18 nt, artificial
  Chemically synthesized
caccacugcgagaccaac

SEQ ID NO: 20296 - RNA, 18 nt, artificial
  Chemically synthesized
ggagggcucuguguggac

SEQ ID NO: 20297 - RNA, 18 nt, artificial
  Chemically synthesized
gcacggaggaagaagucc

SEQ ID NO: 20298 - RNA, 18 nt, artificial
  Chemically synthesized
guguggacggcgugaaca

SEQ ID NO: 20299 - RNA, 18 nt, artificial
  Chemically synthesized
cacccacgguggcuacaa

SEQ ID NO: 20300 - RNA, 18 nt, artificial
  Chemically synthesized
cgagggugugcacugcga

SEQ ID NO: 20301 - RNA, 18 nt, artificial
  Chemically synthesized
gacuucaucuaccagggc

SEQ ID NO: 20302 - RNA, 18 nt, artificial
  Chemically synthesized
gacaagaucaaugaguuc

SEQ ID NO: 20303 - RNA, 18 nt, artificial
  Chemically synthesized
ccgccaaauucaacgggc

SEQ ID NO: 20304 - RNA, 18 nt, artificial
  Chemically synthesized
gagccaggguuuuccuac

SEQ ID NO: 20305 - RNA, 18 nt, artificial
  Chemically synthesized
caagaagguccgcaagcc

SEQ ID NO: 20306 - RNA, 18 nt, artificial
  Chemically synthesized
ggcaugaccagaugcguc

SEQ ID NO: 20307 - RNA, 18 nt, artificial
  Chemically synthesized
gccagcagaugaucuucc

SEQ ID NO: 20308 - RNA, 18 nt, artificial
  Chemically synthesized
ggugccacgugugaggug

SEQ ID NO: 20309 - RNA, 18 nt, artificial
  Chemically synthesized
caacugugacaucaacaa

SEQ ID NO: 20310 - RNA, 18 nt, artificial
  Chemically synthesized
cgauuguccaggaaacaa

SEQ ID NO: 20311 - RNA, 18 nt, artificial
  Chemically synthesized
gcgugcagggcaagaagg

SEQ ID NO: 20312 - RNA, 18 nt, artificial
  Chemically synthesized
ggcugcguccuuuggucc

SEQ ID NO: 20313 - RNA, 18 nt, artificial
  Chemically synthesized
cuggaaguacuucaguga

SEQ ID NO: 20314 - RNA, 18 nt, artificial
  Chemically synthesized
gcacaggagcgcaugcau

SEQ ID NO: 20315 - RNA, 18 nt, artificial
  Chemically synthesized
gacucacagcccugccug

SEQ ID NO: 20316 - RNA, 18 nt, artificial
  Chemically synthesized
ugugacaucaacaacaau

SEQ ID NO: 20317 - RNA, 18 nt, artificial
  Chemically synthesized
cagugggcgcaacugcga

SEQ ID NO: 20318 - RNA, 18 nt, artificial
  Chemically synthesized
caauggcugcaaaggcaa

SEQ ID NO: 20319 - RNA, 18 nt, artificial
  Chemically synthesized
ggcccuacgugcccugca

SEQ ID NO: 20320 - RNA, 18 nt, artificial
  Chemically synthesized
cgacaccaacccugucaa

SEQ ID NO: 20321 - RNA, 18 nt, artificial
  Chemically synthesized
ccgccaaggugcugcugg

SEQ ID NO: 20322 - RNA, 18 nt, artificial
  Chemically synthesized
ggcggcacaugcaucucc

SEQ ID NO: 20323 - RNA, 18 nt, artificial
  Chemically synthesized
cugcaaagacaugaccag

SEQ ID NO: 20324 - RNA, 18 nt, artificial
  Chemically synthesized
cgcugaccugcgcauguc

SEQ ID NO: 20325 - RNA, 18 nt, artificial
  Chemically synthesized
ggcuggaccggccuuuac

SEQ ID NO: 20326 - RNA, 18 nt, artificial
  Chemically synthesized
ggacuaccugggcggcua

SEQ ID NO: 20327 - RNA, 18 nt, artificial
  Chemically synthesized
agagugagaccguggagc

SEQ ID NO: 20328 - RNA, 18 nt, artificial
  Chemically synthesized
agacuuggcucagcucgg

SEQ ID NO: 20329 - RNA, 18 nt, artificial
  Chemically synthesized
ccugggucacacacggag

SEQ ID NO: 20330 - RNA, 18 nt, artificial
  Chemically synthesized
ccaacaccuacaagugcu

SEQ ID NO: 20331 - RNA, 18 nt, artificial
  Chemically synthesized
cgacaagguguugacguu

SEQ ID NO: 20332 - RNA, 18 nt, artificial
  Chemically synthesized
cagguuccgaagaagaug

SEQ ID NO: 20333 - RNA, 18 nt, artificial
  Chemically synthesized
cuggaagaacugcacgca

SEQ ID NO: 20334 - RNA, 18 nt, artificial
  Chemically synthesized
cccaacacuuacaccugu

SEQ ID NO: 20335 - RNA, 18 nt, artificial
  Chemically synthesized
cgggcaacagcgaggaag

SEQ ID NO: 20336 - RNA, 18 nt, artificial
  Chemically synthesized
ugcgagaucaaccuggau

SEQ ID NO: 20337 - RNA, 18 nt, artificial
  Chemically synthesized
gggugagcgcugugaggg

SEQ ID NO: 20338 - RNA, 18 nt, artificial
  Chemically synthesized
ugugugcacggaagggua

SEQ ID NO: 20339 - RNA, 18 nt, artificial
  Chemically synthesized
gaugcagcagcagaaccu

SEQ ID NO: 20340 - RNA, 18 nt, artificial
  Chemically synthesized
cguuccagcagucuccgu

SEQ ID NO: 20341 - RNA, 18 nt, artificial
  Chemically synthesized
ccaacgucuccgacuggu

SEQ ID NO: 20342 - RNA, 18 nt, artificial
  Chemically synthesized
ggucccuccagaaccacc

SEQ ID NO: 20343 - RNA, 18 nt, artificial
  Chemically synthesized
uuagaugguuucuugcaa

SEQ ID NO: 20344 - RNA, 18 nt, artificial
  Chemically synthesized
acaaagauaugcagaaca

SEQ ID NO: 20345 - RNA, 18 nt, artificial
  Chemically synthesized
ccaccaccacagccgcac

SEQ ID NO: 20346 - RNA, 18 nt, artificial
  Chemically synthesized
ggacgcgggcaacaaggu

SEQ ID NO: 20347 - RNA, 18 nt, artificial
  Chemically synthesized
agaucgaggccgugcaga

SEQ ID NO: 20348 - RNA, 18 nt, artificial
  Chemically synthesized
ggaccucaucaacucaca

SEQ ID NO: 20349 - RNA, 18 nt, artificial
  Chemically synthesized
gcaacugccugcugcccu

SEQ ID NO: 20350 - RNA, 18 nt, artificial
  Chemically synthesized
cugccagaaccuugugca

SEQ ID NO: 20351 - RNA, 18 nt, artificial
  Chemically synthesized
cgugcgagcugcccgagu

SEQ ID NO: 20352 - RNA, 18 nt, artificial
  Chemically synthesized
cgugcugcacaccaacgu

SEQ ID NO: 20353 - RNA, 18 nt, artificial
  Chemically synthesized
gacaggucaguacuguac

SEQ ID NO: 20354 - RNA, 18 nt, artificial
  Chemically synthesized
caaugaguuccagugcga

SEQ ID NO: 20355 - RNA, 18 nt, artificial
  Chemically synthesized
cccuucuaccguugccug

SEQ ID NO: 20356 - RNA, 18 nt, artificial
  Chemically synthesized
gggcgacgucacccacga

SEQ ID NO: 20357 - RNA, 18 nt, artificial
  Chemically synthesized
ugcggagcauguacccga

SEQ ID NO: 20358 - RNA, 18 nt, artificial
  Chemically synthesized
ugaccaguggcuacgugu

SEQ ID NO: 20359 - RNA, 18 nt, artificial
  Chemically synthesized
caagcaaguucugagagc

SEQ ID NO: 20360 - RNA, 18 nt, artificial
  Chemically synthesized
cgagccacagaccuggau

SEQ ID NO: 20361 - RNA, 18 nt, artificial
  Chemically synthesized
gcaagggcagaccuguga

SEQ ID NO: 20362 - RNA, 18 nt, artificial
  Chemically synthesized
ccugaguggagagccgag

SEQ ID NO: 20363 - RNA, 18 nt, artificial
  Chemically synthesized
cgaggauguggacgagug

SEQ ID NO: 20364 - RNA, 18 nt, artificial
  Chemically synthesized
gccugucugaggucaaug

SEQ ID NO: 20365 - RNA, 18 nt, artificial
  Chemically synthesized
gcgcgacaucgcacagga

SEQ ID NO: 20366 - RNA, 18 nt, artificial
  Chemically synthesized
caccuuggcgugagcuca

SEQ ID NO: 20367 - RNA, 18 nt, artificial
  Chemically synthesized
ccuuagccgcccaugcac

SEQ ID NO: 20368 - RNA, 18 nt, artificial
  Chemically synthesized
cugugagcccacauccga

SEQ ID NO: 20369 - RNA, 18 nt, artificial
  Chemically synthesized
ccaccuucaccugccucu

SEQ ID NO: 20370 - RNA, 18 nt, artificial
  Chemically synthesized
cccagcguguccugugag

SEQ ID NO: 20371 - RNA, 18 nt, artificial
  Chemically synthesized
guuugggaggagcagauu

SEQ ID NO: 20372 - RNA, 18 nt, artificial
  Chemically synthesized
ggcgggcuacacaggcag

SEQ ID NO: 20373 - RNA, 18 nt, artificial
  Chemically synthesized
cgccagccugcacaacca

SEQ ID NO: 20374 - RNA, 18 nt, artificial
  Chemically synthesized
ggcaagggcagaccugug

SEQ ID NO: 20375 - RNA, 18 nt, artificial
  Chemically synthesized
uguucucggaguguguau

SEQ ID NO: 20376 - RNA, 18 nt, artificial
  Chemically synthesized
cgcaacagcuccuuccac

SEQ ID NO: 20377 - RNA, 18 nt, artificial
  Chemically synthesized
gcuucaaagugucugagg

SEQ ID NO: 20378 - RNA, 18 nt, artificial
  Chemically synthesized
caucaauggcuucaccug

SEQ ID NO: 20379 - RNA, 18 nt, artificial
  Chemically synthesized
gacgaguacaaccuggug

SEQ ID NO: 20380 - RNA, 18 nt, artificial
  Chemically synthesized
gaauggucaaugcgagug

SEQ ID NO: 20381 - RNA, 18 nt, artificial
  Chemically synthesized
cgagaucgacgucaacga

SEQ ID NO: 20382 - RNA, 18 nt, artificial
  Chemically synthesized
cugccuggacaagaucaa

SEQ ID NO: 20383 - RNA, 18 nt, artificial
  Chemically synthesized
acaucaacgagugcguuc

SEQ ID NO: 20384 - RNA, 18 nt, artificial
  Chemically synthesized
gcgccguggccuccaaca

SEQ ID NO: 20385 - RNA, 18 nt, artificial
  Chemically synthesized
cccagguagaaacuuuua

SEQ ID NO: 20386 - RNA, 18 nt, artificial
  Chemically synthesized
cccugagggcuucaaagu

SEQ ID NO: 20387 - RNA, 18 nt, artificial
  Chemically synthesized
cacuccucagggcagccu

SEQ ID NO: 20388 - RNA, 18 nt, artificial
  Chemically synthesized
augucaaugagugcgacu

SEQ ID NO: 20389 - RNA, 18 nt, artificial
  Chemically synthesized
cugcguggacggcaucaa

SEQ ID NO: 20390 - RNA, 18 nt, artificial
  Chemically synthesized
gcagauuuuugcaauacc

SEQ ID NO: 20391 - RNA, 18 nt, artificial
  Chemically synthesized
ugcgagaccaacaucaac

SEQ ID NO: 20392 - RNA, 18 nt, artificial
  Chemically synthesized
aucuccgacuucaucuac

SEQ ID NO: 20393 - RNA, 18 nt, artificial
  Chemically synthesized
ccaaguauagccuauggc

SEQ ID NO: 20394 - RNA, 18 nt, artificial
  Chemically synthesized
gggugugcacugcgaggu

SEQ ID NO: 20395 - RNA, 18 nt, artificial
  Chemically synthesized
aagaacugcacgcagucu

SEQ ID NO: 20396 - RNA, 18 nt, artificial
  Chemically synthesized
gaaaauaucgacgauugu

SEQ ID NO: 20397 - RNA, 18 nt, artificial
  Chemically synthesized
uggcuaccugucagacgu

SEQ ID NO: 20398 - RNA, 18 nt, artificial
  Chemically synthesized
agaggagccuuuuuaaaa

SEQ ID NO: 20399 - RNA, 18 nt, artificial
  Chemically synthesized
ggcaucaauggcuucacc

SEQ ID NO: 20400 - RNA, 18 nt, artificial
  Chemically synthesized
acaacagggaggagacac

SEQ ID NO: 20401 - RNA, 18 nt, artificial
  Chemically synthesized
caugcaugauggcacgac

SEQ ID NO: 20402 - RNA, 18 nt, artificial
  Chemically synthesized
cauggugccgaaccaaua

SEQ ID NO: 20403 - RNA, 18 nt, artificial
  Chemically synthesized
ccacuacggcuccugcaa

SEQ ID NO: 20404 - RNA, 18 nt, artificial
  Chemically synthesized
ggucugcagccugcagug

SEQ ID NO: 20405 - RNA, 18 nt, artificial
  Chemically synthesized
cugguucccugagggcuu

SEQ ID NO: 20406 - RNA, 18 nt, artificial
  Chemically synthesized
gcuacgagggugugcacu

SEQ ID NO: 20407 - RNA, 18 nt, artificial
  Chemically synthesized
ugagggacgucagacuug

SEQ ID NO: 20408 - RNA, 18 nt, artificial
  Chemically synthesized
acgcugacggaguacaag

SEQ ID NO: 20409 - RNA, 18 nt, artificial
  Chemically synthesized
ugugacagccagugcaac

SEQ ID NO: 20410 - RNA, 18 nt, artificial
  Chemically synthesized
gagugggaccaacuguga

SEQ ID NO: 20411 - RNA, 18 nt, artificial
  Chemically synthesized
guggacgacugcaauccc

SEQ ID NO: 20412 - RNA, 18 nt, artificial
  Chemically synthesized
cauguguaacaucaacau

SEQ ID NO: 20413 - RNA, 18 nt, artificial
  Chemically synthesized
ggcagcuacugccagcac

SEQ ID NO: 20414 - RNA, 18 nt, artificial
  Chemically synthesized
augucaaacaugagaugu

SEQ ID NO: 20415 - RNA, 18 nt, artificial
  Chemically synthesized
caggaugucaacgagugu

SEQ ID NO: 20416 - RNA, 18 nt, artificial
  Chemically synthesized
gaccugugaggucgacau

SEQ ID NO: 20417 - RNA, 18 nt, artificial
  Chemically synthesized
guuugaauggucaaugcg

SEQ ID NO: 20418 - RNA, 18 nt, artificial
  Chemically synthesized
agagccaggguuuuccua

SEQ ID NO: 20419 - RNA, 18 nt, artificial
  Chemically synthesized
gcgcauccugccagaaca

SEQ ID NO: 20420 - RNA, 18 nt, artificial
  Chemically synthesized
gaccagggcugcaacagc

SEQ ID NO: 20421 - RNA, 18 nt, artificial
  Chemically synthesized
cuggcagacccacaccca

SEQ ID NO: 20422 - RNA, 18 nt, artificial
  Chemically synthesized
ggcgccagccugcacaac

SEQ ID NO: 20423 - RNA, 18 nt, artificial
  Chemically synthesized
cacagaaacacugccuuu

SEQ ID NO: 20424 - RNA, 18 nt, artificial
  Chemically synthesized
gguucaucugcaagugcc

SEQ ID NO: 20425 - RNA, 18 nt, artificial
  Chemically synthesized
guauagccuauggcagaa

SEQ ID NO: 20426 - RNA, 18 nt, artificial
  Chemically synthesized
cacgccugacugcacaga

SEQ ID NO: 20427 - RNA, 18 nt, artificial
  Chemically synthesized
cauggacgacaaccagaa

SEQ ID NO: 20428 - RNA, 18 nt, artificial
  Chemically synthesized
uggacugugcggagcaug

SEQ ID NO: 20429 - RNA, 18 nt, artificial
  Chemically synthesized
guuuuguaggagacuugc

SEQ ID NO: 20430 - RNA, 18 nt, artificial
  Chemically synthesized
caucugugccaguacgau

SEQ ID NO: 20431 - RNA, 18 nt, artificial
  Chemically synthesized
gugugucaugccagugag

SEQ ID NO: 20432 - RNA, 18 nt, artificial
  Chemically synthesized
cggaggcaccugccacaa

SEQ ID NO: 20433 - RNA, 18 nt, artificial
  Chemically synthesized
gacaucaacgagugcguu

SEQ ID NO: 20434 - RNA, 18 nt, artificial
  Chemically synthesized
ccuggaugccgcugaccu

SEQ ID NO: 20435 - RNA, 18 nt, artificial
  Chemically synthesized
gaucaaccuggaugacug

SEQ ID NO: 20436 - RNA, 18 nt, artificial
  Chemically synthesized
ggcggccaagcccgagau

SEQ ID NO: 20437 - RNA, 18 nt, artificial
  Chemically synthesized
gcaagugcaucaacacgc

SEQ ID NO: 20438 - RNA, 18 nt, artificial
  Chemically synthesized
gggcugcguccuuugguc

SEQ ID NO: 20439 - RNA, 18 nt, artificial
  Chemically synthesized
gcuggcaagggcagaccu

SEQ ID NO: 20440 - RNA, 18 nt, artificial
  Chemically synthesized
cagacccacacccaguac

SEQ ID NO: 20441 - RNA, 18 nt, artificial
  Chemically synthesized
cugcagugcaacaaccac

SEQ ID NO: 20442 - RNA, 18 nt, artificial
  Chemically synthesized
gccgcugcccgccagagu

SEQ ID NO: 20443 - RNA, 18 nt, artificial
  Chemically synthesized
agggcagcuacgagaccg

SEQ ID NO: 20444 - RNA, 18 nt, artificial
  Chemically synthesized
cccaacugcgagaucaac

SEQ ID NO: 20445 - RNA, 18 nt, artificial
  Chemically synthesized
ugagauguguggacugug

SEQ ID NO: 20446 - RNA, 18 nt, artificial
  Chemically synthesized
cgaggucaacacagacga

SEQ ID NO: 20447 - RNA, 18 nt, artificial
  Chemically synthesized
cugggcagccucaacauc

SEQ ID NO: 20448 - RNA, 18 nt, artificial
  Chemically synthesized
caacugccagaccaacau

SEQ ID NO: 20449 - RNA, 18 nt, artificial
  Chemically synthesized
gugggaccaacugugaca

SEQ ID NO: 20450 - RNA, 18 nt, artificial
  Chemically synthesized
ggcaacaaggucugcagc

SEQ ID NO: 20451 - RNA, 18 nt, artificial
  Chemically synthesized
ccuauggcagaaaaaaug

SEQ ID NO: 20452 - RNA, 18 nt, artificial
  Chemically synthesized
ggcacguguauugacgac

SEQ ID NO: 20453 - RNA, 18 nt, artificial
  Chemically synthesized
cugugagaucaacgugga

SEQ ID NO: 20454 - RNA, 18 nt, artificial
  Chemically synthesized
agcugcacuucauguacg

SEQ ID NO: 20455 - RNA, 18 nt, artificial
  Chemically synthesized
cggccgucaucuccgacu

SEQ ID NO: 20456 - RNA, 18 nt, artificial
  Chemically synthesized
gcugcaugcggcuguguc

SEQ ID NO: 20457 - RNA, 18 nt, artificial
  Chemically synthesized
guguuuuagaugguuucu

SEQ ID NO: 20458 - RNA, 18 nt, artificial
  Chemically synthesized
aaugaaugagucuguugu

SEQ ID NO: 20459 - RNA, 18 nt, artificial
  Chemically synthesized
gcaguugugcuccugaag

SEQ ID NO: 20460 - RNA, 18 nt, artificial
  Chemically synthesized
cgacgcaugcaucagcaa

SEQ ID NO: 20461 - RNA, 18 nt, artificial
  Chemically synthesized
cacuuacaccugugugug

SEQ ID NO: 20462 - RNA, 18 nt, artificial
  Chemically synthesized
gaacugcacgcagucucu

SEQ ID NO: 20463 - RNA, 18 nt, artificial
  Chemically synthesized
gagggacgucagacuugg

SEQ ID NO: 20464 - RNA, 18 nt, artificial
  Chemically synthesized
cgucaacgagugcgucuc

SEQ ID NO: 20465 - RNA, 18 nt, artificial
  Chemically synthesized
ccaagugcuuuaacaacg

SEQ ID NO: 20466 - RNA, 18 nt, artificial
  Chemically synthesized
ggcgggcuacacaggcag

SEQ ID NO: 20467 - RNA, 18 nt, artificial
  Chemically synthesized
uggguggagugggaccaa

SEQ ID NO: 20468 - RNA, 18 nt, artificial
  Chemically synthesized
ggagccuuuuuaaaacac

SEQ ID NO: 20469 - RNA, 18 nt, artificial
  Chemically synthesized
ggacggcugcggcuccua

SEQ ID NO: 20470 - RNA, 18 nt, artificial
  Chemically synthesized
ccuggagauugacaaccg

SEQ ID NO: 20471 - RNA, 18 nt, artificial
  Chemically synthesized
agccgcaccuuggcguga

SEQ ID NO: 20472 - RNA, 18 nt, artificial
  Chemically synthesized
cugaauggcgggaagugu

SEQ ID NO: 20473 - RNA, 18 nt, artificial
  Chemically synthesized
gaaguacuucagugacgg

SEQ ID NO: 20474 - RNA, 18 nt, artificial
  Chemically synthesized
gcuccuucgagugccagu

SEQ ID NO: 20475 - RNA, 18 nt, artificial
  Chemically synthesized
uggagaccaagaaguucc

SEQ ID NO: 20476 - RNA, 18 nt, artificial
  Chemically synthesized
agaguggacaggucagua

SEQ ID NO: 20477 - RNA, 18 nt, artificial
  Chemically synthesized
aguguguaugccaagagu

SEQ ID NO: 20478 - RNA, 18 nt, artificial
  Chemically synthesized
gucugaaccagggcacgu

SEQ ID NO: 20479 - RNA, 18 nt, artificial
  Chemically synthesized
gcaccugccgggagggcu

SEQ ID NO: 20480 - RNA, 18 nt, artificial
  Chemically synthesized
auccaacccuugugucaa

SEQ ID NO: 20481 - RNA, 18 nt, artificial
  Chemically synthesized
gcuuccugaguggagagc

SEQ ID NO: 20482 - RNA, 18 nt, artificial
  Chemically synthesized
caaccagacagaccgcac

SEQ ID NO: 20483 - RNA, 18 nt, artificial
  Chemically synthesized
gggaccacaggacccaac

SEQ ID NO: 20484 - RNA, 18 nt, artificial
  Chemically synthesized
agauaugcagaacaacag

SEQ ID NO: 20485 - RNA, 18 nt, artificial
  Chemically synthesized
agugcuccagccagcccu

SEQ ID NO: 20486 - RNA, 18 nt, artificial
  Chemically synthesized
cgugcagcgcgucaauga

SEQ ID NO: 20487 - RNA, 18 nt, artificial
  Chemically synthesized
gcuucagcggucccaacu

SEQ ID NO: 20488 - RNA, 18 nt, artificial
  Chemically synthesized
ccaccugggccggagcuu

SEQ ID NO: 20489 - RNA, 18 nt, artificial
  Chemically synthesized
gcgagaccgacaucgacg

SEQ ID NO: 20490 - RNA, 18 nt, artificial
  Chemically synthesized
gcacggaaggguacacgg

SEQ ID NO: 20491 - RNA, 18 nt, artificial
  Chemically synthesized
agcaaagccugcagccgc

SEQ ID NO: 20492 - RNA, 18 nt, artificial
  Chemically synthesized
aguggacaggucaguacu

SEQ ID NO: 20493 - RNA, 18 nt, artificial
  Chemically synthesized
aguauagccuauggcaga

SEQ ID NO: 20494 - RNA, 18 nt, artificial
  Chemically synthesized
cguccuuugguccugucc

SEQ ID NO: 20495 - RNA, 18 nt, artificial
  Chemically synthesized
accuggacgaccagacag

SEQ ID NO: 20496 - RNA, 18 nt, artificial
  Chemically synthesized
aguugaacgagcauaguc

SEQ ID NO: 20497 - RNA, 18 nt, artificial
  Chemically synthesized
gacgucacccacgagugu

SEQ ID NO: 20498 - RNA, 18 nt, artificial
  Chemically synthesized
gcuucgagggcgccacgu

SEQ ID NO: 20499 - RNA, 18 nt, artificial
  Chemically synthesized
gaagaacugcacgcaguc

SEQ ID NO: 20500 - RNA, 18 nt, artificial
  Chemically synthesized
gcugggcagccucaacau

SEQ ID NO: 20501 - RNA, 18 nt, artificial
  Chemically synthesized
agcugaugccaaaugccu

SEQ ID NO: 20502 - RNA, 18 nt, artificial
  Chemically synthesized
cgagugccagugucugca

SEQ ID NO: 20503 - RNA, 18 nt, artificial
  Chemically synthesized
ggcugcgcagcgacaagg

SEQ ID NO: 20504 - RNA, 18 nt, artificial
  Chemically synthesized
ggaguguguaugccaaga

SEQ ID NO: 20505 - RNA, 18 nt, artificial
  Chemically synthesized
gacgucaacgagugcguc

SEQ ID NO: 20506 - RNA, 18 nt, artificial
  Chemically synthesized
ggcaagggcugccugcug

SEQ ID NO: 20507 - RNA, 18 nt, artificial
  Chemically synthesized
uggcaagggcagaccugu

SEQ ID NO: 20508 - RNA, 18 nt, artificial
  Chemically synthesized
caacgagugcuccagcca

SEQ ID NO: 20509 - RNA, 18 nt, artificial
  Chemically synthesized
cuguugugugucaugcca

SEQ ID NO: 20510 - RNA, 18 nt, artificial
  Chemically synthesized
acgucaacgccguagaug

SEQ ID NO: 20511 - RNA, 18 nt, artificial
  Chemically synthesized
ggagcgcaugcaucacga

SEQ ID NO: 20512 - RNA, 18 nt, artificial
  Chemically synthesized
agaugcuccagcaacaca

SEQ ID NO: 20513 - RNA, 18 nt, artificial
  Chemically synthesized
accugugugugcacggaa

SEQ ID NO: 20514 - RNA, 18 nt, artificial
  Chemically synthesized
ccagaacgacgccaccug

SEQ ID NO: 20515 - RNA, 18 nt, artificial
  Chemically synthesized
ggccagcgcagaugccaa

SEQ ID NO: 20516 - RNA, 18 nt, artificial
  Chemically synthesized
agugagaccguggagccg

SEQ ID NO: 20517 - RNA, 18 nt, artificial
  Chemically synthesized
ggaggcaccugccacaac

SEQ ID NO: 20518 - RNA, 18 nt, artificial
  Chemically synthesized
ccggcacgcugguggugg

SEQ ID NO: 20519 - RNA, 18 nt, artificial
  Chemically synthesized
caagaauggugccaagug

SEQ ID NO: 20520 - RNA, 18 nt, artificial
  Chemically synthesized
ggcacgacgccacugauc

SEQ ID NO: 20521 - RNA, 18 nt, artificial
  Chemically synthesized
cuggagacgggcaacagc

SEQ ID NO: 20522 - RNA, 18 nt, artificial
  Chemically synthesized
cgcugcacaguagccuug

SEQ ID NO: 20523 - RNA, 18 nt, artificial
  Chemically synthesized
ggcucuguguggacgcgg

SEQ ID NO: 20524 - RNA, 18 nt, artificial
  Chemically synthesized
gcugcgaguccgucauca

SEQ ID NO: 20525 - RNA, 18 nt, artificial
  Chemically synthesized
cugccgacgcacaaggug

SEQ ID NO: 20526 - RNA, 18 nt, artificial
  Chemically synthesized
ggugccgaaccaauacaa

SEQ ID NO: 20527 - RNA, 18 nt, artificial
  Chemically synthesized
acgaggaccuggagacca

SEQ ID NO: 20528 - RNA, 18 nt, artificial
  Chemically synthesized
cggcggcaccugcaaaga

SEQ ID NO: 20529 - RNA, 18 nt, artificial
  Chemically synthesized
guacuucagugacggcca

SEQ ID NO: 20530 - RNA, 18 nt, artificial
  Chemically synthesized
gcacagagagcuccugcu

SEQ ID NO: 20531 - RNA, 18 nt, artificial
  Chemically synthesized
ugacaucaacaacaauga

SEQ ID NO: 20532 - RNA, 18 nt, artificial
  Chemically synthesized
gaggacuaugagagcuuc

SEQ ID NO: 20533 - RNA, 18 nt, artificial
  Chemically synthesized
ugcagcgagaacauugau

SEQ ID NO: 20534 - RNA, 18 nt, artificial
  Chemically synthesized
agugugcguccaacccau

SEQ ID NO: 20535 - RNA, 18 nt, artificial
  Chemically synthesized
ugacgacguugccgggua

SEQ ID NO: 20536 - RNA, 18 nt, artificial
  Chemically synthesized
cggaguacaagugccgcu

SEQ ID NO: 20537 - RNA, 18 nt, artificial
  Chemically synthesized
ggccgccuuugugcuucu

SEQ ID NO: 20538 - RNA, 18 nt, artificial
  Chemically synthesized
gggcugcaacagcgcgga

SEQ ID NO: 20539 - RNA, 18 nt, artificial
  Chemically synthesized
gcuacucacgcucugaug

SEQ ID NO: 20540 - RNA, 18 nt, artificial
  Chemically synthesized
acccaugguaccaaucau

SEQ ID NO: 20541 - RNA, 18 nt, artificial
  Chemically synthesized
accugucuggacaagauc

SEQ ID NO: 20542 - RNA, 18 nt, artificial
  Chemically synthesized
cucccagcccggugagac

SEQ ID NO: 20543 - RNA, 18 nt, artificial
  Chemically synthesized
uccuucuacugcgagugu

SEQ ID NO: 20544 - RNA, 18 nt, artificial
  Chemically synthesized
augauguuggagaaggga

SEQ ID NO: 20545 - RNA, 18 nt, artificial
  Chemically synthesized
guccaacccaugucugaa

SEQ ID NO: 20546 - RNA, 18 nt, artificial
  Chemically synthesized
cguccugggcuccagcag

SEQ ID NO: 20547 - RNA, 18 nt, artificial
  Chemically synthesized
gcacugugagaucaacgu

SEQ ID NO: 20548 - RNA, 18 nt, artificial
  Chemically synthesized
gaugagugcucgcugggu

SEQ ID NO: 20549 - RNA, 18 nt, artificial
  Chemically synthesized
ugaggucgacaucaacga

SEQ ID NO: 20550 - RNA, 18 nt, artificial
  Chemically synthesized
ggcuucagcgggauccac

SEQ ID NO: 20551 - RNA, 18 nt, artificial
  Chemically synthesized
ccguguuuuguaggagac

SEQ ID NO: 20552 - RNA, 18 nt, artificial
  Chemically synthesized
gaaacaacugcaagaacg

SEQ ID NO: 20553 - RNA, 18 nt, artificial
  Chemically synthesized
cgagugccgugcugguca

SEQ ID NO: 20554 - RNA, 18 nt, artificial
  Chemically synthesized
caggcagacgugcagcca

SEQ ID NO: 20555 - RNA, 18 nt, artificial
  Chemically synthesized
caugaccaguggcuacgu

SEQ ID NO: 20556 - RNA, 18 nt, artificial
  Chemically synthesized
gucaacacagacgagugu

SEQ ID NO: 20557 - RNA, 18 nt, artificial
  Chemically synthesized
ggaggaagaagucccagg

SEQ ID NO: 20558 - RNA, 18 nt, artificial
  Chemically synthesized
ggugccaagugccuggac

SEQ ID NO: 20559 - RNA, 18 nt, artificial
  Chemically synthesized
cagccugcgcugccucaa

SEQ ID NO: 20560 - RNA, 18 nt, artificial
  Chemically synthesized
cauccucgcuggucccac

SEQ ID NO: 20561 - RNA, 18 nt, artificial
  Chemically synthesized
ucggaguguguaugccaa

SEQ ID NO: 20562 - RNA, 18 nt, artificial
  Chemically synthesized
guggcuacgugugcaccu

SEQ ID NO: 20563 - RNA, 18 nt, artificial
  Chemically synthesized
gacccuggguggaguggg

SEQ ID NO: 20564 - RNA, 18 nt, artificial
  Chemically synthesized
cguggaugagugcucgcu

SEQ ID NO: 20565 - RNA, 18 nt, artificial
  Chemically synthesized
cgacaucaacgagugcgu

SEQ ID NO: 20566 - RNA, 18 nt, artificial
  Chemically synthesized
agccucaacggguacaag

SEQ ID NO: 20567 - RNA, 18 nt, artificial
  Chemically synthesized
gcacgcagucucugcagu

SEQ ID NO: 20568 - RNA, 18 nt, artificial
  Chemically synthesized
cucgcagugcuuccagag

SEQ ID NO: 20569 - RNA, 18 nt, artificial
  Chemically synthesized
gcagacccacacccagua

SEQ ID NO: 20570 - RNA, 18 nt, artificial
  Chemically synthesized
agauugacaaccggcagu

SEQ ID NO: 20571 - RNA, 18 nt, artificial
  Chemically synthesized
cgccugacugcacagaga

SEQ ID NO: 20572 - RNA, 18 nt, artificial
  Chemically synthesized
cgagguggacaucgauga

SEQ ID NO: 20573 - RNA, 18 nt, artificial
  Chemically synthesized
ccauggccgcacaggucu

SEQ ID NO: 20574 - RNA, 18 nt, artificial
  Chemically synthesized
gaugucaaugagugcgac

SEQ ID NO: 20575 - RNA, 18 nt, artificial
  Chemically synthesized
gccgugaacaauguggau

SEQ ID NO: 20576 - RNA, 18 nt, artificial
  Chemically synthesized
cagcccaguuccugacgc

SEQ ID NO: 20577 - RNA, 18 nt, artificial
  Chemically synthesized
acgagcauaguccaaaaa

SEQ ID NO: 20578 - RNA, 18 nt, artificial
  Chemically synthesized
auggcuaccugucagacg

SEQ ID NO: 20579 - RNA, 18 nt, artificial
  Chemically synthesized
ugcucacgcugacggagu

SEQ ID NO: 20580 - RNA, 18 nt, artificial
  Chemically synthesized
gagaucgacgucaacgag

SEQ ID NO: 20581 - RNA, 18 nt, artificial
  Chemically synthesized
gccagcugaugccaaaug

SEQ ID NO: 20582 - RNA, 18 nt, artificial
  Chemically synthesized
ggacgaggaccuggagac

SEQ ID NO: 20583 - RNA, 18 nt, artificial
  Chemically synthesized
gaagaugcuccagcaaca

SEQ ID NO: 20584 - RNA, 18 nt, artificial
  Chemically synthesized
gacgagugccucucccac

SEQ ID NO: 20585 - RNA, 18 nt, artificial
  Chemically synthesized
aggugcugcuggaccacu

SEQ ID NO: 20586 - RNA, 18 nt, artificial
  Chemically synthesized
guuccagugcaucugcau

SEQ ID NO: 20587 - RNA, 18 nt, artificial
  Chemically synthesized
uggacaggucaguacugu

SEQ ID NO: 20588 - RNA, 18 nt, artificial
  Chemically synthesized
gcaugcuggaggaccuca

SEQ ID NO: 20589 - RNA, 18 nt, artificial
  Chemically synthesized
agauaugcagaacaacag

SEQ ID NO: 20590 - RNA, 18 nt, artificial
  Chemically synthesized
gggcucccguguuuugua

SEQ ID NO: 20591 - RNA, 18 nt, artificial
  Chemically synthesized
cgacgagugccucuccca

SEQ ID NO: 20592 - RNA, 18 nt, artificial
  Chemically synthesized
cuaccagggcgccagccu

SEQ ID NO: 20593 - RNA, 18 nt, artificial
  Chemically synthesized
cugcgcagcgacaaggug

SEQ ID NO: 20594 - RNA, 18 nt, artificial
  Chemically synthesized
ccggcugcagagcggcau

SEQ ID NO: 20595 - RNA, 18 nt, artificial
  Chemically synthesized
ucuuaaugaaugagucug

SEQ ID NO: 20596 - RNA, 18 nt, artificial
  Chemically synthesized
ggacguggaugagugcuc

SEQ ID NO: 20597 - RNA, 18 nt, artificial
  Chemically synthesized
agaucgacgagugccucu

SEQ ID NO: 20598 - RNA, 18 nt, artificial
  Chemically synthesized
ggcggagggagcuggacc

SEQ ID NO: 20599 - RNA, 18 nt, artificial
  Chemically synthesized
gcgggaccugccacaaca

SEQ ID NO: 20600 - RNA, 18 nt, artificial
  Chemically synthesized
gcucacgcugacggagua

SEQ ID NO: 20601 - RNA, 18 nt, artificial
  Chemically synthesized
ugcaauaccaaguauagc

SEQ ID NO: 20602 - RNA, 18 nt, artificial
  Chemically synthesized
gccgaccagaggagccuu

SEQ ID NO: 20603 - RNA, 18 nt, artificial
  Chemically synthesized
gcacggacugcguggaca

SEQ ID NO: 20604 - RNA, 18 nt, artificial
  Chemically synthesized
gcggagugcgagugggac

SEQ ID NO: 20605 - RNA, 18 nt, artificial
  Chemically synthesized
cacagagagcuccugcuu

SEQ ID NO: 20606 - RNA, 18 nt, artificial
  Chemically synthesized
ggaggcaaagcuggcuca

SEQ ID NO: 20607 - RNA, 18 nt, artificial
  Chemically synthesized
cgcggagugcgaguggga

SEQ ID NO: 20608 - RNA, 18 nt, artificial
  Chemically synthesized
gucaaugcgaguggcugu

SEQ ID NO: 20609 - RNA, 18 nt, artificial
  Chemically synthesized
gagugagaccguggagcc

SEQ ID NO: 20610 - RNA, 18 nt, artificial
  Chemically synthesized
acgagaccgccaaggugc

SEQ ID NO: 20611 - RNA, 18 nt, artificial
  Chemically synthesized
gagaccgccuugcaccug

SEQ ID NO: 20612 - RNA, 18 nt, artificial
  Chemically synthesized
ugaggucaaugagugcaa

SEQ ID NO: 20613 - RNA, 18 nt, artificial
  Chemically synthesized
cggguucaucugcaagug

SEQ ID NO: 20614 - RNA, 18 nt, artificial
  Chemically synthesized
ccaguggcuacgugugca

SEQ ID NO: 20615 - RNA, 18 nt, artificial
  Chemically synthesized
gccagugcaacucagccg

SEQ ID NO: 20616 - RNA, 18 nt, artificial
  Chemically synthesized
caucaacgagugcguucu

SEQ ID NO: 20617 - RNA, 18 nt, artificial
  Chemically synthesized
gcgcaacugcgagaccga

SEQ ID NO: 20618 - RNA, 18 nt, artificial
  Chemically synthesized
acgaguacaaccuggugc

SEQ ID NO: 20619 - RNA, 18 nt, artificial
  Chemically synthesized
ggccacugugacagccag

SEQ ID NO: 20620 - RNA, 18 nt, artificial
  Chemically synthesized
cagcaugcagucccagau

SEQ ID NO: 20621 - RNA, 18 nt, artificial
  Chemically synthesized
cggcuucacgggcagcua

SEQ ID NO: 20622 - RNA, 18 nt, artificial
  Chemically synthesized
caacugcgagaccgacau

SEQ ID NO: 20623 - RNA, 18 nt, artificial
  Chemically synthesized
gcaacagcgcggagugcg

SEQ ID NO: 20624 - RNA, 18 nt, artificial
  Chemically synthesized
gacggacccaacacuuac

SEQ ID NO: 20625 - RNA, 18 nt, artificial
  Chemically synthesized
gcgucugugugcgcucug

SEQ ID NO: 20626 - RNA, 18 nt, artificial
  Chemically synthesized
ugcacaaccagacagacc

SEQ ID NO: 20627 - RNA, 18 nt, artificial
  Chemically synthesized
ggccuccuucuacugcga

SEQ ID NO: 20628 - RNA, 18 nt, artificial
  Chemically synthesized
ggcuucacgggcagcuac

SEQ ID NO: 20629 - RNA, 18 nt, artificial
  Chemically synthesized
gcggcagcauggccagcu

SEQ ID NO: 20630 - RNA, 18 nt, artificial
  Chemically synthesized
gaguuccagugcgagugc

SEQ ID NO: 20631 - RNA, 18 nt, artificial
  Chemically synthesized
ggccguggagggcaugcu

SEQ ID NO: 20632 - RNA, 18 nt, artificial
  Chemically synthesized
gagugugccugugagccg

SEQ ID NO: 20633 - RNA, 18 nt, artificial
  Chemically synthesized
gaacauugaugacugugc

SEQ ID NO: 20634 - RNA, 18 nt, artificial
  Chemically synthesized
gcccgcagcugcacggag

SEQ ID NO: 20635 - RNA, 18 nt, artificial
  Chemically synthesized
cuaccugggcagccucaa

SEQ ID NO: 20636 - RNA, 18 nt, artificial
  Chemically synthesized
ccgcauuccugggagcgc

SEQ ID NO: 20637 - RNA, 18 nt, artificial
  Chemically synthesized
caccuuccgcacgcggau

SEQ ID NO: 20638 - RNA, 18 nt, artificial
  Chemically synthesized
guggaugagugcucgcug

SEQ ID NO: 20639 - RNA, 18 nt, artificial
  Chemically synthesized
guggcacccagaacugcg

SEQ ID NO: 20640 - RNA, 18 nt, artificial
  Chemically synthesized
ggucccaacugccagacc

SEQ ID NO: 20641 - RNA, 18 nt, artificial
  Chemically synthesized
cguccugggcuccagcag

SEQ ID NO: 20642 - RNA, 18 nt, artificial
  Chemically synthesized
ccuggaugacugugccag

SEQ ID NO: 20643 - RNA, 18 nt, artificial
  Chemically synthesized
ggccgucaucuccgacuu

SEQ ID NO: 20644 - RNA, 18 nt, artificial
  Chemically synthesized
cacuuucugugaggagga

SEQ ID NO: 20645 - RNA, 18 nt, artificial
  Chemically synthesized
cccucaaccaccugccug

SEQ ID NO: 20646 - RNA, 18 nt, artificial
  Chemically synthesized
gaccgcagcccaguuccu

SEQ ID NO: 20647 - RNA, 18 nt, artificial
  Chemically synthesized
gccaccaccaccaccaca

SEQ ID NO: 20648 - RNA, 18 nt, artificial
  Chemically synthesized
caagaucgauggcuacga

SEQ ID NO: 20649 - RNA, 18 nt, artificial
  Chemically synthesized
ugaccagaugcgucccaa

SEQ ID NO: 20650 - RNA, 18 nt, artificial
  Chemically synthesized
gggcccugaauuucacug

SEQ ID NO: 20651 - RNA, 18 nt, artificial
  Chemically synthesized
gagugugccugccugcca

SEQ ID NO: 20652 - RNA, 18 nt, artificial
  Chemically synthesized
ccgcgugcugcacaccaa

SEQ ID NO: 20653 - RNA, 18 nt, artificial
  Chemically synthesized
ccagcgugcggaaggcca

SEQ ID NO: 20654 - RNA, 18 nt, artificial
  Chemically synthesized
cagaugcagcagcagaac

SEQ ID NO: 20655 - RNA, 18 nt, artificial
  Chemically synthesized
guuaggagaagcugcauc

SEQ ID NO: 20656 - RNA, 18 nt, artificial
  Chemically synthesized
ccagcagucuccguccgu

SEQ ID NO: 20657 - RNA, 18 nt, artificial
  Chemically synthesized
ccuggacaaugccugccu

SEQ ID NO: 20658 - RNA, 18 nt, artificial
  Chemically synthesized
cggccacugugacagcca

SEQ ID NO: 20659 - RNA, 18 nt, artificial
  Chemically synthesized
ggccuuuacugcgacgug

SEQ ID NO: 20660 - RNA, 18 nt, artificial
  Chemically synthesized
acaucaacgagugugcgu

SEQ ID NO: 20661 - RNA, 18 nt, artificial
  Chemically synthesized
gcuacugccagcacgaug

SEQ ID NO: 20662 - RNA, 18 nt, artificial
  Chemically synthesized
gguggcuacaacugcgug

SEQ ID NO: 20663 - RNA, 18 nt, artificial
  Chemically synthesized
gcuggaccggccuuuacu

SEQ ID NO: 20664 - RNA, 18 nt, artificial
  Chemically synthesized
gcaccugcgccguggccu

SEQ ID NO: 20665 - RNA, 18 nt, artificial
  Chemically synthesized
acaucaacgagugcucca

SEQ ID NO: 20666 - RNA, 18 nt, artificial
  Chemically synthesized
gccagaacacccacggcg

SEQ ID NO: 20667 - RNA, 18 nt, artificial
  Chemically synthesized
cgcugggcuccuucgagu

SEQ ID NO: 20668 - RNA, 18 nt, artificial
  Chemically synthesized
aagaagaugcuccagcaa

SEQ ID NO: 20669 - RNA, 18 nt, artificial
  Chemically synthesized
cugcacaaccagacagac

SEQ ID NO: 20670 - RNA, 18 nt, artificial
  Chemically synthesized
cguggcacccagaacugc

SEQ ID NO: 20671 - RNA, 18 nt, artificial
  Chemically synthesized
ggcuacgagggugugcac

SEQ ID NO: 20672 - RNA, 18 nt, artificial
  Chemically synthesized
caaugagugcgacucaca

SEQ ID NO: 20673 - RNA, 18 nt, artificial
  Chemically synthesized
agugcgacucacagcccu

SEQ ID NO: 20674 - RNA, 18 nt, artificial
  Chemically synthesized
cauauggguuagauguug

SEQ ID NO: 20675 - RNA, 18 nt, artificial
  Chemically synthesized
gagagccgagccaggcag

SEQ ID NO: 20676 - RNA, 18 nt, artificial
  Chemically synthesized
gccacgugguggaccgca

SEQ ID NO: 20677 - RNA, 18 nt, artificial
  Chemically synthesized
cgagugcguucugagccc

SEQ ID NO: 20678 - RNA, 18 nt, artificial
  Chemically synthesized
gccgugggcugcguccuu

SEQ ID NO: 20679 - RNA, 18 nt, artificial
  Chemically synthesized
cgcacgcggauuaauuug

SEQ ID NO: 20680 - RNA, 18 nt, artificial
  Chemically synthesized
gcgggagcucagccgcgu

SEQ ID NO: 20681 - RNA, 18 nt, artificial
  Chemically synthesized
uggucaaugcgaguggcu

SEQ ID NO: 20682 - RNA, 18 nt, artificial
  Chemically synthesized
aggagaucgacgagugcc

SEQ ID NO: 20683 - RNA, 18 nt, artificial
  Chemically synthesized
caacagcgcggagugcga

SEQ ID NO: 20684 - RNA, 18 nt, artificial
  Chemically synthesized
cugugaggaggacaucaa

SEQ ID NO: 20685 - RNA, 18 nt, artificial
  Chemically synthesized
caacugcgagaucaaccu

SEQ ID NO: 20686 - RNA, 18 nt, artificial
  Chemically synthesized
ccgcucugcucgcccaac

SEQ ID NO: 20687 - RNA, 18 nt, artificial
  Chemically synthesized
ugugcacugugagaucaa

SEQ ID NO: 20688 - RNA, 18 nt, artificial
  Chemically synthesized
uaugagagcuucuccugu

SEQ ID NO: 20689 - RNA, 18 nt, artificial
  Chemically synthesized
ccugaagaacgcuucaga

SEQ ID NO: 20690 - RNA, 18 nt, artificial
  Chemically synthesized
cgacaaccagaaugagug

SEQ ID NO: 20691 - RNA, 18 nt, artificial
  Chemically synthesized
aaguauagccuauggcag

SEQ ID NO: 20692 - RNA, 18 nt, artificial
  Chemically synthesized
gcacauugagcugugcaa

SEQ ID NO: 20693 - RNA, 18 nt, artificial
  Chemically synthesized
cuccucgcccugcaagaa

SEQ ID NO: 20694 - RNA, 18 nt, artificial
  Chemically synthesized
ugggcugcguccuuuggu

SEQ ID NO: 20695 - RNA, 18 nt, artificial
  Chemically synthesized
ggcuggacugugcggagc

SEQ ID NO: 20696 - RNA, 18 nt, artificial
  Chemically synthesized
cagcaaacauccagcagc

SEQ ID NO: 20697 - RNA, 18 nt, artificial
  Chemically synthesized
caacaaggucugcagccu

SEQ ID NO: 20698 - RNA, 18 nt, artificial
  Chemically synthesized
cagcagaaccugcagcca

SEQ ID NO: 20699 - RNA, 18 nt, artificial
  Chemically synthesized
augguaccaaucaugaau

SEQ ID NO: 20700 - RNA, 18 nt, artificial
  Chemically synthesized
ucaacgagugcguucuga

SEQ ID NO: 20701 - RNA, 18 nt, artificial
  Chemically synthesized
cagacggcaucaacacgg

SEQ ID NO: 20702 - RNA, 18 nt, artificial
  Chemically synthesized
caccucagccugcacagu

SEQ ID NO: 20703 - RNA, 18 nt, artificial
  Chemically synthesized
gaccuggacgaccagaca

SEQ ID NO: 20704 - RNA, 18 nt, artificial
  Chemically synthesized
uccaccaguuugaauggu

SEQ ID NO: 20705 - RNA, 18 nt, artificial
  Chemically synthesized
uggacgagugcucaccca

SEQ ID NO: 20706 - RNA, 18 nt, artificial
  Chemically synthesized
auccugauccggaaccga

SEQ ID NO: 20707 - RNA, 18 nt, artificial
  Chemically synthesized
acugugagaacaacacgc

SEQ ID NO: 20708 - RNA, 18 nt, artificial
  Chemically synthesized
agaugaccugggcaaguc

SEQ ID NO: 20709 - RNA, 18 nt, artificial
  Chemically synthesized
ccgaccagaggagccuuu

SEQ ID NO: 20710 - RNA, 18 nt, artificial
  Chemically synthesized
aagcaugcuugugaaaau

SEQ ID NO: 20711 - RNA, 18 nt, artificial
  Chemically synthesized
gcaaacggaggcaaagcu

SEQ ID NO: 20712 - RNA, 18 nt, artificial
  Chemically synthesized
ggcgggaccugccacaac

SEQ ID NO: 20713 - RNA, 18 nt, artificial
  Chemically synthesized
ugcagugcuggaaguacu

SEQ ID NO: 20714 - RNA, 18 nt, artificial
  Chemically synthesized
gccgcguggugccauccc

SEQ ID NO: 20715 - RNA, 18 nt, artificial
  Chemically synthesized
ccuuccgcacgcggauua

SEQ ID NO: 20716 - RNA, 18 nt, artificial
  Chemically synthesized
cacccagccucaccuggu

SEQ ID NO: 20717 - RNA, 18 nt, artificial
  Chemically synthesized
gcuggacagcuccggcau

SEQ ID NO: 20718 - RNA, 18 nt, artificial
  Chemically synthesized
acugugacaucaacaaca

SEQ ID NO: 20719 - RNA, 18 nt, artificial
  Chemically synthesized
gccuuagccgcccaugca

SEQ ID NO: 20720 - RNA, 18 nt, artificial
  Chemically synthesized
acccaguaccgcugcgag

SEQ ID NO: 20721 - RNA, 18 nt, artificial
  Chemically synthesized
ggaggaccucaucaacuc

SEQ ID NO: 20722 - RNA, 18 nt, artificial
  Chemically synthesized
uuguuucagguucaguau

SEQ ID NO: 20723 - RNA, 18 nt, artificial
  Chemically synthesized
ccaccagcaugcaguccc

SEQ ID NO: 20724 - RNA, 18 nt, artificial
  Chemically synthesized
cacugcgaggucaacaca

SEQ ID NO: 20725 - RNA, 18 nt, artificial
  Chemically synthesized
ccuggacaagaucaauga

SEQ ID NO: 20726 - RNA, 18 nt, artificial
  Chemically synthesized
agcaccucagccugcaca

SEQ ID NO: 20727 - RNA, 18 nt, artificial
  Chemically synthesized
ccacugugacagccagug

SEQ ID NO: 20728 - RNA, 18 nt, artificial
  Chemically synthesized
auggcagaaaaaaugucu

SEQ ID NO: 20729 - RNA, 18 nt, artificial
  Chemically synthesized
cgugaacaccuacaacug

SEQ ID NO: 20730 - RNA, 18 nt, artificial
  Chemically synthesized
ggcacaugcaucuccggc

SEQ ID NO: 20731 - RNA, 18 nt, artificial
  Chemically synthesized
gggccaacugcacggacu

SEQ ID NO: 20732 - RNA, 18 nt, artificial
  Chemically synthesized
gggcuaacaaagauaugc

SEQ ID NO: 20733 - RNA, 18 nt, artificial
  Chemically synthesized
ggaccacuucagcgacgg

SEQ ID NO: 20734 - RNA, 18 nt, artificial
  Chemically synthesized
gcuggacuggugaggacu

SEQ ID NO: 20735 - RNA, 18 nt, artificial
  Chemically synthesized
uacgagaccgccaaggug

SEQ ID NO: 20736 - RNA, 18 nt, artificial
  Chemically synthesized
uaccaaguauagccuaug

SEQ ID NO: 20737 - RNA, 18 nt, artificial
  Chemically synthesized
gcuggaggccagcgcaga

SEQ ID NO: 20738 - RNA, 18 nt, artificial
  Chemically synthesized
uucugagagccaggguuu

SEQ ID NO: 20739 - RNA, 18 nt, artificial
  Chemically synthesized
caguacgauguggacgag

SEQ ID NO: 20740 - RNA, 18 nt, artificial
  Chemically synthesized
gagccaggcagacgugca

SEQ ID NO: 20741 - RNA, 18 nt, artificial
  Chemically synthesized
ccuggaugacugugccag

SEQ ID NO: 20742 - RNA, 18 nt, artificial
  Chemically synthesized
cagggcacguguauugac

SEQ ID NO: 20743 - RNA, 18 nt, artificial
  Chemically synthesized
gaucuacaugaggaacug

SEQ ID NO: 20744 - RNA, 18 nt, artificial
  Chemically synthesized
ggugcagacccagcaggu

SEQ ID NO: 20745 - RNA, 18 nt, artificial
  Chemically synthesized
ccgcaugcaugauggcac

SEQ ID NO: 20746 - RNA, 18 nt, artificial
  Chemically synthesized
gaucgaggaggcgugcga

SEQ ID NO: 20747 - RNA, 18 nt, artificial
  Chemically synthesized
agaacugcgugcagcgcg

SEQ ID NO: 20748 - RNA, 18 nt, artificial
  Chemically synthesized
ggauguggacgagugcca

SEQ ID NO: 20749 - RNA, 18 nt, artificial
  Chemically synthesized
cugcacgcagucucugca

SEQ ID NO: 20750 - RNA, 18 nt, artificial
  Chemically synthesized
accagaugcgucccaaga

SEQ ID NO: 20751 - RNA, 18 nt, artificial
  Chemically synthesized
gcgacaucgcacaggagc

SEQ ID NO: 20752 - RNA, 18 nt, artificial
  Chemically synthesized
ccagggugagguugacgc

SEQ ID NO: 20753 - RNA, 18 nt, artificial
  Chemically synthesized
guugccauguguuuuaga

SEQ ID NO: 20754 - RNA, 18 nt, artificial
  Chemically synthesized
cugcaaaggcaagcccug

SEQ ID NO: 20755 - RNA, 18 nt, artificial
  Chemically synthesized
gggcaccugucuggacaa

SEQ ID NO: 20756 - RNA, 18 nt, artificial
  Chemically synthesized
ccugcaagaacgccggga

SEQ ID NO: 20757 - RNA, 18 nt, artificial
  Chemically synthesized
gggcggcuacuccugcaa

SEQ ID NO: 20758 - RNA, 18 nt, artificial
  Chemically synthesized
gagacgggcaacagcgag

SEQ ID NO: 20759 - RNA, 18 nt, artificial
  Chemically synthesized
auaccaaguauagccuau

SEQ ID NO: 20760 - RNA, 18 nt, artificial
  Chemically synthesized
gccugaauggcgggaagu

SEQ ID NO: 20761 - RNA, 18 nt, artificial
  Chemically synthesized
gggcaacacgcaccacug

SEQ ID NO: 20762 - RNA, 18 nt, artificial
  Chemically synthesized
ccacgagugugccugccu

SEQ ID NO: 20763 - RNA, 18 nt, artificial
  Chemically synthesized
cgugcagggcaagaaggu

SEQ ID NO: 20764 - RNA, 18 nt, artificial
  Chemically synthesized
acaaggugucuuccagau

SEQ ID NO: 20765 - RNA, 18 nt, artificial
  Chemically synthesized
uggaaguacuucagugac

SEQ ID NO: 20766 - RNA, 18 nt, artificial
  Chemically synthesized
gggcaaguccgcccugca

SEQ ID NO: 20767 - RNA, 18 nt, artificial
  Chemically synthesized
cugcgagguggacaucga

SEQ ID NO: 20768 - RNA, 18 nt, artificial
  Chemically synthesized
gcauggacgucaaugucc

SEQ ID NO: 20769 - RNA, 18 nt, artificial
  Chemically synthesized
caggugcagccacaaaac

SEQ ID NO: 20770 - RNA, 18 nt, artificial
  Chemically synthesized
cucccugcagcauggcau

SEQ ID NO: 20771 - RNA, 18 nt, artificial
  Chemically synthesized
acaagcaaguucugagag

SEQ ID NO: 20772 - RNA, 18 nt, artificial
  Chemically synthesized
cgacgucacccacgagug

SEQ ID NO: 20773 - RNA, 18 nt, artificial
  Chemically synthesized
ccucauggacgacaacca

SEQ ID NO: 20774 - RNA, 18 nt, artificial
  Chemically synthesized
ggacagccucaacgggua

SEQ ID NO: 20775 - RNA, 18 nt, artificial
  Chemically synthesized
caaaggcaagcccugcaa

SEQ ID NO: 20776 - RNA, 18 nt, artificial
  Chemically synthesized
gagggcgucuccagcccu

SEQ ID NO: 20777 - RNA, 18 nt, artificial
  Chemically synthesized
ccuggacgaccagacaga

SEQ ID NO: 20778 - RNA, 18 nt, artificial
  Chemically synthesized
gcacucagggugugcacu

SEQ ID NO: 20779 - RNA, 18 nt, artificial
  Chemically synthesized
cgugaccgcagcccaguu

SEQ ID NO: 20780 - RNA, 18 nt, artificial
  Chemically synthesized
gcaaguccgcccugcacu

SEQ ID NO: 20781 - RNA, 18 nt, artificial
  Chemically synthesized
cggcgugaacaccuacaa

SEQ ID NO: 20782 - RNA, 18 nt, artificial
  Chemically synthesized
gugugcaccugccgggag

SEQ ID NO: 20783 - RNA, 18 nt, artificial
  Chemically synthesized
ccagagugccaccgacgu

SEQ ID NO: 20784 - RNA, 18 nt, artificial
  Chemically synthesized
cagccagcaaacauccag

SEQ ID NO: 20785 - RNA, 18 nt, artificial
  Chemically synthesized
cccugucccagaugauga

SEQ ID NO: 20786 - RNA, 18 nt, artificial
  Chemically synthesized
gcguggacggcaucaacu

SEQ ID NO: 20787 - RNA, 18 nt, artificial
  Chemically synthesized
ggaccgcgacaacgccua

SEQ ID NO: 20788 - RNA, 18 nt, artificial
  Chemically synthesized
gucucugcagugcuggaa

SEQ ID NO: 20789 - RNA, 18 nt, artificial
  Chemically synthesized
gccaaggaccucaaggca

SEQ ID NO: 20790 - RNA, 18 nt, artificial
  Chemically synthesized
aggagacuugccagagcc

SEQ ID NO: 20791 - RNA, 18 nt, artificial
  Chemically synthesized
caacgagugcgucucgaa

SEQ ID NO: 20792 - RNA, 18 nt, artificial
  Chemically synthesized
cgagaccaacaucaacga

SEQ ID NO: 20793 - RNA, 18 nt, artificial
  Chemically synthesized
gcacgcggauuaauuugc

SEQ ID NO: 20794 - RNA, 18 nt, artificial
  Chemically synthesized
gugcacugugagaucaac

SEQ ID NO: 20795 - RNA, 18 nt, artificial
  Chemically synthesized
ggacuguggcacuugccu

SEQ ID NO: 20796 - RNA, 18 nt, artificial
  Chemically synthesized
cgggcaacacgcaccacu

SEQ ID NO: 20797 - RNA, 18 nt, artificial
  Chemically synthesized
ccugcacaaccagacaga

SEQ ID NO: 20798 - RNA, 18 nt, artificial
  Chemically synthesized
guggccuccuucuacugc

SEQ ID NO: 20799 - RNA, 18 nt, artificial
  Chemically synthesized
cggcaaaugcuggcagac

SEQ ID NO: 20800 - RNA, 18 nt, artificial
  Chemically synthesized
acgucagacuuggcucag

SEQ ID NO: 20801 - RNA, 18 nt, artificial
  Chemically synthesized
ggcuuugccgccacggag

SEQ ID NO: 20802 - RNA, 18 nt, artificial
  Chemically synthesized
cgccguagaugaccuggg

SEQ ID NO: 20803 - RNA, 18 nt, artificial
  Chemically synthesized
cggacuaccugggcggcu

SEQ ID NO: 20804 - RNA, 18 nt, artificial
  Chemically synthesized
ccggcugccucuucgacg

SEQ ID NO: 20805 - RNA, 18 nt, artificial
  Chemically synthesized
ccuucgaggccuccuaca

SEQ ID NO: 20806 - RNA, 18 nt, artificial
  Chemically synthesized
ggagcucagccgcgugcu

SEQ ID NO: 20807 - RNA, 18 nt, artificial
  Chemically synthesized
cgugccagaacgacgcca

SEQ ID NO: 20808 - RNA, 18 nt, artificial
  Chemically synthesized
cagaccgcacgggcgaga

SEQ ID NO: 20809 - RNA, 18 nt, artificial
  Chemically synthesized
caacgagugccuguccaa

SEQ ID NO: 20810 - RNA, 18 nt, artificial
  Chemically synthesized
ugcucccucaacuucaau

SEQ ID NO: 20811 - RNA, 18 nt, artificial
  Chemically synthesized
gcagugcuggaaguacuu

SEQ ID NO: 20812 - RNA, 18 nt, artificial
  Chemically synthesized
gcacaguagccuugcugc

SEQ ID NO: 20813 - RNA, 18 nt, artificial
  Chemically synthesized
aggccgugcagagugaga

SEQ ID NO: 20814 - RNA, 18 nt, artificial
  Chemically synthesized
cauugaugacugugccag

SEQ ID NO: 20815 - RNA, 18 nt, artificial
  Chemically synthesized
caccggcaguggacucag

SEQ ID NO: 20816 - RNA, 18 nt, artificial
  Chemically synthesized
ccaaauucaacgggcucu

SEQ ID NO: 20817 - RNA, 18 nt, artificial
  Chemically synthesized
cccggcuggucagggaaa

SEQ ID NO: 20818 - RNA, 18 nt, artificial
  Chemically synthesized
gcgcaacagcuccuucca

SEQ ID NO: 20819 - RNA, 18 nt, artificial
  Chemically synthesized
ccaccucaacgacgcaug

SEQ ID NO: 20820 - RNA, 18 nt, artificial
  Chemically synthesized
gcauccugccagaacacc

SEQ ID NO: 20821 - RNA, 18 nt, artificial
  Chemically synthesized
gaggcguggcagacuaug

SEQ ID NO: 20822 - RNA, 18 nt, artificial
  Chemically synthesized
cccagcaggugcagccac

SEQ ID NO: 20823 - RNA, 18 nt, artificial
  Chemically synthesized
gccgcaccuuggcgugag

SEQ ID NO: 20824 - RNA, 18 nt, artificial
  Chemically synthesized
ccgggagggcagcuacga

SEQ ID NO: 20825 - RNA, 18 nt, artificial
  Chemically synthesized
cguggucuucaagcguga

SEQ ID NO: 20826 - RNA, 18 nt, artificial
  Chemically synthesized
aaaacaagcaaguucuga

SEQ ID NO: 20827 - RNA, 18 nt, artificial
  Chemically synthesized
cacagacgagugugccag

SEQ ID NO: 20828 - RNA, 18 nt, artificial
  Chemically synthesized
acccaacugcgagaucaa

SEQ ID NO: 20829 - RNA, 18 nt, artificial
  Chemically synthesized
cgucaacgccguagauga

SEQ ID NO: 20830 - RNA, 18 nt, artificial
  Chemically synthesized
agugcuuuaacaacggca

SEQ ID NO: 20831 - RNA, 18 nt, artificial
  Chemically synthesized
guguggccuccuucuacu

SEQ ID NO: 20832 - RNA, 18 nt, artificial
  Chemically synthesized
cugcugcccuacacaggu

SEQ ID NO: 20833 - RNA, 18 nt, artificial
  Chemically synthesized
cggagcuuccugagugga

SEQ ID NO: 20834 - RNA, 18 nt, artificial
  Chemically synthesized
gcagcccaguuccugacg

SEQ ID NO: 20835 - RNA, 18 nt, artificial
  Chemically synthesized
gugagaucaacguggacg

SEQ ID NO: 20836 - RNA, 18 nt, artificial
  Chemically synthesized
ccgcccgcggguucaucu

SEQ ID NO: 20837 - RNA, 18 nt, artificial
  Chemically synthesized
ggcuccaacugcgacacc

SEQ ID NO: 20838 - RNA, 18 nt, artificial
  Chemically synthesized
cgacaagguguugacguu

SEQ ID NO: 20839 - RNA, 18 nt, artificial
  Chemically synthesized
gaggagaucgacgagugc

SEQ ID NO: 20840 - RNA, 18 nt, artificial
  Chemically synthesized
caaccuggaugacugugc

SEQ ID NO: 20841 - RNA, 18 nt, artificial
  Chemically synthesized
cccggcuuccuuucccaa

SEQ ID NO: 20842 - RNA, 18 nt, artificial
  Chemically synthesized
ccggcuggucagggaaau

SEQ ID NO: 20843 - RNA, 18 nt, artificial
  Chemically synthesized
gcgcagcugcacuucaug

SEQ ID NO: 20844 - RNA, 18 nt, artificial
  Chemically synthesized
aaaagugaucuacaugag

SEQ ID NO: 20845 - RNA, 18 nt, artificial
  Chemically synthesized
cugaggucaaugagugca

SEQ ID NO: 20846 - RNA, 18 nt, artificial
  Chemically synthesized
ggccagcagaugaucuuc

SEQ ID NO: 20847 - RNA, 18 nt, artificial
  Chemically synthesized
gcaugcaugauggcacga

SEQ ID NO: 20848 - RNA, 18 nt, artificial
  Chemically synthesized
ccugcccguucuugaaau

SEQ ID NO: 20849 - RNA, 18 nt, artificial
  Chemically synthesized
gcaaaggccuggccugug

SEQ ID NO: 20850 - RNA, 18 nt, artificial
  Chemically synthesized
acuucauguacguggcgg

SEQ ID NO: 20851 - RNA, 18 nt, artificial
  Chemically synthesized
ggcuacgagugugccugu

SEQ ID NO: 20852 - RNA, 18 nt, artificial
  Chemically synthesized
gcgggcaagugcaucaac

SEQ ID NO: 20853 - RNA, 18 nt, artificial
  Chemically synthesized
gugucaugccagugaggg

SEQ ID NO: 20854 - RNA, 18 nt, artificial
  Chemically synthesized
cugugaggaaaauaucga

SEQ ID NO: 20855 - RNA, 18 nt, artificial
  Chemically synthesized
cucccugguggcagcgag

SEQ ID NO: 20856 - RNA, 18 nt, artificial
  Chemically synthesized
ccagaugaugagcuacca

SEQ ID NO: 20857 - RNA, 18 nt, artificial
  Chemically synthesized
gauugacaaccggcagug

SEQ ID NO: 20858 - RNA, 18 nt, artificial
  Chemically synthesized
gcuccugcuucaacggug

SEQ ID NO: 20859 - RNA, 18 nt, artificial
  Chemically synthesized
gcuacacaggcagcuacu

SEQ ID NO: 20860 - RNA, 18 nt, artificial
  Chemically synthesized
ccguagaugaccugggca

SEQ ID NO: 20861 - RNA, 18 nt, artificial
  Chemically synthesized
uaggcaucaugcauguca

SEQ ID NO: 20862 - RNA, 18 nt, artificial
  Chemically synthesized
gagaacauugaugacugu

SEQ ID NO: 20863 - RNA, 18 nt, artificial
  Chemically synthesized
uccugaguggagagccga

SEQ ID NO: 20864 - RNA, 18 nt, artificial
  Chemically synthesized
ccgggagggcuucagcgg

SEQ ID NO: 20865 - RNA, 18 nt, artificial
  Chemically synthesized
aguacugcaaggaccacu

SEQ ID NO: 20866 - RNA, 18 nt, artificial
  Chemically synthesized
caaaacuuacagaugcag

SEQ ID NO: 20867 - RNA, 18 nt, artificial
  Chemically synthesized
gaggcugcuggacgagua

SEQ ID NO: 20868 - RNA, 18 nt, artificial
  Chemically synthesized
ugccgacgcacaaggugu

SEQ ID NO: 20869 - RNA, 18 nt, artificial
  Chemically synthesized
caaccggcagugugugca

SEQ ID NO: 20870 - RNA, 18 nt, artificial
  Chemically synthesized
gccugugccagcauggag

SEQ ID NO: 20871 - RNA, 18 nt, artificial
  Chemically synthesized
agcugcauccagaggcaa

SEQ ID NO: 20872 - RNA, 18 nt, artificial
  Chemically synthesized
ggacaaugccugccucac

SEQ ID NO: 20873 - RNA, 18 nt, artificial
  Chemically synthesized
augaguuccagugcgagu

SEQ ID NO: 20874 - RNA, 18 nt, artificial
  Chemically synthesized
gcacgcuggugguggugg

SEQ ID NO: 20875 - RNA, 18 nt, artificial
  Chemically synthesized
guguggacuguggcacuu

SEQ ID NO: 20876 - RNA, 18 nt, artificial
  Chemically synthesized
aguccgucaucaauggcu

SEQ ID NO: 20877 - RNA, 18 nt, artificial
  Chemically synthesized
cgacucgggcaccugucu

SEQ ID NO: 20878 - RNA, 18 nt, artificial
  Chemically synthesized
uggugguggugcugaugc

SEQ ID NO: 20879 - RNA, 18 nt, artificial
  Chemically synthesized
gaguggcugucccggcug

SEQ ID NO: 20880 - RNA, 18 nt, artificial
  Chemically synthesized
ucgcagugcuuccagagu

SEQ ID NO: 20881 - RNA, 18 nt, artificial
  Chemically synthesized
acugcagcgagaacauug

SEQ ID NO: 20882 - RNA, 18 nt, artificial
  Chemically synthesized
cagccagcaaacauccag

SEQ ID NO: 20883 - RNA, 18 nt, artificial
  Chemically synthesized
cgugccgccugcacuccu

SEQ ID NO: 20884 - RNA, 18 nt, artificial
  Chemically synthesized
aggaugucaacgagugug

SEQ ID NO: 20885 - RNA, 18 nt, artificial
  Chemically synthesized
gugaccgcagcccaguuc

SEQ ID NO: 20886 - RNA, 18 nt, artificial
  Chemically synthesized
auuccaacgucuccgacu

SEQ ID NO: 20887 - RNA, 18 nt, artificial
  Chemically synthesized
gggacgggcuggacugug

SEQ ID NO: 20888 - RNA, 18 nt, artificial
  Chemically synthesized
ccugaacguggcggccaa

SEQ ID NO: 20889 - RNA, 18 nt, artificial
  Chemically synthesized
ccaguacugcaaggacca

SEQ ID NO: 20890 - RNA, 18 nt, artificial
  Chemically synthesized
ccgaugcgagaucgacgu

SEQ ID NO: 20891 - RNA, 18 nt, artificial
  Chemically synthesized
ccagcucugguucccuga

SEQ ID NO: 20892 - RNA, 18 nt, artificial
  Chemically synthesized
ggcaacagcgaggaagag

SEQ ID NO: 20893 - RNA, 18 nt, artificial
  Chemically synthesized
cuucuacugcgagugucc

SEQ ID NO: 20894 - RNA, 18 nt, artificial
  Chemically synthesized
gccugcugcccuacacag

SEQ ID NO: 20895 - RNA, 18 nt, artificial
  Chemically synthesized
ggcgggaagugugaagcg

SEQ ID NO: 20896 - RNA, 18 nt, artificial
  Chemically synthesized
cuacagugggcgcaacug

SEQ ID NO: 20897 - RNA, 18 nt, artificial
  Chemically synthesized
agauccugauccggaacc

SEQ ID NO: 20898 - RNA, 18 nt, artificial
  Chemically synthesized
cagugacggccacuguga

SEQ ID NO: 20899 - RNA, 18 nt, artificial
  Chemically synthesized
gagaucgacgagugccuc

SEQ ID NO: 20900 - RNA, 18 nt, artificial
  Chemically synthesized
ggcgccaccugccaugac

SEQ ID NO: 20901 - RNA, 18 nt, artificial
  Chemically synthesized
acgucagacuuggcucag

SEQ ID NO: 20902 - RNA, 18 nt, artificial
  Chemically synthesized
ugcuggacgaguacaacc

SEQ ID NO: 20903 - RNA, 18 nt, artificial
  Chemically synthesized
ggagacuugccagagccg

SEQ ID NO: 20904 - RNA, 18 nt, artificial
  Chemically synthesized
aacgagugcuccagccag

SEQ ID NO: 20905 - RNA, 18 nt, artificial
  Chemically synthesized
gucaucaauggcugcaaa

SEQ ID NO: 20906 - RNA, 18 nt, artificial
  Chemically synthesized
cgacguugccggguacaa

SEQ ID NO: 20907 - RNA, 18 nt, artificial
  Chemically synthesized
gccuggagacgggcaaca

SEQ ID NO: 20908 - RNA, 18 nt, artificial
  Chemically synthesized
ggaugccgcaguugugcu

SEQ ID NO: 20909 - RNA, 18 nt, artificial
  Chemically synthesized
ccugcauggcggcaccug

SEQ ID NO: 20910 - RNA, 18 nt, artificial
  Chemically synthesized
ggcacugcgaccagggcu

SEQ ID NO: 20911 - RNA, 18 nt, artificial
  Chemically synthesized
cacgcagucucugcagug

SEQ ID NO: 20912 - RNA, 18 nt, artificial
  Chemically synthesized
gggcagccucaacauccc

SEQ ID NO: 20913 - RNA, 18 nt, artificial
  Chemically synthesized
ggcuccuacaggugcacc

SEQ ID NO: 20914 - RNA, 18 nt, artificial
  Chemically synthesized
agguccgcaagcccagca

SEQ ID NO: 20915 - RNA, 18 nt, artificial
  Chemically synthesized
agacgugcagccacuggg

SEQ ID NO: 20916 - RNA, 18 nt, artificial
  Chemically synthesized
ggcaucgggcaccugaac

SEQ ID NO: 20917 - RNA, 18 nt, artificial
  Chemically synthesized
cuaacaaagauaugcaga

SEQ ID NO: 20918 - RNA, 18 nt, artificial
  Chemically synthesized
cauugaugacugugccag

SEQ ID NO: 20919 - RNA, 18 nt, artificial
  Chemically synthesized
cuauucugagaaaacaag

SEQ ID NO: 20920 - RNA, 18 nt, artificial
  Chemically synthesized
aaaauguguucucggagu

SEQ ID NO: 20921 - RNA, 18 nt, artificial
  Chemically synthesized
gcggguccaccaguuuga

SEQ ID NO: 20922 - RNA, 18 nt, artificial
  Chemically synthesized
ggacgagugccagcugau

SEQ ID NO: 20923 - RNA, 18 nt, artificial
  Chemically synthesized
agcccucccaccagcaug

SEQ ID NO: 20924 - RNA, 18 nt, artificial
  Chemically synthesized
ucuacaugaggaacugua

SEQ ID NO: 20925 - RNA, 18 nt, artificial
  Chemically synthesized
cugacugcacagagagcu

SEQ ID NO: 20926 - RNA, 18 nt, artificial
  Chemically synthesized
cugcacaguagccuugcu

SEQ ID NO: 20927 - RNA, 18 nt, artificial
  Chemically synthesized
cugaagaacgcuucagac

SEQ ID NO: 20928 - RNA, 18 nt, artificial
  Chemically synthesized
agcccagcagcaaaggcc

SEQ ID NO: 20929 - RNA, 18 nt, artificial
  Chemically synthesized
uccacugugagaacaaca

SEQ ID NO: 20930 - RNA, 18 nt, artificial
  Chemically synthesized
agugagggacgucagacu

SEQ ID NO: 20931 - RNA, 18 nt, artificial
  Chemically synthesized
cacagacgagugugccag

SEQ ID NO: 20932 - RNA, 18 nt, artificial
  Chemically synthesized
gccgcugaccugcgcaug

SEQ ID NO: 20933 - RNA, 18 nt, artificial
  Chemically synthesized
gacugcacagagagcucc

SEQ ID NO: 20934 - RNA, 18 nt, artificial
  Chemically synthesized
gaaccaauacaacccucu

SEQ ID NO: 20935 - RNA, 18 nt, artificial
  Chemically synthesized
cugcagccagcaaacauc

SEQ ID NO: 20936 - RNA, 18 nt, artificial
  Chemically synthesized
cggaguguguaugccaag

SEQ ID NO: 20937 - RNA, 18 nt, artificial
  Chemically synthesized
gucaaugacuuccacugc

SEQ ID NO: 20938 - RNA, 18 nt, artificial
  Chemically synthesized
gcaccugcgaggacggca

SEQ ID NO: 20939 - RNA, 18 nt, artificial
  Chemically synthesized
ggcuacagcugcaccugc

SEQ ID NO: 20940 - RNA, 18 nt, artificial
  Chemically synthesized
cuuggucccuccagaacc

SEQ ID NO: 20941 - RNA, 18 nt, artificial
  Chemically synthesized
gcaccugcgaccugcuca

SEQ ID NO: 20942 - RNA, 18 nt, artificial
  Chemically synthesized
aguacuguaccgaggaug

SEQ ID NO: 20943 - RNA, 18 nt, artificial
  Chemically synthesized
gcuucagcgggauccacu

SEQ ID NO: 20944 - RNA, 18 nt, artificial
  Chemically synthesized
ccgcugcgaguccgucau

SEQ ID NO: 20945 - RNA, 18 nt, artificial
  Chemically synthesized
ggacggcggugacugcuc

SEQ ID NO: 20946 - RNA, 18 nt, artificial
  Chemically synthesized
ggcuucagcggucccaac

SEQ ID NO: 20947 - RNA, 18 nt, artificial
  Chemically synthesized
ccagccugcacaaccaga

SEQ ID NO: 20948 - RNA, 18 nt, artificial
  Chemically synthesized
cauggcuaccugucagac

SEQ ID NO: 20949 - RNA, 18 nt, artificial
  Chemically synthesized
gccguggccuccaacacc

SEQ ID NO: 20950 - RNA, 18 nt, artificial
  Chemically synthesized
cuccaacugcgacaccaa

SEQ ID NO: 20951 - RNA, 18 nt, artificial
  Chemically synthesized
gagcccacauccgagagc

SEQ ID NO: 20952 - RNA, 18 nt, artificial
  Chemically synthesized
agcccgagauggcggcgc

SEQ ID NO: 20953 - RNA, 18 nt, artificial
  Chemically synthesized
cacccaguaccgcugcga

SEQ ID NO: 20954 - RNA, 18 nt, artificial
  Chemically synthesized
cggccuggagacgggcaa

SEQ ID NO: 20955 - RNA, 18 nt, artificial
  Chemically synthesized
ccguggcacccagaacug

SEQ ID NO: 20956 - RNA, 18 nt, artificial
  Chemically synthesized
gcugugcccugggcuucu

SEQ ID NO: 20957 - RNA, 18 nt, artificial
  Chemically synthesized
ugcgaguccgucaucaau

SEQ ID NO: 20958 - RNA, 18 nt, artificial
  Chemically synthesized
gucugaggccagcaagaa

SEQ ID NO: 20959 - RNA, 18 nt, artificial
  Chemically synthesized
gcugacggaguacaagug

SEQ ID NO: 20960 - RNA, 18 nt, artificial
  Chemically synthesized
gccagccugcacaaccag

SEQ ID NO: 20961 - RNA, 18 nt, artificial
  Chemically synthesized
gacccgugcgccuccaac

SEQ ID NO: 20962 - RNA, 18 nt, artificial
  Chemically synthesized
cguaggaugaaaagauuc

SEQ ID NO: 20963 - RNA, 18 nt, artificial
  Chemically synthesized
uggaggaccucaucaacu

SEQ ID NO: 20964 - RNA, 18 nt, artificial
  Chemically synthesized
ucugcagccugcagugca

SEQ ID NO: 20965 - RNA, 18 nt, artificial
  Chemically synthesized
agccucaccuggugcaga

SEQ ID NO: 20966 - RNA, 18 nt, artificial
  Chemically synthesized
gcccuucgaggccuccua

SEQ ID NO: 20967 - RNA, 18 nt, artificial
  Chemically synthesized
caacgagugcguucugag

SEQ ID NO: 20968 - RNA, 18 nt, artificial
  Chemically synthesized
caguagccuugcugccag

SEQ ID NO: 20969 - RNA, 18 nt, artificial
  Chemically synthesized
cggaucauauggaccgcc

SEQ ID NO: 20970 - RNA, 18 nt, artificial
  Chemically synthesized
ccgcugaccugcgcaugu

SEQ ID NO: 20971 - RNA, 18 nt, artificial
  Chemically synthesized
aggcaaagcuggcucacc

SEQ ID NO: 20972 - RNA, 18 nt, artificial
  Chemically synthesized
ccugaauuucacuguggg

SEQ ID NO: 20973 - RNA, 18 nt, artificial
  Chemically synthesized
caucaagcgugccgccga

SEQ ID NO: 20974 - RNA, 18 nt, artificial
  Chemically synthesized
cgcacaggagcgcaugca

SEQ ID NO: 20975 - RNA, 18 nt, artificial
  Chemically synthesized
gcugccugcuggacagcu

SEQ ID NO: 20976 - RNA, 18 nt, artificial
  Chemically synthesized
caccugucuggacaagau

SEQ ID NO: 20977 - RNA, 18 nt, artificial
  Chemically synthesized
cgggaagugugaagcggc

SEQ ID NO: 20978 - RNA, 18 nt, artificial
  Chemically synthesized
ccaacguggucuucaagc

SEQ ID NO: 20979 - RNA, 18 nt, artificial
  Chemically synthesized
gugccagcauggagggcu

SEQ ID NO: 20980 - RNA, 18 nt, artificial
  Chemically synthesized
ggccgaccagaggagccu

SEQ ID NO: 20981 - RNA, 18 nt, artificial
  Chemically synthesized
caugagauguguggacug

SEQ ID NO: 20982 - RNA, 18 nt, artificial
  Chemically synthesized
guguguaugccaagagug

SEQ ID NO: 20983 - RNA, 18 nt, artificial
  Chemically synthesized
caaaacuuacagaugcag

SEQ ID NO: 20984 - RNA, 18 nt, artificial
  Chemically synthesized
ccucaaggcacggaggaa

SEQ ID NO: 20985 - RNA, 18 nt, artificial
  Chemically synthesized
cgagugugccagugaccc

SEQ ID NO: 20986 - RNA, 18 nt, artificial
  Chemically synthesized
gcgugcggaaggccagug

SEQ ID NO: 20987 - RNA, 18 nt, artificial
  Chemically synthesized
gcaaagcuggcucaccuu

SEQ ID NO: 20988 - RNA, 18 nt, artificial
  Chemically synthesized
gcguggcagacuaugccu

SEQ ID NO: 20989 - RNA, 18 nt, artificial
  Chemically synthesized
ccaccaccaccacagccg

SEQ ID NO: 20990 - RNA, 18 nt, artificial
  Chemically synthesized
gcagcagcagaaccugca

SEQ ID NO: 20991 - RNA, 18 nt, artificial
  Chemically synthesized
cccgaaugccaguucccg

SEQ ID NO: 20992 - RNA, 18 nt, artificial
  Chemically synthesized
cgacugcauggacgucaa

SEQ ID NO: 20993 - RNA, 18 nt, artificial
  Chemically synthesized
gccucaccuggugcagac

SEQ ID NO: 20994 - RNA, 18 nt, artificial
  Chemically synthesized
guacaagugcgacuguga

SEQ ID NO: 20995 - RNA, 18 nt, artificial
  Chemically synthesized
acaggucaguacuguacc

SEQ ID NO: 20996 - RNA, 18 nt, artificial
  Chemically synthesized
cuucaagcgugacgcaca

SEQ ID NO: 20997 - RNA, 18 nt, artificial
  Chemically synthesized
cacugcgagugccgugcu

SEQ ID NO: 20998 - RNA, 18 nt, artificial
  Chemically synthesized
gcuacagugggcgcaacu

SEQ ID NO: 20999 - RNA, 18 nt, artificial
  Chemically synthesized
gacgcgggcaacaagguc

SEQ ID NO: 21000 - RNA, 18 nt, artificial
  Chemically synthesized
ggcaagugcaucaacacg

SEQ ID NO: 21001 - RNA, 18 nt, artificial
  Chemically synthesized
gacgccgacugcauggac

SEQ ID NO: 21002 - RNA, 18 nt, artificial
  Chemically synthesized
gggccaccacugcgagac

SEQ ID NO: 21003 - RNA, 18 nt, artificial
  Chemically synthesized
agugugaauccaacccuu

SEQ ID NO: 21004 - RNA, 18 nt, artificial
  Chemically synthesized
cacuacggcuccugcaag

SEQ ID NO: 21005 - RNA, 18 nt, artificial
  Chemically synthesized
gugccgaaccaauacaac

SEQ ID NO: 21006 - RNA, 18 nt, artificial
  Chemically synthesized
ccuguccaaucccugcga

SEQ ID NO: 21007 - RNA, 18 nt, artificial
  Chemically synthesized
cacgcugacggaguacaa

SEQ ID NO: 21008 - RNA, 18 nt, artificial
  Chemically synthesized
cugacggaguacaagugc

SEQ ID NO: 21009 - RNA, 18 nt, artificial
  Chemically synthesized
aaugaguuccagugcgag

SEQ ID NO: 21010 - RNA, 18 nt, artificial
  Chemically synthesized
gccugcugcccuacacag

SEQ ID NO: 21011 - RNA, 18 nt, artificial
  Chemically synthesized
cgcuggucccacccguga

SEQ ID NO: 21012 - RNA, 18 nt, artificial
  Chemically synthesized
ggagggcagcuacgagac

SEQ ID NO: 21013 - RNA, 18 nt, artificial
  Chemically synthesized
gugccaagugccuggacg

SEQ ID NO: 21014 - RNA, 18 nt, artificial
  Chemically synthesized
gcuggaccacuuugccaa

SEQ ID NO: 21015 - RNA, 18 nt, artificial
  Chemically synthesized
agcaugcagucccagauc

SEQ ID NO: 21016 - RNA, 18 nt, artificial
  Chemically synthesized
gcugugccaccucaacga

SEQ ID NO: 21017 - RNA, 18 nt, artificial
  Chemically synthesized
gugccagcugaugccaaa

SEQ ID NO: 21018 - RNA, 18 nt, artificial
  Chemically synthesized
cggcaggaugucaacgag

SEQ ID NO: 21019 - RNA, 18 nt, artificial
  Chemically synthesized
gcuacuccugcaagugcg

SEQ ID NO: 21020 - RNA, 18 nt, artificial
  Chemically synthesized
aggaagaagucccaggac

SEQ ID NO: 21021 - RNA, 18 nt, artificial
  Chemically synthesized
gugccugccugccaggcu

SEQ ID NO: 21022 - RNA, 18 nt, artificial
  Chemically synthesized
aacgagugcuccagccag

SEQ ID NO: 21023 - RNA, 18 nt, artificial
  Chemically synthesized
ccucaucaacucacacgc

SEQ ID NO: 21024 - RNA, 18 nt, artificial
  Chemically synthesized
gggcagcuacgagaccgc

SEQ ID NO: 21025 - RNA, 18 nt, artificial
  Chemically synthesized
cccgcauuccggaggccu

SEQ ID NO: 21026 - RNA, 18 nt, artificial
  Chemically synthesized
ggccagaagcccgggcuu

SEQ ID NO: 21027 - RNA, 18 nt, artificial
  Chemically synthesized
caguacuguaccgaggau

SEQ ID NO: 21028 - RNA, 18 nt, artificial
  Chemically synthesized
ccagugccugcccuucga

SEQ ID NO: 21029 - RNA, 18 nt, artificial
  Chemically synthesized
guggacucccuggaguca

SEQ ID NO: 21030 - RNA, 18 nt, artificial
  Chemically synthesized
caacauccaggacaacau

SEQ ID NO: 21031 - RNA, 18 nt, artificial
  Chemically synthesized
gagaagcugcauccagag

SEQ ID NO: 21032 - RNA, 18 nt, artificial
  Chemically synthesized
cugcauggcggcaccugu

SEQ ID NO: 21033 - RNA, 18 nt, artificial
  Chemically synthesized
gccgcuccaccagcauca

SEQ ID NO: 21034 - RNA, 18 nt, artificial
  Chemically synthesized
gucuaccuggagauugac

SEQ ID NO: 21035 - RNA, 18 nt, artificial
  Chemically synthesized
gcugcagagcggcauggu

SEQ ID NO: 21036 - RNA, 18 nt, artificial
  Chemically synthesized
ccacagaccuggaugccc

SEQ ID NO: 21037 - RNA, 18 nt, artificial
  Chemically synthesized
cccuggguggagugggac

SEQ ID NO: 21038 - RNA, 18 nt, artificial
  Chemically synthesized
ggacagcuccggcaugcu

SEQ ID NO: 21039 - RNA, 18 nt, artificial
  Chemically synthesized
cuaugagagcuucuccug

SEQ ID NO: 21040 - RNA, 18 nt, artificial
  Chemically synthesized
gaaugacgcucguaccug

SEQ ID NO: 21041 - RNA, 18 nt, artificial
  Chemically synthesized
acgcgggcaacaaggucu

SEQ ID NO: 21042 - RNA, 18 nt, artificial
  Chemically synthesized
cucugcuucugccugaag

SEQ ID NO: 21043 - RNA, 18 nt, artificial
  Chemically synthesized
agugcaacucagccggcu

SEQ ID NO: 21044 - RNA, 18 nt, artificial
  Chemically synthesized
caagaagaagcggcggga

SEQ ID NO: 21045 - RNA, 18 nt, artificial
  Chemically synthesized
gcccugucccagaugaug

SEQ ID NO: 21046 - RNA, 18 nt, artificial
  Chemically synthesized
cccgaugcgagaucgacg

SEQ ID NO: 21047 - RNA, 18 nt, artificial
  Chemically synthesized
ccuacacaggugccacgu

SEQ ID NO: 21048 - RNA, 18 nt, artificial
  Chemically synthesized
ugcgcucuguggaugcca

SEQ ID NO: 21049 - RNA, 18 nt, artificial
  Chemically synthesized
ccauggcuaccugucaga

SEQ ID NO: 21050 - RNA, 18 nt, artificial
  Chemically synthesized
ggcuccaucgucuaccug

SEQ ID NO: 21051 - RNA, 18 nt, artificial
  Chemically synthesized
cugcauggacgucaaugu

SEQ ID NO: 21052 - RNA, 18 nt, artificial
  Chemically synthesized
ccauggacguccgcggcu

SEQ ID NO: 21053 - RNA, 18 nt, artificial
  Chemically synthesized
ucagccgcgugcugcaca

SEQ ID NO: 21054 - RNA, 18 nt, artificial
  Chemically synthesized
acgugugagaaugacgcu

SEQ ID NO: 21055 - RNA, 18 nt, artificial
  Chemically synthesized
ccuccuacaucugccacu

SEQ ID NO: 21056 - RNA, 18 nt, artificial
  Chemically synthesized
gcuccaccagcaucaccu

SEQ ID NO: 21057 - RNA, 18 nt, artificial
  Chemically synthesized
agaaccugcagccagcaa

SEQ ID NO: 21058 - RNA, 18 nt, artificial
  Chemically synthesized
acgcggauuaauuugcau

SEQ ID NO: 21059 - RNA, 18 nt, artificial
  Chemically synthesized
acugugcggagcauguac

SEQ ID NO: 21060 - RNA, 18 nt, artificial
  Chemically synthesized
gccuuuacugcgacgugc

SEQ ID NO: 21061 - RNA, 18 nt, artificial
  Chemically synthesized
gaggucggcuccuaccgc

SEQ ID NO: 21062 - RNA, 18 nt, artificial
  Chemically synthesized
gccgcacaggucugcugu

SEQ ID NO: 21063 - RNA, 18 nt, artificial
  Chemically synthesized
cuucaaagugucugaggc

SEQ ID NO: 21064 - RNA, 18 nt, artificial
  Chemically synthesized
cgcccguggcacccagaa

SEQ ID NO: 21065 - RNA, 18 nt, artificial
  Chemically synthesized
cugugagguggcugcgca

SEQ ID NO: 21066 - RNA, 18 nt, artificial
  Chemically synthesized
cgggcaccugucuggaca

SEQ ID NO: 21067 - RNA, 18 nt, artificial
  Chemically synthesized
ggagcgcucgccucgcug

SEQ ID NO: 21068 - RNA, 18 nt, artificial
  Chemically synthesized
ccguccugggcuccagca

SEQ ID NO: 21069 - RNA, 18 nt, artificial
  Chemically synthesized
uguugugugucaugccag

SEQ ID NO: 21070 - RNA, 18 nt, artificial
  Chemically synthesized
cagcacgaugucaaugag

SEQ ID NO: 21071 - RNA, 18 nt, artificial
  Chemically synthesized
uacguaggaugaaaagau

SEQ ID NO: 21072 - RNA, 18 nt, artificial
  Chemically synthesized
gcaccugcguggaccagg

SEQ ID NO: 21073 - RNA, 18 nt, artificial
  Chemically synthesized
ccauguguuuuagauggu

SEQ ID NO: 21074 - RNA, 18 nt, artificial
  Chemically synthesized
acugcucccucaacuuca

SEQ ID NO: 21075 - RNA, 18 nt, artificial
  Chemically synthesized
ccucugccgcccaggcua

SEQ ID NO: 21076 - RNA, 18 nt, artificial
  Chemically synthesized
cagccugcacaaccagac

SEQ ID NO: 21077 - RNA, 18 nt, artificial
  Chemically synthesized
gcaggcaauccgaggacu

SEQ ID NO: 21078 - RNA, 18 nt, artificial
  Chemically synthesized
gggcaagugcaucaacac

SEQ ID NO: 21079 - RNA, 18 nt, artificial
  Chemically synthesized
gugugcacugugagauca

SEQ ID NO: 21080 - RNA, 18 nt, artificial
  Chemically synthesized
gccuccucgcagugcuuc

SEQ ID NO: 21081 - RNA, 18 nt, artificial
  Chemically synthesized
agaccgccuugcaccugg

SEQ ID NO: 21082 - RNA, 18 nt, artificial
  Chemically synthesized
guacgaccaguacugcaa

SEQ ID NO: 21083 - RNA, 18 nt, artificial
  Chemically synthesized
cgggcgucugugugcgcu

SEQ ID NO: 21084 - RNA, 18 nt, artificial
  Chemically synthesized
caauaccaaguauagccu

SEQ ID NO: 21085 - RNA, 18 nt, artificial
  Chemically synthesized
ugaggacugcagcgagaa

SEQ ID NO: 21086 - RNA, 18 nt, artificial
  Chemically synthesized
caagaacggcggcaaaug

SEQ ID NO: 21087 - RNA, 18 nt, artificial
  Chemically synthesized
cggccaagcccgagaugg

SEQ ID NO: 21088 - RNA, 18 nt, artificial
  Chemically synthesized
uguggaugccgcaguugu

SEQ ID NO: 21089 - RNA, 18 nt, artificial
  Chemically synthesized
ccugaauggcgggaagug

SEQ ID NO: 21090 - RNA, 18 nt, artificial
  Chemically synthesized
caaggcacggaggaagaa

SEQ ID NO: 21091 - RNA, 18 nt, artificial
  Chemically synthesized
ugugugucaugccaguga

SEQ ID NO: 21092 - RNA, 18 nt, artificial
  Chemically synthesized
gccuguggccucuggcac

SEQ ID NO: 21093 - RNA, 18 nt, artificial
  Chemically synthesized
ugccagaccaacaucaac

SEQ ID NO: 21094 - RNA, 18 nt, artificial
  Chemically synthesized
ccguguggccuccuucua

SEQ ID NO: 21095 - RNA, 18 nt, artificial
  Chemically synthesized
gcugcguccuuugguccu

SEQ ID NO: 21096 - RNA, 18 nt, artificial
  Chemically synthesized
cagcgcagaugccaacau

SEQ ID NO: 21097 - RNA, 18 nt, artificial
  Chemically synthesized
gacgucagacuuggcuca

SEQ ID NO: 21098 - RNA, 18 nt, artificial
  Chemically synthesized
ggccagcucugguucccu

SEQ ID NO: 21099 - RNA, 18 nt, artificial
  Chemically synthesized
gagacuugccagagccgg

SEQ ID NO: 21100 - RNA, 18 nt, artificial
  Chemically synthesized
caacccaugucugaacca

SEQ ID NO: 21101 - RNA, 18 nt, artificial
  Chemically synthesized
ccuuugagacuggcccac

SEQ ID NO: 21102 - RNA, 18 nt, artificial
  Chemically synthesized
caaggaccacuucagcga

SEQ ID NO: 21103 - RNA, 18 nt, artificial
  Chemically synthesized
ugugaauccaacccuugu

SEQ ID NO: 21104 - RNA, 18 nt, artificial
  Chemically synthesized
cgucaaugacuuccacug

SEQ ID NO: 21105 - RNA, 18 nt, artificial
  Chemically synthesized
ggcaccugcaaagacaug

SEQ ID NO: 21106 - RNA, 18 nt, artificial
  Chemically synthesized
ggcuaccugucagacgug

SEQ ID NO: 21107 - RNA, 18 nt, artificial
  Chemically synthesized
cggaggccuucaaguaaa

SEQ ID NO: 21108 - RNA, 18 nt, artificial
  Chemically synthesized
cucccaccagcaugcagu

SEQ ID NO: 21109 - RNA, 18 nt, artificial
  Chemically synthesized
gagacgggcaacagcgag

SEQ ID NO: 21110 - RNA, 18 nt, artificial
  Chemically synthesized
gcagaacaacagggagga

SEQ ID NO: 21111 - RNA, 18 nt, artificial
  Chemically synthesized
cugcagcauggcauggua

SEQ ID NO: 21112 - RNA, 18 nt, artificial
  Chemically synthesized
aauguaggcaucaugcau

SEQ ID NO: 21113 - RNA, 18 nt, artificial
  Chemically synthesized
uguaggagacuugccaga

SEQ ID NO: 21114 - RNA, 18 nt, artificial
  Chemically synthesized
gaccggccuuuacugcga

SEQ ID NO: 21115 - RNA, 18 nt, artificial
  Chemically synthesized
cgugguucugccugaccu

SEQ ID NO: 21116 - RNA, 18 nt, artificial
  Chemically synthesized
gaggaggacaucaacgag

SEQ ID NO: 21117 - RNA, 18 nt, artificial
  Chemically synthesized
ggcguggcagacuaugcc

SEQ ID NO: 21118 - RNA, 18 nt, artificial
  Chemically synthesized
cugcuggacgaguacaac

SEQ ID NO: 21119 - RNA, 18 nt, artificial
  Chemically synthesized
ccucaagcccggcgugca

SEQ ID NO: 21120 - RNA, 18 nt, artificial
  Chemically synthesized
gaccagaggagccuuuuu

SEQ ID NO: 21121 - RNA, 18 nt, artificial
  Chemically synthesized
gcauggagggcucugugu

SEQ ID NO: 21122 - RNA, 18 nt, artificial
  Chemically synthesized
ugcaagaacggcggcaaa

SEQ ID NO: 21123 - RNA, 18 nt, artificial
  Chemically synthesized
cagugcuggaaguacuuc

SEQ ID NO: 21124 - RNA, 18 nt, artificial
  Chemically synthesized
gcugcgcagcgacaaggu

SEQ ID NO: 21125 - RNA, 18 nt, artificial
  Chemically synthesized
gcuuugacugccagcgug

SEQ ID NO: 21126 - RNA, 18 nt, artificial
  Chemically synthesized
guucucggaguguguaug

SEQ ID NO: 21127 - RNA, 18 nt, artificial
  Chemically synthesized
acaagcaaguucugagag

SEQ ID NO: 21128 - RNA, 18 nt, artificial
  Chemically synthesized
cagccagugcaacucagc

SEQ ID NO: 21129 - RNA, 18 nt, artificial
  Chemically synthesized
cgcgugcugcacaccaac

SEQ ID NO: 21130 - RNA, 18 nt, artificial
  Chemically synthesized
augaggaacuguagauga

SEQ ID NO: 21131 - RNA, 18 nt, artificial
  Chemically synthesized
ggagccuuagccgcccau

SEQ ID NO: 21132 - RNA, 18 nt, artificial
  Chemically synthesized
cacgaugucaaugagugc

SEQ ID NO: 21133 - RNA, 18 nt, artificial
  Chemically synthesized
caccaacguggucuucaa

SEQ ID NO: 21134 - RNA, 18 nt, artificial
  Chemically synthesized
gccucaacggcggcacau

SEQ ID NO: 21135 - RNA, 18 nt, artificial
  Chemically synthesized
gggaugucaacgagugcc

SEQ ID NO: 21136 - RNA, 18 nt, artificial
  Chemically synthesized
ccggguacaagugcaacu

SEQ ID NO: 21137 - RNA, 18 nt, artificial
  Chemically synthesized
aauucaacgggcucuugu

SEQ ID NO: 21138 - RNA, 18 nt, artificial
  Chemically synthesized
cgcccugucccagaugau

SEQ ID NO: 21139 - RNA, 18 nt, artificial
  Chemically synthesized
gcccaguuccugacgccc

SEQ ID NO: 21140 - RNA, 18 nt, artificial
  Chemically synthesized
gacugcauggacgucaau

SEQ ID NO: 21141 - RNA, 18 nt, artificial
  Chemically synthesized
cggcuaccugggcagccu

SEQ ID NO: 21142 - RNA, 18 nt, artificial
  Chemically synthesized
guguaugccaagagugca

SEQ ID NO: 21143 - RNA, 18 nt, artificial
  Chemically synthesized
gcgucgccaccuucaccu

SEQ ID NO: 21144 - RNA, 18 nt, artificial
  Chemically synthesized
gcgagguggacaucgaug

SEQ ID NO: 21145 - RNA, 18 nt, artificial
  Chemically synthesized
cagcaaagccugcagccg

SEQ ID NO: 21146 - RNA, 18 nt, artificial
  Chemically synthesized
gccugaccuggacgacca

SEQ ID NO: 21147 - RNA, 18 nt, artificial
  Chemically synthesized
gggacggcggugacugcu

SEQ ID NO: 21148 - RNA, 18 nt, artificial
  Chemically synthesized
cacauugagcugugcaac

SEQ ID NO: 21149 - RNA, 18 nt, artificial
  Chemically synthesized
cggccuuuacugcgacgu

SEQ ID NO: 21150 - RNA, 18 nt, artificial
  Chemically synthesized
gaggaccucaucaacuca

SEQ ID NO: 21151 - RNA, 18 nt, artificial
  Chemically synthesized
gaggucaaugagugcaac

SEQ ID NO: 21152 - RNA, 18 nt, artificial
  Chemically synthesized
acgucacccacgagugug

SEQ ID NO: 21153 - RNA, 18 nt, artificial
  Chemically synthesized
cuguuaggagaagcugca

SEQ ID NO: 21154 - RNA, 18 nt, artificial
  Chemically synthesized
cauguacccgagaggcug

SEQ ID NO: 21155 - RNA, 18 nt, artificial
  Chemically synthesized
cccucgcccugccagaac

SEQ ID NO: 21156 - RNA, 18 nt, artificial
  Chemically synthesized
caagagugcacccauggu

SEQ ID NO: 21157 - RNA, 18 nt, artificial
  Chemically synthesized
aggagcagauuuuugcaa

SEQ ID NO: 21158 - RNA, 18 nt, artificial
  Chemically synthesized
ugaacaauguggaugccg

SEQ ID NO: 21159 - RNA, 18 nt, artificial
  Chemically synthesized
gcaagcccugcaagaaug

SEQ ID NO: 21160 - RNA, 18 nt, artificial
  Chemically synthesized
gugucugccgacgcacaa

SEQ ID NO: 21161 - RNA, 18 nt, artificial
  Chemically synthesized
ccacugcccacccagcuu

SEQ ID NO: 21162 - RNA, 18 nt, artificial
  Chemically synthesized
gacgcacaaggugucuuc

SEQ ID NO: 21163 - RNA, 18 nt, artificial
  Chemically synthesized
cggcaccugcaaagacau

SEQ ID NO: 21164 - RNA, 18 nt, artificial
  Chemically synthesized
ccugugagccgggcuaca

SEQ ID NO: 21165 - RNA, 18 nt, artificial
  Chemically synthesized
agccuucgggcgucugug

SEQ ID NO: 21166 - RNA, 18 nt, artificial
  Chemically synthesized
cuggacgaccagacagac

SEQ ID NO: 21167 - RNA, 18 nt, artificial
  Chemically synthesized
ccgaagaagaugcuccag

SEQ ID NO: 21168 - RNA, 18 nt, artificial
  Chemically synthesized
cccagggugagguugacg

SEQ ID NO: 21169 - RNA, 18 nt, artificial
  Chemically synthesized
ccgagauggcggcgcugg

SEQ ID NO: 21170 - RNA, 18 nt, artificial
  Chemically synthesized
cuccucgccuguggacaa

SEQ ID NO: 21171 - RNA, 18 nt, artificial
  Chemically synthesized
ccgcgggccugauggcuu

SEQ ID NO: 21172 - RNA, 18 nt, artificial
  Chemically synthesized
gcaacaaccacgcgugcg

SEQ ID NO: 21173 - RNA, 18 nt, artificial
  Chemically synthesized
ggugugacuccucgcccu

SEQ ID NO: 21174 - RNA, 18 nt, artificial
  Chemically synthesized
gaguguggccagaagccc

SEQ ID NO: 21175 - RNA, 18 nt, artificial
  Chemically synthesized
gcagcagcaaagccugca

SEQ ID NO: 21176 - RNA, 18 nt, artificial
  Chemically synthesized
aucgauggcuacgagugu

SEQ ID NO: 21177 - RNA, 18 nt, artificial
  Chemically synthesized
gacugcucccucaacuuc

SEQ ID NO: 21178 - RNA, 18 nt, artificial
  Chemically synthesized
ccagaggagccuuuuuaa

SEQ ID NO: 21179 - RNA, 18 nt, artificial
  Chemically synthesized
gugugcgcucuguggaug

SEQ ID NO: 21180 - RNA, 18 nt, artificial
  Chemically synthesized
agaugcagcagcagaacc

SEQ ID NO: 21181 - RNA, 18 nt, artificial
  Chemically synthesized
ggacgcgccggccgucau

SEQ ID NO: 21182 - RNA, 18 nt, artificial
  Chemically synthesized
ggaggccaaggaccucaa

SEQ ID NO: 21183 - RNA, 18 nt, artificial
  Chemically synthesized
cugccgggacagccucaa

SEQ ID NO: 21184 - RNA, 18 nt, artificial
  Chemically synthesized
cucgcugggcagccucaa

SEQ ID NO: 21185 - RNA, 18 nt, artificial
  Chemically synthesized
gcacaaccagacagaccg

SEQ ID NO: 21186 - RNA, 18 nt, artificial
  Chemically synthesized
gagugcuccagccagccc

SEQ ID NO: 21187 - RNA, 18 nt, artificial
  Chemically synthesized
ggcagcuacugugaggac

SEQ ID NO: 21188 - RNA, 18 nt, artificial
  Chemically synthesized
ccucagccugcacagugu

SEQ ID NO: 21189 - RNA, 18 nt, artificial
  Chemically synthesized
accuggagauugacaacc

SEQ ID NO: 21190 - RNA, 18 nt, artificial
  Chemically synthesized
ugcgagaccgacaucgac

SEQ ID NO: 21191 - RNA, 18 nt, artificial
  Chemically synthesized
gggcuuugccgccacgga

SEQ ID NO: 21192 - RNA, 18 nt, artificial
  Chemically synthesized
cuauggcagaaaaaaugu

SEQ ID NO: 21193 - RNA, 18 nt, artificial
  Chemically synthesized
gcaaacauccagcagcag

SEQ ID NO: 21194 - RNA, 18 nt, artificial
  Chemically synthesized
agggagcauguguaacau

SEQ ID NO: 21195 - RNA, 18 nt, artificial
  Chemically synthesized
ccagcaacacagccuggg

SEQ ID NO: 21196 - RNA, 18 nt, artificial
  Chemically synthesized
gccugcccuucgaggccu

SEQ ID NO: 21197 - RNA, 18 nt, artificial
  Chemically synthesized
cagacgagugugccagca

SEQ ID NO: 21198 - RNA, 18 nt, artificial
  Chemically synthesized
cgcagcccaguuccugac

SEQ ID NO: 21199 - RNA, 18 nt, artificial
  Chemically synthesized
agaaaacaagcaaguucu

SEQ ID NO: 21200 - RNA, 18 nt, artificial
  Chemically synthesized
cagccagcccugccgcca

SEQ ID NO: 21201 - RNA, 18 nt, artificial
  Chemically synthesized
uagccuauggcagaaaaa

SEQ ID NO: 21202 - RNA, 18 nt, artificial
  Chemically synthesized
ugaagaacgcuucagacg

SEQ ID NO: 21203 - RNA, 18 nt, artificial
  Chemically synthesized
guggacaggucaguacug

SEQ ID NO: 21204 - RNA, 18 nt, artificial
  Chemically synthesized
cggcuacuccugcaagug

SEQ ID NO: 21205 - RNA, 18 nt, artificial
  Chemically synthesized
acaacacgccugacugca

SEQ ID NO: 21206 - RNA, 18 nt, artificial
  Chemically synthesized
agaugaugagcuaccagg

SEQ ID NO: 21207 - RNA, 18 nt, artificial
  Chemically synthesized
ggcugacccgugcgccuc

SEQ ID NO: 21208 - RNA, 18 nt, artificial
  Chemically synthesized
cuuccagagugccaccga

SEQ ID NO: 21209 - RNA, 18 nt, artificial
  Chemically synthesized
uggugaggacugcagcga

SEQ ID NO: 21210 - RNA, 18 nt, artificial
  Chemically synthesized
ccgugguucugccugacc

SEQ ID NO: 21211 - RNA, 18 nt, artificial
  Chemically synthesized
cgggagggcuucagcggu

SEQ ID NO: 21212 - RNA, 18 nt, artificial
  Chemically synthesized
acuucaucuaccagggcg

SEQ ID NO: 21213 - RNA, 18 nt, artificial
  Chemically synthesized
cgacgucaacgagugcgu

SEQ ID NO: 21214 - RNA, 18 nt, artificial
  Chemically synthesized
gcucccugguggcagcga

SEQ ID NO: 21215 - RNA, 18 nt, artificial
  Chemically synthesized
ggccuguggaagcaagga

SEQ ID NO: 21216 - RNA, 18 nt, artificial
  Chemically synthesized
caaccaccugccugggau

SEQ ID NO: 21217 - RNA, 18 nt, artificial
  Chemically synthesized
cgugagcucagcagccag

SEQ ID NO: 21218 - RNA, 18 nt, artificial
  Chemically synthesized
ccgcugccuggacaagau

SEQ ID NO: 21219 - RNA, 18 nt, artificial
  Chemically synthesized
acaugagauguguggacu

SEQ ID NO: 21220 - RNA, 18 nt, artificial
  Chemically synthesized
ugcacugcgaggucaaca

SEQ ID NO: 21221 - RNA, 18 nt, artificial
  Chemically synthesized
ccgcauuccggaggccuu

SEQ ID NO: 21222 - RNA, 18 nt, artificial
  Chemically synthesized
cugccugaauggcgggaa

SEQ ID NO: 21223 - RNA, 18 nt, artificial
  Chemically synthesized
agcgugcggaaggccagu

SEQ ID NO: 21224 - RNA, 18 nt, artificial
  Chemically synthesized
caugcuggaggaccucau

SEQ ID NO: 21225 - RNA, 18 nt, artificial
  Chemically synthesized
ccucuucgacggcuuuga

SEQ ID NO: 21226 - RNA, 18 nt, artificial
  Chemically synthesized
ccuggacuacagcuucgg

SEQ ID NO: 21227 - RNA, 18 nt, artificial
  Chemically synthesized
gugggugagcgcugugag

SEQ ID NO: 21228 - RNA, 18 nt, artificial
  Chemically synthesized
cagaugaugagcuaccag

SEQ ID NO: 21229 - RNA, 18 nt, artificial
  Chemically synthesized
ggucuucaagcgugacgc

SEQ ID NO: 21230 - RNA, 18 nt, artificial
  Chemically synthesized
ccacuuugccaaccggga

SEQ ID NO: 21231 - RNA, 18 nt, artificial
  Chemically synthesized
gaccagacagaccaccgg

SEQ ID NO: 21232 - RNA, 18 nt, artificial
  Chemically synthesized
gcgacucgggcaccuguc

SEQ ID NO: 21233 - RNA, 18 nt, artificial
  Chemically synthesized
ugcacuggugugacuccu

SEQ ID NO: 21234 - RNA, 18 nt, artificial
  Chemically synthesized
gcucccagcccggugaga

SEQ ID NO: 21235 - RNA, 18 nt, artificial
  Chemically synthesized
cggcaguggacucagcag

SEQ ID NO: 21236 - RNA, 18 nt, artificial
  Chemically synthesized
gaccaguggcuacgugug

SEQ ID NO: 21237 - RNA, 18 nt, artificial
  Chemically synthesized
cgccacugauccuggcug

SEQ ID NO: 21238 - RNA, 18 nt, artificial
  Chemically synthesized
ggacggcgucgccaccuu

SEQ ID NO: 21239 - RNA, 18 nt, artificial
  Chemically synthesized
caaagacaugaccagugg

SEQ ID NO: 21240 - RNA, 18 nt, artificial
  Chemically synthesized
ccgggcacauugagcugu

SEQ ID NO: 21241 - RNA, 18 nt, artificial
  Chemically synthesized
cugccaggaccgcgacaa

SEQ ID NO: 21242 - RNA, 18 nt, artificial
  Chemically synthesized
ggcuucaccugccgcugc

SEQ ID NO: 21243 - RNA, 18 nt, artificial
  Chemically synthesized
gcagccuggcggugcaca

SEQ ID NO: 21244 - RNA, 18 nt, artificial
  Chemically synthesized
caccacagccgcaccuug

SEQ ID NO: 21245 - RNA, 18 nt, artificial
  Chemically synthesized
uccagauccugauccgga

SEQ ID NO: 21246 - RNA, 18 nt, artificial
  Chemically synthesized
caucaacucacacgccga

SEQ ID NO: 21247 - RNA, 18 nt, artificial
  Chemically synthesized
ugauccggaaccgagcca

SEQ ID NO: 21248 - RNA, 18 nt, artificial
  Chemically synthesized
caaugcgaguggcugucc

SEQ ID NO: 21249 - RNA, 18 nt, artificial
  Chemically synthesized
uucugagaaaacaagcaa

SEQ ID NO: 21250 - RNA, 18 nt, artificial
  Chemically synthesized
gggcaugcuggaggaccu

SEQ ID NO: 21251 - RNA, 18 nt, artificial
  Chemically synthesized
cacugugagaucaacgug

SEQ ID NO: 21252 - RNA, 18 nt, artificial
  Chemically synthesized
cgaggagcccgugguucu

SEQ ID NO: 21253 - RNA, 18 nt, artificial
  Chemically synthesized
guacugcaaggaccacuu

SEQ ID NO: 21254 - RNA, 18 nt, artificial
  Chemically synthesized
cugcucccucaacuucaa

SEQ ID NO: 21255 - RNA, 18 nt, artificial
  Chemically synthesized
cugaaauaggaaacaagu

SEQ ID NO: 21256 - RNA, 18 nt, artificial
  Chemically synthesized
agcauaguccaaaaagcu

SEQ ID NO: 21257 - RNA, 18 nt, artificial
  Chemically synthesized
ggcacggaggaagaaguc

SEQ ID NO: 21258 - RNA, 18 nt, artificial
  Chemically synthesized
uuggagaagggaaguuga

SEQ ID NO: 21259 - RNA, 18 nt, artificial
  Chemically synthesized
ggaccacuuugccaaccg

SEQ ID NO: 21260 - RNA, 18 nt, artificial
  Chemically synthesized
gacucgggcaccugucug

SEQ ID NO: 21261 - RNA, 18 nt, artificial
  Chemically synthesized
guccaaucccugcgacgc

SEQ ID NO: 21262 - RNA, 18 nt, artificial
  Chemically synthesized
gaggacaucaacgagugu

SEQ ID NO: 21263 - RNA, 18 nt, artificial
  Chemically synthesized
ccaagugccuggacggac

SEQ ID NO: 21264 - RNA, 18 nt, artificial
  Chemically synthesized
cugcgugugugucaacgg

SEQ ID NO: 21265 - RNA, 18 nt, artificial
  Chemically synthesized
cagggugugcacugugag

SEQ ID NO: 21266 - RNA, 18 nt, artificial
  Chemically synthesized
ggcaaggccaucugcacc

SEQ ID NO: 21267 - RNA, 18 nt, artificial
  Chemically synthesized
gccuucgggcgucugugu

SEQ ID NO: 21268 - RNA, 18 nt, artificial
  Chemically synthesized
gugagaccugccugaaug

SEQ ID NO: 21269 - RNA, 18 nt, artificial
  Chemically synthesized
gucuggacaagaucgaug

SEQ ID NO: 21270 - RNA, 18 nt, artificial
  Chemically synthesized
cagcugcacuucauguac

SEQ ID NO: 21271 - RNA, 18 nt, artificial
  Chemically synthesized
cuuccgcacgcggauuaa

SEQ ID NO: 21272 - RNA, 18 nt, artificial
  Chemically synthesized
ugaggaacuguagaugau

SEQ ID NO: 21273 - RNA, 18 nt, artificial
  Chemically synthesized
cagugcaacucagccggc

SEQ ID NO: 21274 - RNA, 18 nt, artificial
  Chemically synthesized
cggcuuccuuucccaagc

SEQ ID NO: 21275 - RNA, 18 nt, artificial
  Chemically synthesized
gggcgucuccagcccucc

SEQ ID NO: 21276 - RNA, 18 nt, artificial
  Chemically synthesized
cggccagcagaugaucuu

SEQ ID NO: 21277 - RNA, 18 nt, artificial
  Chemically synthesized
gcgcagcgacaagguguu

SEQ ID NO: 21278 - RNA, 18 nt, artificial
  Chemically synthesized
gggagggcuucagcgguc

SEQ ID NO: 21279 - RNA, 18 nt, artificial
  Chemically synthesized
ggcaccugccacaacgag

SEQ ID NO: 21280 - RNA, 18 nt, artificial
  Chemically synthesized
uucuugaaauguaggcau

SEQ ID NO: 21281 - RNA, 18 nt, artificial
  Chemically synthesized
ggcccgcgaugcucccag

SEQ ID NO: 21282 - RNA, 18 nt, artificial
  Chemically synthesized
ccgaaccaauacaacccu

SEQ ID NO: 21283 - RNA, 18 nt, artificial
  Chemically synthesized
agaccuggaugcccgcau

SEQ ID NO: 21284 - RNA, 18 nt, artificial
  Chemically synthesized
gacucagcagcaccugga

SEQ ID NO: 21285 - RNA, 18 nt, artificial
  Chemically synthesized
ccuggacggacccaacac

SEQ ID NO: 21286 - RNA, 18 nt, artificial
  Chemically synthesized
caguaccgcugcgagugc

SEQ ID NO: 21287 - RNA, 18 nt, artificial
  Chemically synthesized
gucaacggcuggacuggu

SEQ ID NO: 21288 - RNA, 18 nt, artificial
  Chemically synthesized
agagccgagccaggcaga

SEQ ID NO: 21289 - RNA, 18 nt, artificial
  Chemically synthesized
gcuccggcaugcucucgc

SEQ ID NO: 21290 - RNA, 18 nt, artificial
  Chemically synthesized
gacaucgaugagugcgac

SEQ ID NO: 21291 - RNA, 18 nt, artificial
  Chemically synthesized
ccaaggugcugcuggacc

SEQ ID NO: 21292 - RNA, 18 nt, artificial
  Chemically synthesized
gugcagggcaagaagguc

SEQ ID NO: 21293 - RNA, 18 nt, artificial
  Chemically synthesized
acagcuccggcaugcucu

SEQ ID NO: 21294 - RNA, 18 nt, artificial
  Chemically synthesized
cccagaugaugagcuacc

SEQ ID NO: 21295 - RNA, 18 nt, artificial
  Chemically synthesized
gcccacauccgagagccc

SEQ ID NO: 21296 - RNA, 18 nt, artificial
  Chemically synthesized
gggcugggccgcaccuga

SEQ ID NO: 21297 - RNA, 18 nt, artificial
  Chemically synthesized
ccgaagaagaugcuccag

SEQ ID NO: 21298 - RNA, 18 nt, artificial
  Chemically synthesized
gugggcgcaacugcgaga

SEQ ID NO: 21299 - RNA, 18 nt, artificial
  Chemically synthesized
gucccagaucgcccgcau

SEQ ID NO: 21300 - RNA, 18 nt, artificial
  Chemically synthesized
gggacgcacugcgaggug

SEQ ID NO: 21301 - RNA, 18 nt, artificial
  Chemically synthesized
gccuuuuuaaaacacaug

SEQ ID NO: 21302 - RNA, 18 nt, artificial
  Chemically synthesized
aacaacaaugagugugaa

SEQ ID NO: 21303 - RNA, 18 nt, artificial
  Chemically synthesized
cuacgagugugccuguga

SEQ ID NO: 21304 - RNA, 18 nt, artificial
  Chemically synthesized
cacccacgagugugccug

SEQ ID NO: 21305 - RNA, 18 nt, artificial
  Chemically synthesized
augccaagagugcaccca

SEQ ID NO: 21306 - RNA, 18 nt, artificial
  Chemically synthesized
caucaacgagugugcguc

SEQ ID NO: 21307 - RNA, 18 nt, artificial
  Chemically synthesized
gucccagaugaugagcua

SEQ ID NO: 21308 - RNA, 18 nt, artificial
  Chemically synthesized
cgccggagcagcugcgca

SEQ ID NO: 21309 - RNA, 18 nt, artificial
  Chemically synthesized
aaggcacggaggaagaag

SEQ ID NO: 21310 - RNA, 18 nt, artificial
  Chemically synthesized
gccgccgugaacaaugug

SEQ ID NO: 21311 - RNA, 18 nt, artificial
  Chemically synthesized
ccugcgcaugucugccau

SEQ ID NO: 21312 - RNA, 18 nt, artificial
  Chemically synthesized
ucgucuaccuggagauug

SEQ ID NO: 21313 - RNA, 18 nt, artificial
  Chemically synthesized
cuggacugugcggagcau

SEQ ID NO: 21314 - RNA, 18 nt, artificial
  Chemically synthesized
gcaaacauccagcagcag

SEQ ID NO: 21315 - RNA, 18 nt, artificial
  Chemically synthesized
gaggccagcaagaagaag

SEQ ID NO: 21316 - RNA, 18 nt, artificial
  Chemically synthesized
gcuaccugucagacgugg

SEQ ID NO: 21317 - RNA, 18 nt, artificial
  Chemically synthesized
uccuucgagugccagugu

SEQ ID NO: 21318 - RNA, 18 nt, artificial
  Chemically synthesized
gccucuggcaccagcacc

SEQ ID NO: 21319 - RNA, 18 nt, artificial
  Chemically synthesized
cgucaucuccgacuucau

SEQ ID NO: 21320 - RNA, 18 nt, artificial
  Chemically synthesized
agaagaagcggcgggagc

SEQ ID NO: 21321 - RNA, 18 nt, artificial
  Chemically synthesized
caucacggaucauaugga

SEQ ID NO: 21322 - RNA, 18 nt, artificial
  Chemically synthesized
ccaguaccgcugcgagug

SEQ ID NO: 21323 - RNA, 18 nt, artificial
  Chemically synthesized
auagccuauggcagaaaa

SEQ ID NO: 21324 - RNA, 18 nt, artificial
  Chemically synthesized
agaggcguggcagacuau

SEQ ID NO: 21325 - RNA, 18 nt, artificial
  Chemically synthesized
cccguggcacccagaacu

SEQ ID NO: 21326 - RNA, 18 nt, artificial
  Chemically synthesized
ggacgcgggcaacacgca

SEQ ID NO: 21327 - RNA, 18 nt, artificial
  Chemically synthesized
gacagaccaccggcagug

SEQ ID NO: 21328 - RNA, 18 nt, artificial
  Chemically synthesized
aaggugucuuccagaucc

SEQ ID NO: 21329 - RNA, 18 nt, artificial
  Chemically synthesized
ugaggcugcuggacgagu

SEQ ID NO: 21330 - RNA, 18 nt, artificial
  Chemically synthesized
gcacuuucugugaggagg

SEQ ID NO: 21331 - RNA, 18 nt, artificial
  Chemically synthesized
ugaaugagucuguugugu

SEQ ID NO: 21332 - RNA, 18 nt, artificial
  Chemically synthesized
gcgcgucaaugacuucca

SEQ ID NO: 21333 - RNA, 18 nt, artificial
  Chemically synthesized
ccuccuaguuugggagga

SEQ ID NO: 21334 - RNA, 18 nt, artificial
  Chemically synthesized
gggccggagcuuccugag

SEQ ID NO: 21335 - RNA, 18 nt, artificial
  Chemically synthesized
cgacugugacccugggug

SEQ ID NO: 21336 - RNA, 18 nt, artificial
  Chemically synthesized
ccuggugcagacccagca

SEQ ID NO: 21337 - RNA, 18 nt, artificial
  Chemically synthesized
gugcagacccagcaggug

SEQ ID NO: 21338 - RNA, 18 nt, artificial
  Chemically synthesized
caugauggcacgacgcca

SEQ ID NO: 21339 - RNA, 18 nt, artificial
  Chemically synthesized
ggaugucaacgagugccu

SEQ ID NO: 21340 - RNA, 18 nt, artificial
  Chemically synthesized
gaccaagaaguuccgguu

SEQ ID NO: 21341 - RNA, 18 nt, artificial
  Chemically synthesized
aaauguaggcaucaugca

SEQ ID NO: 21342 - RNA, 18 nt, artificial
  Chemically synthesized
ugaauuucacugugggcg

SEQ ID NO: 21343 - RNA, 18 nt, artificial
  Chemically synthesized
cacgggcgagaccgccuu

SEQ ID NO: 21344 - RNA, 18 nt, artificial
  Chemically synthesized
gaggucaacacagacgag

SEQ ID NO: 21345 - RNA, 18 nt, artificial
  Chemically synthesized
cgugagcucagcagccag

SEQ ID NO: 21346 - RNA, 18 nt, artificial
  Chemically synthesized
uggguuagauguugccau

SEQ ID NO: 21347 - RNA, 18 nt, artificial
  Chemically synthesized
cggguacaagugcaacug

SEQ ID NO: 21348 - RNA, 18 nt, artificial
  Chemically synthesized
gcuggcucaccuuccgca

SEQ ID NO: 21349 - RNA, 18 nt, artificial
  Chemically synthesized
gaagguccgcaagcccag

SEQ ID NO: 21350 - RNA, 18 nt, artificial
  Chemically synthesized
cuggacggacccaacacu

SEQ ID NO: 21351 - RNA, 18 nt, artificial
  Chemically synthesized
gcccuacacaggugccac

SEQ ID NO: 21352 - RNA, 18 nt, artificial
  Chemically synthesized
gcggcuacuccugcaagu

SEQ ID NO: 21353 - RNA, 18 nt, artificial
  Chemically synthesized
cagaugaugagcuaccag

SEQ ID NO: 21354 - RNA, 18 nt, artificial
  Chemically synthesized
gcaucgggcaccugaacg

SEQ ID NO: 21355 - RNA, 18 nt, artificial
  Chemically synthesized
ccagcaagaagaagcggc

SEQ ID NO: 21356 - RNA, 18 nt, artificial
  Chemically synthesized
gcccagcagcaaaggccu

SEQ ID NO: 21357 - RNA, 18 nt, artificial
  Chemically synthesized
cuccugcacagacggcau

SEQ ID NO: 21358 - RNA, 18 nt, artificial
  Chemically synthesized
ccgagccacagaccugga

SEQ ID NO: 21359 - RNA, 18 nt, artificial
  Chemically synthesized
aagugaucuacaugagga

SEQ ID NO: 21360 - RNA, 18 nt, artificial
  Chemically synthesized
aggcaaacggaggcaaag

SEQ ID NO: 21361 - RNA, 18 nt, artificial
  Chemically synthesized
cgugaccgcagcccaguu

SEQ ID NO: 21362 - RNA, 18 nt, artificial
  Chemically synthesized
gcagccugcagugcaaca

SEQ ID NO: 21363 - RNA, 18 nt, artificial
  Chemically synthesized
cugcgacgcccguggcac

SEQ ID NO: 21364 - RNA, 18 nt, artificial
  Chemically synthesized
gacagaccgcacgggcga

SEQ ID NO: 21365 - RNA, 18 nt, artificial
  Chemically synthesized
accugguggacgagugcu

SEQ ID NO: 21366 - RNA, 18 nt, artificial
  Chemically synthesized
cgacguggccgcauuccu

SEQ ID NO: 21367 - RNA, 18 nt, artificial
  Chemically synthesized
guuagauguugccaugug

SEQ ID NO: 21368 - RNA, 18 nt, artificial
  Chemically synthesized
ccagaccaacaucaacga

SEQ ID NO: 21369 - RNA, 18 nt, artificial
  Chemically synthesized
gcagcgcgucaaugacuu

SEQ ID NO: 21370 - RNA, 18 nt, artificial
  Chemically synthesized
gccugcagccgccaccac

SEQ ID NO: 21371 - RNA, 18 nt, artificial
  Chemically synthesized
gcgaccugcucacgcuga

SEQ ID NO: 21372 - RNA, 18 nt, artificial
  Chemically synthesized
gugccacauccuggacua

SEQ ID NO: 21373 - RNA, 18 nt, artificial
  Chemically synthesized
aauguguucucggagugu

SEQ ID NO: 21374 - RNA, 18 nt, artificial
  Chemically synthesized
gcaguggacucagcagca

SEQ ID NO: 21375 - RNA, 18 nt, artificial
  Chemically synthesized
cagcccucccaccagcau

SEQ ID NO: 21376 - RNA, 18 nt, artificial
  Chemically synthesized
gaccaccggcaguggacu

SEQ ID NO: 21377 - RNA, 18 nt, artificial
  Chemically synthesized
auccuggacuacagcuuc

SEQ ID NO: 21378 - RNA, 18 nt, artificial
  Chemically synthesized
gcguccuuugguccuguc

SEQ ID NO: 21379 - RNA, 18 nt, artificial
  Chemically synthesized
acuaugagagcuucuccu

SEQ ID NO: 21380 - RNA, 18 nt, artificial
  Chemically synthesized
cugagagccaggguuuuc

SEQ ID NO: 21381 - RNA, 18 nt, artificial
  Chemically synthesized
gucuguugugugucaugc

SEQ ID NO: 21382 - RNA, 18 nt, artificial
  Chemically synthesized
gcuugugaaaauguguuc

SEQ ID NO: 21383 - RNA, 18 nt, artificial
  Chemically synthesized
cuguguggacgcgggcaa

SEQ ID NO: 21384 - RNA, 18 nt, artificial
  Chemically synthesized
gaaguugaacgagcauag

SEQ ID NO: 21385 - RNA, 18 nt, artificial
  Chemically synthesized
gcuacaggugccugagca

SEQ ID NO: 21386 - RNA, 18 nt, artificial
  Chemically synthesized
ggacuggugaggacugca

SEQ ID NO: 21387 - RNA, 18 nt, artificial
  Chemically synthesized
cacagacggcaucaacac

SEQ ID NO: 21388 - RNA, 18 nt, artificial
  Chemically synthesized
gcaugcaucacgacaucg

SEQ ID NO: 21389 - RNA, 18 nt, artificial
  Chemically synthesized
aacguggucuucaagcgu

SEQ ID NO: 21390 - RNA, 18 nt, artificial
  Chemically synthesized
aguccaaaaagcuccugg

SEQ ID NO: 21391 - RNA, 18 nt, artificial
  Chemically synthesized
gacaugaccaguggcuac

SEQ ID NO: 21392 - RNA, 18 nt, artificial
  Chemically synthesized
ccugcagcauggcauggu

SEQ ID NO: 21393 - RNA, 18 nt, artificial
  Chemically synthesized
gacgcaugcaucagcaac

SEQ ID NO: 21394 - RNA, 18 nt, artificial
  Chemically synthesized
guggcuacaacugcgugu

SEQ ID NO: 21395 - RNA, 18 nt, artificial
  Chemically synthesized
ggccacccagccucaccu

SEQ ID NO: 21396 - RNA, 18 nt, artificial
  Chemically synthesized
cgauguggacgagugugc

SEQ ID NO: 21397 - RNA, 18 nt, artificial
  Chemically synthesized
aggacaucaacgagugug

SEQ ID NO: 21398 - RNA, 18 nt, artificial
  Chemically synthesized
aggugucuuccagauccu

SEQ ID NO: 21399 - RNA, 18 nt, artificial
  Chemically synthesized
gccauguguuuuagaugg

SEQ ID NO: 21400 - RNA, 18 nt, artificial
  Chemically synthesized
acguaggaugaaaagauu

SEQ ID NO: 21401 - RNA, 18 nt, artificial
  Chemically synthesized
gccagcgccgccugcuuc

SEQ ID NO: 21402 - RNA, 18 nt, artificial
  Chemically synthesized
gacgucaacgccguagau

SEQ ID NO: 21403 - RNA, 18 nt, artificial
  Chemically synthesized
ggcccgcgaugcucccag

SEQ ID NO: 21404 - RNA, 18 nt, artificial
  Chemically synthesized
gccgggagggcuucagcg

SEQ ID NO: 21405 - RNA, 18 nt, artificial
  Chemically synthesized
ggaugucaacgagugugg

SEQ ID NO: 21406 - RNA, 18 nt, artificial
  Chemically synthesized
acgccugacugcacagag

SEQ ID NO: 21407 - RNA, 18 nt, artificial
  Chemically synthesized
ccugcacuccucagggca

SEQ ID NO: 21408 - RNA, 18 nt, artificial
  Chemically synthesized
gagggcuucaaagugucu

SEQ ID NO: 21409 - RNA, 18 nt, artificial
  Chemically synthesized
cgccgcugaucgaggagg

SEQ ID NO: 21410 - RNA, 18 nt, artificial
  Chemically synthesized
cgaccagggcugcaacag

SEQ ID NO: 21411 - RNA, 18 nt, artificial
  Chemically synthesized
gcugcacaccaacguggu

SEQ ID NO: 21412 - RNA, 18 nt, artificial
  Chemically synthesized
ggagaccaagaaguuccg

SEQ ID NO: 21413 - RNA, 18 nt, artificial
  Chemically synthesized
gcacaggagcgcaugcau

SEQ ID NO: 21414 - RNA, 18 nt, artificial
  Chemically synthesized
acaggcagcuacugugag

SEQ ID NO: 21415 - RNA, 18 nt, artificial
  Chemically synthesized
agaggcaaacggaggcaa

SEQ ID NO: 21416 - RNA, 18 nt, artificial
  Chemically synthesized
gggaguguggcaccaggc

SEQ ID NO: 21417 - RNA, 18 nt, artificial
  Chemically synthesized
cgcagcugcacuucaugu

SEQ ID NO: 21418 - RNA, 18 nt, artificial
  Chemically synthesized
uccucgcccugcaagaac

SEQ ID NO: 21419 - RNA, 18 nt, artificial
  Chemically synthesized
cauguguuuuagaugguu

SEQ ID NO: 21420 - RNA, 18 nt, artificial
  Chemically synthesized
gaguccgucaucaauggc

SEQ ID NO: 21421 - RNA, 18 nt, artificial
  Chemically synthesized
ccaagagugcacccaugg

SEQ ID NO: 21422 - RNA, 18 nt, artificial
  Chemically synthesized
gaccucaucaacucacac

SEQ ID NO: 21423 - RNA, 18 nt, artificial
  Chemically synthesized
agagccgggcacauugag

SEQ ID NO: 21424 - RNA, 18 nt, artificial
  Chemically synthesized
gcccaacccgugucacaa

SEQ ID NO: 21425 - RNA, 18 nt, artificial
  Chemically synthesized
cggacccaacacuuacac

SEQ ID NO: 21426 - RNA, 18 nt, artificial
  Chemically synthesized
auguaggcaucaugcaug

SEQ ID NO: 21427 - RNA, 18 nt, artificial
  Chemically synthesized
gagaagcugcauccagag

SEQ ID NO: 21428 - RNA, 18 nt, artificial
  Chemically synthesized
agcauguguaacaucaac

SEQ ID NO: 21429 - RNA, 18 nt, artificial
  Chemically synthesized
cggaaccgagccacagac

SEQ ID NO: 21430 - RNA, 18 nt, artificial
  Chemically synthesized
cgcucgccucgcugggca

SEQ ID NO: 21431 - RNA, 18 nt, artificial
  Chemically synthesized
gaguuccagugcaucugc

SEQ ID NO: 21432 - RNA, 18 nt, artificial
  Chemically synthesized
gugccaguacgaugugga

SEQ ID NO: 21433 - RNA, 18 nt, artificial
  Chemically synthesized
ccaacaccuacaagugcu

SEQ ID NO: 21434 - RNA, 18 nt, artificial
  Chemically synthesized
cugcucugaggagaucga

SEQ ID NO: 21435 - RNA, 18 nt, artificial
  Chemically synthesized
cggcaucaauggcuucac

SEQ ID NO: 21436 - RNA, 18 nt, artificial
  Chemically synthesized
gggcuccugcacagacgg

SEQ ID NO: 21437 - RNA, 18 nt, artificial
  Chemically synthesized
gcuuuaacaacggcaccu

SEQ ID NO: 21438 - RNA, 18 nt, artificial
  Chemically synthesized
ugcgagaucaaccuggau

SEQ ID NO: 21439 - RNA, 18 nt, artificial
  Chemically synthesized
gaugcagcagcagaaccu

SEQ ID NO: 21440 - RNA, 18 nt, artificial
  Chemically synthesized
ugcacaguagccuugcug

SEQ ID NO: 21441 - RNA, 18 nt, artificial
  Chemically synthesized
agugccagcugaugccaa

SEQ ID NO: 21442 - RNA, 18 nt, artificial
  Chemically synthesized
cguuccagcagucuccgu

SEQ ID NO: 21443 - RNA, 18 nt, artificial
  Chemically synthesized
acgucaacgagugcgucu

SEQ ID NO: 21444 - RNA, 18 nt, artificial
  Chemically synthesized
cccagaucgcccgcauuc

SEQ ID NO: 21445 - RNA, 18 nt, artificial
  Chemically synthesized
agacagaccaccggcagu

SEQ ID NO: 21446 - RNA, 18 nt, artificial
  Chemically synthesized
ccaacgucuccgacuggu

SEQ ID NO: 21447 - RNA, 18 nt, artificial
  Chemically synthesized
gaaacacugccuuuuuau

SEQ ID NO: 21448 - RNA, 18 nt, artificial
  Chemically synthesized
gaacaacacgccugacug

SEQ ID NO: 21449 - RNA, 18 nt, artificial
  Chemically synthesized
acaucaacgagugugcca

SEQ ID NO: 21450 - RNA, 18 nt, artificial
  Chemically synthesized
ggacgcgggcaacaaggu

SEQ ID NO: 21451 - RNA, 18 nt, artificial
  Chemically synthesized
gcuccuuccacuuccugc

SEQ ID NO: 21452 - RNA, 18 nt, artificial
  Chemically synthesized
gcagugcuuccagagugc

SEQ ID NO: 21453 - RNA, 18 nt, artificial
  Chemically synthesized
agcccugccugcauggcg

SEQ ID NO: 21454 - RNA, 18 nt, artificial
  Chemically synthesized
agaugcgucccaagaugu

SEQ ID NO: 21455 - RNA, 18 nt, artificial
  Chemically synthesized
cccguguuuuguaggaga

SEQ ID NO: 21456 - RNA, 18 nt, artificial
  Chemically synthesized
cgagaccgacaucgacga

SEQ ID NO: 21457 - RNA, 18 nt, artificial
  Chemically synthesized
cccugaccagugguccag

SEQ ID NO: 21458 - RNA, 18 nt, artificial
  Chemically synthesized
cgugcgagcugcccgagu

SEQ ID NO: 21459 - RNA, 18 nt, artificial
  Chemically synthesized
cgugcugcacaccaacgu

SEQ ID NO: 21460 - RNA, 18 nt, artificial
  Chemically synthesized
cggugacugcucccucaa

SEQ ID NO: 21461 - RNA, 18 nt, artificial
  Chemically synthesized
gccuaccucugcuucugc

SEQ ID NO: 21462 - RNA, 18 nt, artificial
  Chemically synthesized
gccgggcuacacagggag

SEQ ID NO: 21463 - RNA, 18 nt, artificial
  Chemically synthesized
ggcgugagcucagcagcc

SEQ ID NO: 21464 - RNA, 18 nt, artificial
  Chemically synthesized
gccugcagugcaacaacc

SEQ ID NO: 21465 - RNA, 18 nt, artificial
  Chemically synthesized
ccuggccuguggaagcaa

SEQ ID NO: 21466 - RNA, 18 nt, artificial
  Chemically synthesized
cguggacgacugcaaucc

SEQ ID NO: 21467 - RNA, 18 nt, artificial
  Chemically synthesized
cguaccugcggcagccug

SEQ ID NO: 21468 - RNA, 18 nt, artificial
  Chemically synthesized
gcaccuggaugccgcuga

SEQ ID NO: 21469 - RNA, 18 nt, artificial
  Chemically synthesized
ccaccugccggcaggaug

SEQ ID NO: 21470 - RNA, 18 nt, artificial
  Chemically synthesized
gaagguccgcaagcccag

SEQ ID NO: 21471 - RNA, 18 nt, artificial
  Chemically synthesized
ggugggcggcuacagcug

SEQ ID NO: 21472 - RNA, 18 nt, artificial
  Chemically synthesized
ccgaaugccaguucccgg

SEQ ID NO: 21473 - RNA, 18 nt, artificial
  Chemically synthesized
agcgcagaugccaacauc

SEQ ID NO: 21474 - RNA, 18 nt, artificial
  Chemically synthesized
gccuccuacaucugccac

SEQ ID NO: 21475 - RNA, 18 nt, artificial
  Chemically synthesized
accaacaucaacgagugu

SEQ ID NO: 21476 - RNA, 18 nt, artificial
  Chemically synthesized
gcgaggacggcaucaaug

SEQ ID NO: 21477 - RNA, 18 nt, artificial
  Chemically synthesized
caccaacccugucaaugg

SEQ ID NO: 21478 - RNA, 18 nt, artificial
  Chemically synthesized
uaaugaaugagucuguug

SEQ ID NO: 21479 - RNA, 18 nt, artificial
  Chemically synthesized
ugcacuucauguacgugg

SEQ ID NO: 21480 - RNA, 18 nt, artificial
  Chemically synthesized
ccggcaguggacucagca

SEQ ID NO: 21481 - RNA, 18 nt, artificial
  Chemically synthesized
ggcaguggacucagcagc

SEQ ID NO: 21482 - RNA, 18 nt, artificial
  Chemically synthesized
cgccaaggugcugcugga

SEQ ID NO: 21483 - RNA, 18 nt, artificial
  Chemically synthesized
ugagaacaacacgccuga

SEQ ID NO: 21484 - RNA, 18 nt, artificial
  Chemically synthesized
agggaaguugaacgagca

SEQ ID NO: 21485 - RNA, 18 nt, artificial
  Chemically synthesized
gagaccguggagccgccc

SEQ ID NO: 21486 - RNA, 18 nt, artificial
  Chemically synthesized
guuccgaagaagaugcuc

SEQ ID NO: 21487 - RNA, 18 nt, artificial
  Chemically synthesized
uggugugacuccucgccc

SEQ ID NO: 21488 - RNA, 18 nt, artificial
  Chemically synthesized
acugcauggacgucaaug

SEQ ID NO: 21489 - RNA, 18 nt, artificial
  Chemically synthesized
ccagggcacguguauuga

SEQ ID NO: 21490 - RNA, 18 nt, artificial
  Chemically synthesized
acugugacagccagugca

SEQ ID NO: 21491 - RNA, 18 nt, artificial
  Chemically synthesized
ccgccugccgcgcgacau

SEQ ID NO: 21492 - RNA, 18 nt, artificial
  Chemically synthesized
ccuugugcacugguguga

SEQ ID NO: 21493 - RNA, 18 nt, artificial
  Chemically synthesized
ugucaacgaguguggcca

SEQ ID NO: 21494 - RNA, 18 nt, artificial
  Chemically synthesized
gccacugcccacccagcu

SEQ ID NO: 21495 - RNA, 18 nt, artificial
  Chemically synthesized
cagagugagaccguggag

SEQ ID NO: 21496 - RNA, 18 nt, artificial
  Chemically synthesized
cgggcuggacugugcgga

SEQ ID NO: 21497 - RNA, 18 nt, artificial
  Chemically synthesized
cuacgagggugugcacug

SEQ ID NO: 21498 - RNA, 18 nt, artificial
  Chemically synthesized
gccagugagggacgucag

SEQ ID NO: 21499 - RNA, 18 nt, artificial
  Chemically synthesized
ugcucugaggagaucgac

SEQ ID NO: 21500 - RNA, 18 nt, artificial
  Chemically synthesized
acaaugagugugaaucca

SEQ ID NO: 21501 - RNA, 18 nt, artificial
  Chemically synthesized
ggcucaccuuccgcacgc

SEQ ID NO: 21502 - RNA, 18 nt, artificial
  Chemically synthesized
gccagcauggagggcucu

SEQ ID NO: 21503 - RNA, 18 nt, artificial
  Chemically synthesized
aacgagugcgucucgaac

SEQ ID NO: 21504 - RNA, 18 nt, artificial
  Chemically synthesized
aggaaacaacugcaagaa

SEQ ID NO: 21505 - RNA, 18 nt, artificial
  Chemically synthesized
cacuccucagggcagccu

SEQ ID NO: 21506 - RNA, 18 nt, artificial
  Chemically synthesized
augucaaugagugcgacu

SEQ ID NO: 21507 - RNA, 18 nt, artificial
  Chemically synthesized
gaggacugcagcgagaac

SEQ ID NO: 21508 - RNA, 18 nt, artificial
  Chemically synthesized
gagugcaggcaauccgag

SEQ ID NO: 21509 - RNA, 18 nt, artificial
  Chemically synthesized
caucaacgagugugccag

SEQ ID NO: 21510 - RNA, 18 nt, artificial
  Chemically synthesized
gcgaguggcugucccggc

SEQ ID NO: 21511 - RNA, 18 nt, artificial
  Chemically synthesized
cgcgacaacgccuaccuc

SEQ ID NO: 21512 - RNA, 18 nt, artificial
  Chemically synthesized
acaccaacccugucaaug

SEQ ID NO: 21513 - RNA, 18 nt, artificial
  Chemically synthesized
ccgcgacaacgccuaccu

SEQ ID NO: 21514 - RNA, 18 nt, artificial
  Chemically synthesized
gccaagagugcacccaug

SEQ ID NO: 21515 - RNA, 18 nt, artificial
  Chemically synthesized
gaaaauaucgacgauugu

SEQ ID NO: 21516 - RNA, 18 nt, artificial
  Chemically synthesized
uggcuaccugucagacgu

SEQ ID NO: 21517 - RNA, 18 nt, artificial
  Chemically synthesized
uucagguucaguauuaug

SEQ ID NO: 21518 - RNA, 18 nt, artificial
  Chemically synthesized
agaaaugauguuggagaa

SEQ ID NO: 21519 - RNA, 18 nt, artificial
  Chemically synthesized
cagacgugcagccacugg

SEQ ID NO: 21520 - RNA, 18 nt, artificial
  Chemically synthesized
agcuacgagaccgccaag

SEQ ID NO: 21521 - RNA, 18 nt, artificial
  Chemically synthesized
caccgacguggccgcauu

SEQ ID NO: 21522 - RNA, 18 nt, artificial
  Chemically synthesized
gcauggcggcaccuguca

SEQ ID NO: 21523 - RNA, 18 nt, artificial
  Chemically synthesized
ccaacugcacggacugcg

SEQ ID NO: 21524 - RNA, 18 nt, artificial
  Chemically synthesized
ccaaggaccucaaggcac

SEQ ID NO: 21525 - RNA, 18 nt, artificial
  Chemically synthesized
ugcagugcaacaaccacg

SEQ ID NO: 21526 - RNA, 18 nt, artificial
  Chemically synthesized
cugguucccugagggcuu

SEQ ID NO: 21527 - RNA, 18 nt, artificial
  Chemically synthesized
agcgcggagugcgagugg

SEQ ID NO: 21528 - RNA, 18 nt, artificial
  Chemically synthesized
caacaucgaugagugugc

SEQ ID NO: 21529 - RNA, 18 nt, artificial
  Chemically synthesized
cgggcuacacagggagca

SEQ ID NO: 21530 - RNA, 18 nt, artificial
  Chemically synthesized
auguuggagaagggaagu

SEQ ID NO: 21531 - RNA, 18 nt, artificial
  Chemically synthesized
ccagaaccuugugcacug

SEQ ID NO: 21532 - RNA, 18 nt, artificial
  Chemically synthesized
cuggcggugcacacuauu

SEQ ID NO: 21533 - RNA, 18 nt, artificial
  Chemically synthesized
cccaggacggcaagggcu

SEQ ID NO: 21534 - RNA, 18 nt, artificial
  Chemically synthesized
caguggacucagcagcac

SEQ ID NO: 21535 - RNA, 18 nt, artificial
  Chemically synthesized
aacgagugugcguccaac

SEQ ID NO: 21536 - RNA, 18 nt, artificial
  Chemically synthesized
agagcuccugcuucaacg

SEQ ID NO: 21537 - RNA, 18 nt, artificial
  Chemically synthesized
uauacaaguucuuggucc

SEQ ID NO: 21538 - RNA, 18 nt, artificial
  Chemically synthesized
gugaacaccuacaacugc

SEQ ID NO: 21539 - RNA, 18 nt, artificial
  Chemically synthesized
gggacgcuccgcugccgu

SEQ ID NO: 21540 - RNA, 18 nt, artificial
  Chemically synthesized
cgugugagguggugcugg

SEQ ID NO: 21541 - RNA, 18 nt, artificial
  Chemically synthesized
gugagaaugacgcucgua

SEQ ID NO: 21542 - RNA, 18 nt, artificial
  Chemically synthesized
gcacgggcgagaccgccu

SEQ ID NO: 21543 - RNA, 18 nt, artificial
  Chemically synthesized
gguucgaggagcccgugg

SEQ ID NO: 21544 - RNA, 18 nt, artificial
  Chemically synthesized
ggugcacacuauucugcc

SEQ ID NO: 21545 - RNA, 18 nt, artificial
  Chemically synthesized
cagcagucuccguccgug

SEQ ID NO: 21546 - RNA, 18 nt, artificial
  Chemically synthesized
cgaccagggcugcaacag

SEQ ID NO: 21547 - RNA, 18 nt, artificial
  Chemically synthesized
ucaguacuguaccgagga

SEQ ID NO: 21548 - RNA, 18 nt, artificial
  Chemically synthesized
agcagauuuuugcaauac

SEQ ID NO: 21549 - RNA, 18 nt, artificial
  Chemically synthesized
ccguuccagcagucuccg

SEQ ID NO: 21550 - RNA, 18 nt, artificial
  Chemically synthesized
gccugggucacacacgga

SEQ ID NO: 21551 - RNA, 18 nt, artificial
  Chemically synthesized
ggaguacaagugccgcug

SEQ ID NO: 21552 - RNA, 18 nt, artificial
  Chemically synthesized
caggaugucaacgagugu

SEQ ID NO: 21553 - RNA, 18 nt, artificial
  Chemically synthesized
ugagucuguuguguguca

SEQ ID NO: 21554 - RNA, 18 nt, artificial
  Chemically synthesized
gcagacgugcagccacug

SEQ ID NO: 21555 - RNA, 18 nt, artificial
  Chemically synthesized
cggcuacgagggugugca

SEQ ID NO: 21556 - RNA, 18 nt, artificial
  Chemically synthesized
agcccaguuccugacgcc

SEQ ID NO: 21557 - RNA, 18 nt, artificial
  Chemically synthesized
ccagugucugcagggcua

SEQ ID NO: 21558 - RNA, 18 nt, artificial
  Chemically synthesized
gugaggucgacaucaacg

SEQ ID NO: 21559 - RNA, 18 nt, artificial
  Chemically synthesized
ccugaccagugguccagc

SEQ ID NO: 21560 - RNA, 18 nt, artificial
  Chemically synthesized
gaugccaaaugccugcca

SEQ ID NO: 21561 - RNA, 18 nt, artificial
  Chemically synthesized
agcgccugcuggaggcca

SEQ ID NO: 21562 - RNA, 18 nt, artificial
  Chemically synthesized
uggcacgacgccacugau

SEQ ID NO: 21563 - RNA, 18 nt, artificial
  Chemically synthesized
gggaccugccacaacacc

SEQ ID NO: 21564 - RNA, 18 nt, artificial
  Chemically synthesized
ccugcaagaauggugcca

SEQ ID NO: 21565 - RNA, 18 nt, artificial
  Chemically synthesized
gacgagugccagcugaug

SEQ ID NO: 21566 - RNA, 18 nt, artificial
  Chemically synthesized
cagccugcacaguguccc

SEQ ID NO: 21567 - RNA, 18 nt, artificial
  Chemically synthesized
ggcggccaagcccgagau

SEQ ID NO: 21568 - RNA, 18 nt, artificial
  Chemically synthesized
gggccugauggcuucacc

SEQ ID NO: 21569 - RNA, 18 nt, artificial
  Chemically synthesized
gccagcaaacauccagca

SEQ ID NO: 21570 - RNA, 18 nt, artificial
  Chemically synthesized
gaucgacgagugccucuc

SEQ ID NO: 21571 - RNA, 18 nt, artificial
  Chemically synthesized
cgaaccaauacaacccuc

SEQ ID NO: 21572 - RNA, 18 nt, artificial
  Chemically synthesized
cacaggacccaacugcga

SEQ ID NO: 21573 - RNA, 18 nt, artificial
  Chemically synthesized
aguuugaauggucaaugc

SEQ ID NO: 21574 - RNA, 18 nt, artificial
  Chemically synthesized
ggcuaccugggcagccuc

SEQ ID NO: 21575 - RNA, 18 nt, artificial
  Chemically synthesized
acgagugcgucucgaacc

SEQ ID NO: 21576 - RNA, 18 nt, artificial
  Chemically synthesized
gggcaacagcgaggaaga

SEQ ID NO: 21577 - RNA, 18 nt, artificial
  Chemically synthesized
acaaaacuuacagaugca

SEQ ID NO: 21578 - RNA, 18 nt, artificial
  Chemically synthesized
ccucgcagugcuuccaga

SEQ ID NO: 21579 - RNA, 18 nt, artificial
  Chemically synthesized
gaugcgucccaagauguu

SEQ ID NO: 21580 - RNA, 18 nt, artificial
  Chemically synthesized
gccgcugcccgccagagu

SEQ ID NO: 21581 - RNA, 18 nt, artificial
  Chemically synthesized
ggccugccgggacagccu

SEQ ID NO: 21582 - RNA, 18 nt, artificial
  Chemically synthesized
cagccaggacguggauga

SEQ ID NO: 21583 - RNA, 18 nt, artificial
  Chemically synthesized
ugagaaugacgcucguac

SEQ ID NO: 21584 - RNA, 18 nt, artificial
  Chemically synthesized
caacugccagaccaacau

SEQ ID NO: 21585 - RNA, 18 nt, artificial
  Chemically synthesized
gaaauaggaaacaaguga

SEQ ID NO: 21586 - RNA, 18 nt, artificial
  Chemically synthesized
acguguauugacgacguu

SEQ ID NO: 21587 - RNA, 18 nt, artificial
  Chemically synthesized
cagaaacacugccuuuuu

SEQ ID NO: 21588 - RNA, 18 nt, artificial
  Chemically synthesized
cgccugugccagcaugga

SEQ ID NO: 21589 - RNA, 18 nt, artificial
  Chemically synthesized
cugcgagcaugcgggcaa

SEQ ID NO: 21590 - RNA, 18 nt, artificial
  Chemically synthesized
cgccguggccuccaacac

SEQ ID NO: 21591 - RNA, 18 nt, artificial
  Chemically synthesized
cagccaccagcuacaggu

SEQ ID NO: 21592 - RNA, 18 nt, artificial
  Chemically synthesized
gccuggacggacccaaca

SEQ ID NO: 21593 - RNA, 18 nt, artificial
  Chemically synthesized
agggcuucaaagugucug

SEQ ID NO: 21594 - RNA, 18 nt, artificial
  Chemically synthesized
gagccuuagccgcccaug

SEQ ID NO: 21595 - RNA, 18 nt, artificial
  Chemically synthesized
ugucuggacaagaucgau

SEQ ID NO: 21596 - RNA, 18 nt, artificial
  Chemically synthesized
ggcggcaccugucaggac

SEQ ID NO: 21597 - RNA, 18 nt, artificial
  Chemically synthesized
gucccacccgugaccgca

SEQ ID NO: 21598 - RNA, 18 nt, artificial
  Chemically synthesized
guaacgagggcuccaacu

SEQ ID NO: 21599 - RNA, 18 nt, artificial
  Chemically synthesized
gggaggagcagauuuuug

SEQ ID NO: 21600 - RNA, 18 nt, artificial
  Chemically synthesized
aaugaaugagucuguugu

SEQ ID NO: 21601 - RNA, 18 nt, artificial
  Chemically synthesized
ggguuagauguugccaug

SEQ ID NO: 21602 - RNA, 18 nt, artificial
  Chemically synthesized
gggcucuugugccacauc

SEQ ID NO: 21603 - RNA, 18 nt, artificial
  Chemically synthesized
gacccacacccaguaccg

SEQ ID NO: 21604 - RNA, 18 nt, artificial
  Chemically synthesized
guugugugucaugccagu

SEQ ID NO: 21605 - RNA, 18 nt, artificial
  Chemically synthesized
caagaacgccgggacaug

SEQ ID NO: 21606 - RNA, 18 nt, artificial
  Chemically synthesized
cgcucugcucgcccaacg

SEQ ID NO: 21607 - RNA, 18 nt, artificial
  Chemically synthesized
cuccagcccucccaccag

SEQ ID NO: 21608 - RNA, 18 nt, artificial
  Chemically synthesized
caggguuuuccuacguag

SEQ ID NO: 21609 - RNA, 18 nt, artificial
  Chemically synthesized
agcaugcuugugaaaaug

SEQ ID NO: 21610 - RNA, 18 nt, artificial
  Chemically synthesized
cgagcaugcgggcaagug

SEQ ID NO: 21611 - RNA, 18 nt, artificial
  Chemically synthesized
gagugccagugucugcag

SEQ ID NO: 21612 - RNA, 18 nt, artificial
  Chemically synthesized
ccaagccuucgggcgucu

SEQ ID NO: 21613 - RNA, 18 nt, artificial
  Chemically synthesized
ccugcggcagccugcgcu

SEQ ID NO: 21614 - RNA, 18 nt, artificial
  Chemically synthesized
gcguggaccaggugggcg

SEQ ID NO: 21615 - RNA, 18 nt, artificial
  Chemically synthesized
agugcguucugagcccgu

SEQ ID NO: 21616 - RNA, 18 nt, artificial
  Chemically synthesized
gucugaaccagggcacgu

SEQ ID NO: 21617 - RNA, 18 nt, artificial
  Chemically synthesized
caugucugaaccagggca

SEQ ID NO: 21618 - RNA, 18 nt, artificial
  Chemically synthesized
guggcaccugcguggacg

SEQ ID NO: 21619 - RNA, 18 nt, artificial
  Chemically synthesized
gggcacuuucugugagga

SEQ ID NO: 21620 - RNA, 18 nt, artificial
  Chemically synthesized
gcuacacagggagcaugu

SEQ ID NO: 21621 - RNA, 18 nt, artificial
  Chemically synthesized
cuccucgcccugcaagaa

SEQ ID NO: 21622 - RNA, 18 nt, artificial
  Chemically synthesized
ugugagccgggcuacaca

SEQ ID NO: 21623 - RNA, 18 nt, artificial
  Chemically synthesized
aaccuugugcacuggugu

SEQ ID NO: 21624 - RNA, 18 nt, artificial
  Chemically synthesized
ggccgccgccgugaacaa

SEQ ID NO: 21625 - RNA, 18 nt, artificial
  Chemically synthesized
gagaccgccaaggugcug

SEQ ID NO: 21626 - RNA, 18 nt, artificial
  Chemically synthesized
gacgagugcucacccagc

SEQ ID NO: 21627 - RNA, 18 nt, artificial
  Chemically synthesized
gaagaagaugcuccagca

SEQ ID NO: 21628 - RNA, 18 nt, artificial
  Chemically synthesized
agccgggcuacacaggga

SEQ ID NO: 21629 - RNA, 18 nt, artificial
  Chemically synthesized
gugcugcuggaccacuuu

SEQ ID NO: 21630 - RNA, 18 nt, artificial
  Chemically synthesized
gccuuugagacuggccca

SEQ ID NO: 21631 - RNA, 18 nt, artificial
  Chemically synthesized
acugcaaggaccacuuca

SEQ ID NO: 21632 - RNA, 18 nt, artificial
  Chemically synthesized
cauuccggaggccuucaa

SEQ ID NO: 21633 - RNA, 18 nt, artificial
  Chemically synthesized
gcagaccugugaggucga

SEQ ID NO: 21634 - RNA, 18 nt, artificial
  Chemically synthesized
ccuucgggcgucugugug

SEQ ID NO: 21635 - RNA, 18 nt, artificial
  Chemically synthesized
agugcuccagccagcccu

SEQ ID NO: 21636 - RNA, 18 nt, artificial
  Chemically synthesized
caucgaugagugugcggg

SEQ ID NO: 21637 - RNA, 18 nt, artificial
  Chemically synthesized
gcuucagcggucccaacu

SEQ ID NO: 21638 - RNA, 18 nt, artificial
  Chemically synthesized
ccaccugggccggagcuu

SEQ ID NO: 21639 - RNA, 18 nt, artificial
  Chemically synthesized
gggacaugccacguggug

SEQ ID NO: 21640 - RNA, 18 nt, artificial
  Chemically synthesized
ggcuaccgcugccacugc

SEQ ID NO: 21641 - RNA, 18 nt, artificial
  Chemically synthesized
cacagcuacuccucgccu

SEQ ID NO: 21642 - RNA, 18 nt, artificial
  Chemically synthesized
cgaccaguacugcaagga

SEQ ID NO: 21643 - RNA, 18 nt, artificial
  Chemically synthesized
gggcgccagccugcacaa

SEQ ID NO: 21644 - RNA, 18 nt, artificial
  Chemically synthesized
ggccaccacugcgagacc

SEQ ID NO: 21645 - RNA, 18 nt, artificial
  Chemically synthesized
gccgggacagccucaacg

SEQ ID NO: 21646 - RNA, 18 nt, artificial
  Chemically synthesized
cgugaacaauguggaugc

SEQ ID NO: 21647 - RNA, 18 nt, artificial
  Chemically synthesized
gacgucacccacgagugu

SEQ ID NO: 21648 - RNA, 18 nt, artificial
  Chemically synthesized
guccgucaucaauggcug

SEQ ID NO: 21649 - RNA, 18 nt, artificial
  Chemically synthesized
guccugggcuccagcagc

SEQ ID NO: 21650 - RNA, 18 nt, artificial
  Chemically synthesized
gcuucgagggcgccacgu

SEQ ID NO: 21651 - RNA, 18 nt, artificial
  Chemically synthesized
acaaguucuuggucccuc

SEQ ID NO: 21652 - RNA, 18 nt, artificial
  Chemically synthesized
acagaugcagcagcagaa

SEQ ID NO: 21653 - RNA, 18 nt, artificial
  Chemically synthesized
gccagaacggcgggaccu

SEQ ID NO: 21654 - RNA, 18 nt, artificial
  Chemically synthesized
agcugaugccaaaugccu

SEQ ID NO: 21655 - RNA, 18 nt, artificial
  Chemically synthesized
cugccggcaggaugucaa

SEQ ID NO: 21656 - RNA, 18 nt, artificial
  Chemically synthesized
ugguuucuugcaagcaug

SEQ ID NO: 21657 - RNA, 18 nt, artificial
  Chemically synthesized
gccgugcagagugagacc

SEQ ID NO: 21658 - RNA, 18 nt, artificial
  Chemically synthesized
cagaccaccggcagugga

SEQ ID NO: 21659 - RNA, 18 nt, artificial
  Chemically synthesized
agcuacacgugcaccugc

SEQ ID NO: 21660 - RNA, 18 nt, artificial
  Chemically synthesized
guuccagcagucuccguc

SEQ ID NO: 21661 - RNA, 18 nt, artificial
  Chemically synthesized
cacggaaggguacacggg

SEQ ID NO: 21662 - RNA, 18 nt, artificial
  Chemically synthesized
gcugcacuucauguacgu

SEQ ID NO: 21663 - RNA, 18 nt, artificial
  Chemically synthesized
uacaugaggaacuguaga

SEQ ID NO: 21664 - RNA, 18 nt, artificial
  Chemically synthesized
cgccaagcgccugcugga

SEQ ID NO: 21665 - RNA, 18 nt, artificial
  Chemically synthesized
uguggacuguggcacuug

SEQ ID NO: 21666 - RNA, 18 nt, artificial
  Chemically synthesized
acggaggcauccuacccu

SEQ ID NO: 21667 - RNA, 18 nt, artificial
  Chemically synthesized
cgggcuucacugggcauc

SEQ ID NO: 21668 - RNA, 18 nt, artificial
  Chemically synthesized
gagggugugcacugcgag

SEQ ID NO: 21669 - RNA, 18 nt, artificial
  Chemically synthesized
agaccaccggcaguggac

SEQ ID NO: 21670 - RNA, 18 nt, artificial
  Chemically synthesized
gccaggcagacgugcagc

SEQ ID NO: 21671 - RNA, 18 nt, artificial
  Chemically synthesized
gaagugugaagcggccaa

SEQ ID NO: 21672 - RNA, 18 nt, artificial
  Chemically synthesized
uggacucccuggagucac

SEQ ID NO: 21673 - RNA, 18 nt, artificial
  Chemically synthesized
agcuccugcuucaacggu

SEQ ID NO: 21674 - RNA, 18 nt, artificial
  Chemically synthesized
caacugcgugugugucaa

SEQ ID NO: 21675 - RNA, 18 nt, artificial
  Chemically synthesized
caauccgaggacuaugag

SEQ ID NO: 21676 - RNA, 18 nt, artificial
  Chemically synthesized
gugcaacucagccggcug

SEQ ID NO: 21677 - RNA, 18 nt, artificial
  Chemically synthesized
ucaacaucgaugagugug

SEQ ID NO: 21678 - RNA, 18 nt, artificial
  Chemically synthesized
ggacaucaacgagugugc

SEQ ID NO: 21679 - RNA, 18 nt, artificial
  Chemically synthesized
gcucuugugccacauccu

SEQ ID NO: 21680 - RNA, 18 nt, artificial
  Chemically synthesized
uccggaaccgagccacag

SEQ ID NO: 21681 - RNA, 18 nt, artificial
  Chemically synthesized
ugccuggacaagaucaau

SEQ ID NO: 21682 - RNA, 18 nt, artificial
  Chemically synthesized
gcagaugccaacauccag

SEQ ID NO: 21683 - RNA, 18 nt, artificial
  Chemically synthesized
acgauguggacgagugug

SEQ ID NO: 21684 - RNA, 18 nt, artificial
  Chemically synthesized
gcaccguccugggcucca

SEQ ID NO: 21685 - RNA, 18 nt, artificial
  Chemically synthesized
ccagggcgccagccugca

SEQ ID NO: 21686 - RNA, 18 nt, artificial
  Chemically synthesized
cgccucgcugggcagccu

SEQ ID NO: 21687 - RNA, 18 nt, artificial
  Chemically synthesized
gccgacgucaacgccgua

SEQ ID NO: 21688 - RNA, 18 nt, artificial
  Chemically synthesized
cggcgcauccugccagaa

SEQ ID NO: 21689 - RNA, 18 nt, artificial
  Chemically synthesized
agcgacaagguguugacg

SEQ ID NO: 21690 - RNA, 18 nt, artificial
  Chemically synthesized
gcugcgcaacagcuccuu

SEQ ID NO: 21691 - RNA, 18 nt, artificial
  Chemically synthesized
gcaaggccaucugcaccu

SEQ ID NO: 21692 - RNA, 18 nt, artificial
  Chemically synthesized
gagaucaaccuggaugac

SEQ ID NO: 21693 - RNA, 18 nt, artificial
  Chemically synthesized
agugugcguccaacccau

SEQ ID NO: 21694 - RNA, 18 nt, artificial
  Chemically synthesized
gccaguucccggccagca

SEQ ID NO: 21695 - RNA, 18 nt, artificial
  Chemically synthesized
gccaggaccgcgacaacg

SEQ ID NO: 21696 - RNA, 18 nt, artificial
  Chemically synthesized
ccagcugaugccaaaugc

SEQ ID NO: 21697 - RNA, 18 nt, artificial
  Chemically synthesized
agcgccgccugcuuccac

SEQ ID NO: 21698 - RNA, 18 nt, artificial
  Chemically synthesized
cagcaggugcagccacaa

SEQ ID NO: 21699 - RNA, 18 nt, artificial
  Chemically synthesized
ugcaucugaaauaggaaa

SEQ ID NO: 21700 - RNA, 18 nt, artificial
  Chemically synthesized
cuucuaccguugccugug

SEQ ID NO: 21701 - RNA, 18 nt, artificial
  Chemically synthesized
gcuccuaccgcugcgucu

SEQ ID NO: 21702 - RNA, 18 nt, artificial
  Chemically synthesized
cggaguacaagugccgcu

SEQ ID NO: 21703 - RNA, 18 nt, artificial
  Chemically synthesized
cugccagcgugcggaagg

SEQ ID NO: 21704 - RNA, 18 nt, artificial
  Chemically synthesized
caaggucugcagccugca

SEQ ID NO: 21705 - RNA, 18 nt, artificial
  Chemically synthesized
gccaccagcuacaggugc

SEQ ID NO: 21706 - RNA, 18 nt, artificial
  Chemically synthesized
cuccagcaacacagccug

SEQ ID NO: 21707 - RNA, 18 nt, artificial
  Chemically synthesized
cuucgaggccuccuacau

SEQ ID NO: 21708 - RNA, 18 nt, artificial
  Chemically synthesized
cugcacagacggcaucaa

SEQ ID NO: 21709 - RNA, 18 nt, artificial
  Chemically synthesized
cuguguggacggcgugaa

SEQ ID NO: 21710 - RNA, 18 nt, artificial
  Chemically synthesized
ggacaacaugggccgcac

SEQ ID NO: 21711 - RNA, 18 nt, artificial
  Chemically synthesized
ggcggcuaccgcugccac

SEQ ID NO: 21712 - RNA, 18 nt, artificial
  Chemically synthesized
acagagagcuccugcuuc

SEQ ID NO: 21713 - RNA, 18 nt, artificial
  Chemically synthesized
aucuuuguuucagguuca

SEQ ID NO: 21714 - RNA, 18 nt, artificial
  Chemically synthesized
ccugcuuccacggcgcca

SEQ ID NO: 21715 - RNA, 18 nt, artificial
  Chemically synthesized
gaugaaaagauucuucug

SEQ ID NO: 21716 - RNA, 18 nt, artificial
  Chemically synthesized
cucacacgccgacgucaa

SEQ ID NO: 21717 - RNA, 18 nt, artificial
  Chemically synthesized
ggccagugccugcccuuc

SEQ ID NO: 21718 - RNA, 18 nt, artificial
  Chemically synthesized
caacaucaacgagugcuc

SEQ ID NO: 21719 - RNA, 18 nt, artificial
  Chemically synthesized
cccuggaagaacugcacg

SEQ ID NO: 21720 - RNA, 18 nt, artificial
  Chemically synthesized
gcaccuggccgcccgcua

SEQ ID NO: 21721 - RNA, 18 nt, artificial
  Chemically synthesized
aaugagugugaauccaac

SEQ ID NO: 21722 - RNA, 18 nt, artificial
  Chemically synthesized
acaaccagacagaccgca

SEQ ID NO: 21723 - RNA, 18 nt, artificial
  Chemically synthesized
caugaccaguggcuacgu

SEQ ID NO: 21724 - RNA, 18 nt, artificial
  Chemically synthesized
caccugcaaagacaugac

SEQ ID NO: 21725 - RNA, 18 nt, artificial
  Chemically synthesized
cucccucaacuucaauga

SEQ ID NO: 21726 - RNA, 18 nt, artificial
  Chemically synthesized
gucaacacagacgagugu

SEQ ID NO: 21727 - RNA, 18 nt, artificial
  Chemically synthesized
guccaggccgcgcccuuu

SEQ ID NO: 21728 - RNA, 18 nt, artificial
  Chemically synthesized
gcguguccugugaggugg

SEQ ID NO: 21729 - RNA, 18 nt, artificial
  Chemically synthesized
uguuaggagaagcugcau

SEQ ID NO: 21730 - RNA, 18 nt, artificial
  Chemically synthesized
gacaucacggaucauaug

SEQ ID NO: 21731 - RNA, 18 nt, artificial
  Chemically synthesized
gggcuucgagggcgccac

SEQ ID NO: 21732 - RNA, 18 nt, artificial
  Chemically synthesized
caucaauggcugcaaagg

SEQ ID NO: 21733 - RNA, 18 nt, artificial
  Chemically synthesized
cccugucaauggcaaggc

SEQ ID NO: 21734 - RNA, 18 nt, artificial
  Chemically synthesized
gcgacugugacccugggu

SEQ ID NO: 21735 - RNA, 18 nt, artificial
  Chemically synthesized
cguggaugagugcucgcu

SEQ ID NO: 21736 - RNA, 18 nt, artificial
  Chemically synthesized
ccagcucgcgggacccga

SEQ ID NO: 21737 - RNA, 18 nt, artificial
  Chemically synthesized
ggugaaggccucgcugcu

SEQ ID NO: 21738 - RNA, 18 nt, artificial
  Chemically synthesized
ggucggcuccuaccgcug

SEQ ID NO: 21739 - RNA, 18 nt, artificial
  Chemically synthesized
gauguugccauguguuuu

SEQ ID NO: 21740 - RNA, 18 nt, artificial
  Chemically synthesized
gaucgacgucaacgagug

SEQ ID NO: 21741 - RNA, 18 nt, artificial
  Chemically synthesized
cgcaccuuggcgugagcu

SEQ ID NO: 21742 - RNA, 18 nt, artificial
  Chemically synthesized
guucuuggucccuccaga

SEQ ID NO: 21743 - RNA, 18 nt, artificial
  Chemically synthesized
cugcagccugcagugcaa

SEQ ID NO: 21744 - RNA, 18 nt, artificial
  Chemically synthesized
cuguaacgagggcuccaa

SEQ ID NO: 21745 - RNA, 18 nt, artificial
  Chemically synthesized
cuccagcccucccaccag

SEQ ID NO: 21746 - RNA, 18 nt, artificial
  Chemically synthesized
acaagaucaaugaguucc

SEQ ID NO: 21747 - RNA, 18 nt, artificial
  Chemically synthesized
agaacggcggcaaaugcu

SEQ ID NO: 21748 - RNA, 18 nt, artificial
  Chemically synthesized
gccacaacacccacggug

SEQ ID NO: 21749 - RNA, 18 nt, artificial
  Chemically synthesized
agauugacaaccggcagu

SEQ ID NO: 21750 - RNA, 18 nt, artificial
  Chemically synthesized
acgagugcguucugagcc

SEQ ID NO: 21751 - RNA, 18 nt, artificial
  Chemically synthesized
gugucaacggcggcaccu

SEQ ID NO: 21752 - RNA, 18 nt, artificial
  Chemically synthesized
ggacggcgugaacaccua

SEQ ID NO: 21753 - RNA, 18 nt, artificial
  Chemically synthesized
ccuggugcgcagcccgca

SEQ ID NO: 21754 - RNA, 18 nt, artificial
  Chemically synthesized
cccugagcacacaggccc

SEQ ID NO: 21755 - RNA, 18 nt, artificial
  Chemically synthesized
aggcacggaggaagaagu

SEQ ID NO: 21756 - RNA, 18 nt, artificial
  Chemically synthesized
gccgugaacaauguggau

SEQ ID NO: 21757 - RNA, 18 nt, artificial
  Chemically synthesized
ccugccuguuaggagaag

SEQ ID NO: 21758 - RNA, 18 nt, artificial
  Chemically synthesized
aggaccuggagaccaaga

SEQ ID NO: 21759 - RNA, 18 nt, artificial
  Chemically synthesized
ccugauccggaaccgagc

SEQ ID NO: 21760 - RNA, 18 nt, artificial
  Chemically synthesized
auggacgacaaccagaau

SEQ ID NO: 21761 - RNA, 18 nt, artificial
  Chemically synthesized
ugcgggcaagugcaucaa

SEQ ID NO: 21762 - RNA, 18 nt, artificial
  Chemically synthesized
gugcugaugccgccggag

SEQ ID NO: 21763 - RNA, 18 nt, artificial
  Chemically synthesized
cacgcugggcuccuucga

SEQ ID NO: 21764 - RNA, 18 nt, artificial
  Chemically synthesized
cagcuacugugaggaccu

SEQ ID NO: 21765 - RNA, 18 nt, artificial
  Chemically synthesized
ggaugccgcugaccugcg

SEQ ID NO: 21766 - RNA, 18 nt, artificial
  Chemically synthesized
ccgccugcuuccacggcg

SEQ ID NO: 21767 - RNA, 18 nt, artificial
  Chemically synthesized
ccaggacguggaugagug

SEQ ID NO: 21768 - RNA, 18 nt, artificial
  Chemically synthesized
gcaaaggcaagcccugca

SEQ ID NO: 21769 - RNA, 18 nt, artificial
  Chemically synthesized
agggcuccaacugcgaca

SEQ ID NO: 21770 - RNA, 18 nt, artificial
  Chemically synthesized
ugaggagaucgacgagug

SEQ ID NO: 21771 - RNA, 18 nt, artificial
  Chemically synthesized
cgccguagaugaccuggg

SEQ ID NO: 21772 - RNA, 18 nt, artificial
  Chemically synthesized
auguguaacaucaacauc

SEQ ID NO: 21773 - RNA, 18 nt, artificial
  Chemically synthesized
ugggcaucugugccagua

SEQ ID NO: 21774 - RNA, 18 nt, artificial
  Chemically synthesized
ugucuuccagauccugau

SEQ ID NO: 21775 - RNA, 18 nt, artificial
  Chemically synthesized
gguggacgagugcucacc

SEQ ID NO: 21776 - RNA, 18 nt, artificial
  Chemically synthesized
cuaccagggcgccagccu

SEQ ID NO: 21777 - RNA, 18 nt, artificial
  Chemically synthesized
ccggcugcagagcggcau

SEQ ID NO: 21778 - RNA, 18 nt, artificial
  Chemically synthesized
cugcgaccugcucacgcu

SEQ ID NO: 21779 - RNA, 18 nt, artificial
  Chemically synthesized
cgcgacaucgcacaggag

SEQ ID NO: 21780 - RNA, 18 nt, artificial
  Chemically synthesized
cagaguggacaggucagu

SEQ ID NO: 21781 - RNA, 18 nt, artificial
  Chemically synthesized
ugcguccuuugguccugu

SEQ ID NO: 21782 - RNA, 18 nt, artificial
  Chemically synthesized
gccgggacaugccacgug

SEQ ID NO: 21783 - RNA, 18 nt, artificial
  Chemically synthesized
cggagcagcugcgcaaca

SEQ ID NO: 21784 - RNA, 18 nt, artificial
  Chemically synthesized
aagagugcacccauggua

SEQ ID NO: 21785 - RNA, 18 nt, artificial
  Chemically synthesized
agaaacacugccuuuuua

SEQ ID NO: 21786 - RNA, 18 nt, artificial
  Chemically synthesized
cugcauccagaggcaaac

SEQ ID NO: 21787 - RNA, 18 nt, artificial
  Chemically synthesized
ggcacccagaacugcgug

SEQ ID NO: 21788 - RNA, 18 nt, artificial
  Chemically synthesized
gccgcaguugugcuccug

SEQ ID NO: 21789 - RNA, 18 nt, artificial
  Chemically synthesized
aagggaaguugaacgagc

SEQ ID NO: 21790 - RNA, 18 nt, artificial
  Chemically synthesized
gucuccgacugguccgag

SEQ ID NO: 21791 - RNA, 18 nt, artificial
  Chemically synthesized
gucugugugcgcucugug

SEQ ID NO: 21792 - RNA, 18 nt, artificial
  Chemically synthesized
cgcgaugcucccagcccg

SEQ ID NO: 21793 - RNA, 18 nt, artificial
  Chemically synthesized
cgccaaauucaacgggcu

SEQ ID NO: 21794 - RNA, 18 nt, artificial
  Chemically synthesized
agagagcuccugcuucaa

SEQ ID NO: 21795 - RNA, 18 nt, artificial
  Chemically synthesized
agacccacacccaguacc

SEQ ID NO: 21796 - RNA, 18 nt, artificial
  Chemically synthesized
gucaaugcgaguggcugu

SEQ ID NO: 21797 - RNA, 18 nt, artificial
  Chemically synthesized
ggugucuuccagauccug

SEQ ID NO: 21798 - RNA, 18 nt, artificial
  Chemically synthesized
gaccugugagcccacauc

SEQ ID NO: 21799 - RNA, 18 nt, artificial
  Chemically synthesized
ugccugcugcccuacaca

SEQ ID NO: 21800 - RNA, 18 nt, artificial
  Chemically synthesized
ccagacagaccaccggca

SEQ ID NO: 21801 - RNA, 18 nt, artificial
  Chemically synthesized
agccgggcacauugagcu

SEQ ID NO: 21802 - RNA, 18 nt, artificial
  Chemically synthesized
cauccagaggcaaacgga

SEQ ID NO: 21803 - RNA, 18 nt, artificial
  Chemically synthesized
cgaggaggcgugcgagcu

SEQ ID NO: 21804 - RNA, 18 nt, artificial
  Chemically synthesized
ugcacccaugguaccaau

SEQ ID NO: 21805 - RNA, 18 nt, artificial
  Chemically synthesized
ugugcacuggugugacuc

SEQ ID NO: 21806 - RNA, 18 nt, artificial
  Chemically synthesized
gcugccuggacaagauca

SEQ ID NO: 21807 - RNA, 18 nt, artificial
  Chemically synthesized
cagcguguccugugaggu

SEQ ID NO: 21808 - RNA, 18 nt, artificial
  Chemically synthesized
gcagaugccaacauccag

SEQ ID NO: 21809 - RNA, 18 nt, artificial
  Chemically synthesized
gcgucuccagcccuccca

SEQ ID NO: 21810 - RNA, 18 nt, artificial
  Chemically synthesized
ccggcagugugugcaggc

SEQ ID NO: 21811 - RNA, 18 nt, artificial
  Chemically synthesized
gguuucuugcaagcaugc

SEQ ID NO: 21812 - RNA, 18 nt, artificial
  Chemically synthesized
aucaaugaguuccagugc

SEQ ID NO: 21813 - RNA, 18 nt, artificial
  Chemically synthesized
cccauggcuaccugucag

SEQ ID NO: 21814 - RNA, 18 nt, artificial
  Chemically synthesized
gugcucgcugggugccaa

SEQ ID NO: 21815 - RNA, 18 nt, artificial
  Chemically synthesized
cugugcggagcauguacc

SEQ ID NO: 21816 - RNA, 18 nt, artificial
  Chemically synthesized
gagauggcggcgcugggu

SEQ ID NO: 21817 - RNA, 18 nt, artificial
  Chemically synthesized
gcacuggugugacuccuc

SEQ ID NO: 21818 - RNA, 18 nt, artificial
  Chemically synthesized
ggaggagcugcgcaagca

SEQ ID NO: 21819 - RNA, 18 nt, artificial
  Chemically synthesized
gcucugaggagaucgacg

SEQ ID NO: 21820 - RNA, 18 nt, artificial
  Chemically synthesized
cgagugcucacccagccc

SEQ ID NO: 21821 - RNA, 18 nt, artificial
  Chemically synthesized
cagcagcagcaaagccug

SEQ ID NO: 21822 - RNA, 18 nt, artificial
  Chemically synthesized
aggacuaugagagcuucu

SEQ ID NO: 21823 - RNA, 18 nt, artificial
  Chemically synthesized
ggcacuugccugggucac

SEQ ID NO: 21824 - RNA, 18 nt, artificial
  Chemically synthesized
guauugacgacguugccg

SEQ ID NO: 21825 - RNA, 18 nt, artificial
  Chemically synthesized
ugcagcgcgucaaugacu

SEQ ID NO: 21826 - RNA, 18 nt, artificial
  Chemically synthesized
accugugagcccacaucc

SEQ ID NO: 21827 - RNA, 18 nt, artificial
  Chemically synthesized
gcgcggagugcgaguggg

SEQ ID NO: 21828 - RNA, 18 nt, artificial
  Chemically synthesized
ccgccaccaccaccacca

SEQ ID NO: 21829 - RNA, 18 nt, artificial
  Chemically synthesized
gacuggugaggacugcag

SEQ ID NO: 21830 - RNA, 18 nt, artificial
  Chemically synthesized
gcggcagcauggccagcu

SEQ ID NO: 21831 - RNA, 18 nt, artificial
  Chemically synthesized
agaccugccugaauggcg

SEQ ID NO: 21832 - RNA, 18 nt, artificial
  Chemically synthesized
gcucccucaacuucaaug

SEQ ID NO: 21833 - RNA, 18 nt, artificial
  Chemically synthesized
ggaugagugcucgcuggg

SEQ ID NO: 21834 - RNA, 18 nt, artificial
  Chemically synthesized
gcuccuacaggugcaccu

SEQ ID NO: 21835 - RNA, 18 nt, artificial
  Chemically synthesized
cuuacagaugcagcagca

SEQ ID NO: 21836 - RNA, 18 nt, artificial
  Chemically synthesized
acagccagugcaacucag

SEQ ID NO: 21837 - RNA, 18 nt, artificial
  Chemically synthesized
ggccguggagggcaugcu

SEQ ID NO: 21838 - RNA, 18 nt, artificial
  Chemically synthesized
cagugccugcccuucgag

SEQ ID NO: 21839 - RNA, 18 nt, artificial
  Chemically synthesized
uguaguuguucguugguu

SEQ ID NO: 21840 - RNA, 18 nt, artificial
  Chemically synthesized
accugaacguggcggcca

SEQ ID NO: 21841 - RNA, 18 nt, artificial
  Chemically synthesized
ccuggaugcccgcaugca

SEQ ID NO: 21842 - RNA, 18 nt, artificial
  Chemically synthesized
guuuuagaugguuucuug

SEQ ID NO: 21843 - RNA, 18 nt, artificial
  Chemically synthesized
cauggagggcucugugug

SEQ ID NO: 21844 - RNA, 18 nt, artificial
  Chemically synthesized
gggcuggcaagggcagac

SEQ ID NO: 21845 - RNA, 18 nt, artificial
  Chemically synthesized
ccagcauggagggcucug

SEQ ID NO: 21846 - RNA, 18 nt, artificial
  Chemically synthesized
cgccugcacuccucaggg

SEQ ID NO: 21847 - RNA, 18 nt, artificial
  Chemically synthesized
ccgggacaucacggauca

SEQ ID NO: 21848 - RNA, 18 nt, artificial
  Chemically synthesized
cggaaggccagugcaacc

SEQ ID NO: 21849 - RNA, 18 nt, artificial
  Chemically synthesized
ugugcacggaaggguaca

SEQ ID NO: 21850 - RNA, 18 nt, artificial
  Chemically synthesized
agcccacauccgagagcc

SEQ ID NO: 21851 - RNA, 18 nt, artificial
  Chemically synthesized
gggcuucaaagugucuga

SEQ ID NO: 21852 - RNA, 18 nt, artificial
  Chemically synthesized
gccguggagggcaugcug

SEQ ID NO: 21853 - RNA, 18 nt, artificial
  Chemically synthesized
cucugaggagaucgacga

SEQ ID NO: 21854 - RNA, 18 nt, artificial
  Chemically synthesized
agccagugcaacucagcc

SEQ ID NO: 21855 - RNA, 18 nt, artificial
  Chemically synthesized
aggaaacaagugaaagca

SEQ ID NO: 21856 - RNA, 18 nt, artificial
  Chemically synthesized
aggacguggaugagugcu

SEQ ID NO: 21857 - RNA, 18 nt, artificial
  Chemically synthesized
gaccgcagcccaguuccu

SEQ ID NO: 21858 - RNA, 18 nt, artificial
  Chemically synthesized
caguggcuacgugugcac

SEQ ID NO: 21859 - RNA, 18 nt, artificial
  Chemically synthesized
ccugcguggaccaggugg

SEQ ID NO: 21860 - RNA, 18 nt, artificial
  Chemically synthesized
ggugccacgugugaggug

SEQ ID NO: 21861 - RNA, 18 nt, artificial
  Chemically synthesized
agggcugccugcuggaca

SEQ ID NO: 21862 - RNA, 18 nt, artificial
  Chemically synthesized
cagugcaacaaccacgcg

SEQ ID NO: 21863 - RNA, 18 nt, artificial
  Chemically synthesized
cucgggcaccugucugga

SEQ ID NO: 21864 - RNA, 18 nt, artificial
  Chemically synthesized
uccugauccggaaccgag

SEQ ID NO: 21865 - RNA, 18 nt, artificial
  Chemically synthesized
caacagcuccuuccacuu

SEQ ID NO: 21866 - RNA, 18 nt, artificial
  Chemically synthesized
gaugagugugcgggcaac

SEQ ID NO: 21867 - RNA, 18 nt, artificial
  Chemically synthesized
gacucacagcccugccug

SEQ ID NO: 21868 - RNA, 18 nt, artificial
  Chemically synthesized
accugcagccagcaaaca

SEQ ID NO: 21869 - RNA, 18 nt, artificial
  Chemically synthesized
cgugggugagcgcuguga

SEQ ID NO: 21870 - RNA, 18 nt, artificial
  Chemically synthesized
cagaugcgucccaagaug

SEQ ID NO: 21871 - RNA, 18 nt, artificial
  Chemically synthesized
ucuuggucccuccagaac

SEQ ID NO: 21872 - RNA, 18 nt, artificial
  Chemically synthesized
aucaugcaugucaaacau

SEQ ID NO: 21873 - RNA, 18 nt, artificial
  Chemically synthesized
gacuuccacugcgagugc

SEQ ID NO: 21874 - RNA, 18 nt, artificial
  Chemically synthesized
ccuggacaaugccugccu

SEQ ID NO: 21875 - RNA, 18 nt, artificial
  Chemically synthesized
guagaugaccugggcaag

SEQ ID NO: 21876 - RNA, 18 nt, artificial
  Chemically synthesized
cugaguggagagccgagc

SEQ ID NO: 21877 - RNA, 18 nt, artificial
  Chemically synthesized
cugggcuccagcagcgga

SEQ ID NO: 21878 - RNA, 18 nt, artificial
  Chemically synthesized
gagccgagccaggcagac

SEQ ID NO: 21879 - RNA, 18 nt, artificial
  Chemically synthesized
aggccuccucgcagugcu

SEQ ID NO: 21880 - RNA, 18 nt, artificial
  Chemically synthesized
cacggaucauauggaccg

SEQ ID NO: 21881 - RNA, 18 nt, artificial
  Chemically synthesized
gaggcaaagcuggcucac

SEQ ID NO: 21882 - RNA, 18 nt, artificial
  Chemically synthesized
gcuggaccggccuuuacu

SEQ ID NO: 21883 - RNA, 18 nt, artificial
  Chemically synthesized
gcugcggcuccuacaggu

SEQ ID NO: 21884 - RNA, 18 nt, artificial
  Chemically synthesized
gcaccugcgccguggccu

SEQ ID NO: 21885 - RNA, 18 nt, artificial
  Chemically synthesized
ggcagcuacgagaccgcc

SEQ ID NO: 21886 - RNA, 18 nt, artificial
  Chemically synthesized
cagagagcuccugcuuca

SEQ ID NO: 21887 - RNA, 18 nt, artificial
  Chemically synthesized
agugcuggaaguacuuca

SEQ ID NO: 21888 - RNA, 18 nt, artificial
  Chemically synthesized
ggcugugucugccgacgc

SEQ ID NO: 21889 - RNA, 18 nt, artificial
  Chemically synthesized
agucuguugugugucaug

SEQ ID NO: 21890 - RNA, 18 nt, artificial
  Chemically synthesized
ccgagggcuaccacgacc

SEQ ID NO: 21891 - RNA, 18 nt, artificial
  Chemically synthesized
agagugcacccaugguac

SEQ ID NO: 21892 - RNA, 18 nt, artificial
  Chemically synthesized
ccaacugcgacaccaacc

SEQ ID NO: 21893 - RNA, 18 nt, artificial
  Chemically synthesized
cugcgacgugcccagcgu

SEQ ID NO: 21894 - RNA, 18 nt, artificial
  Chemically synthesized
gccaagcccgagauggcg

SEQ ID NO: 21895 - RNA, 18 nt, artificial
  Chemically synthesized
caucuaccagggcgccag

SEQ ID NO: 21896 - RNA, 18 nt, artificial
  Chemically synthesized
cagaacugugaggaaaau

SEQ ID NO: 21897 - RNA, 18 nt, artificial
  Chemically synthesized
augcagaacaacagggag

SEQ ID NO: 21898 - RNA, 18 nt, artificial
  Chemically synthesized
gcgacaccaacccuguca

SEQ ID NO: 21899 - RNA, 18 nt, artificial
  Chemically synthesized
guggacgagugcucaccc

SEQ ID NO: 21900 - RNA, 18 nt, artificial
  Chemically synthesized
acccaacacuuacaccug

SEQ ID NO: 21901 - RNA, 18 nt, artificial
  Chemically synthesized
caucaacgagugcuccag

SEQ ID NO: 21902 - RNA, 18 nt, artificial
  Chemically synthesized
gggugagcgcugugaggg

SEQ ID NO: 21903 - RNA, 18 nt, artificial
  Chemically synthesized
agugcgacucacagcccu

SEQ ID NO: 21904 - RNA, 18 nt, artificial
  Chemically synthesized
cgagaucaaccuggauga

SEQ ID NO: 21905 - RNA, 18 nt, artificial
  Chemically synthesized
uucccugagggcuucaaa

SEQ ID NO: 21906 - RNA, 18 nt, artificial
  Chemically synthesized
gauccggaaccgagccac

SEQ ID NO: 21907 - RNA, 18 nt, artificial
  Chemically synthesized
augagagcuucuccugug

SEQ ID NO: 21908 - RNA, 18 nt, artificial
  Chemically synthesized
aacugugaggaaaauauc

SEQ ID NO: 21909 - RNA, 18 nt, artificial
  Chemically synthesized
gcagcugcgcaacagcuc

SEQ ID NO: 21910 - RNA, 18 nt, artificial
  Chemically synthesized
gcggcuccaucgucuacc

SEQ ID NO: 21911 - RNA, 18 nt, artificial
  Chemically synthesized
ccgucaucaauggcugca

SEQ ID NO: 21912 - RNA, 18 nt, artificial
  Chemically synthesized
uggucaaugcgaguggcu

SEQ ID NO: 21913 - RNA, 18 nt, artificial
  Chemically synthesized
guguggacgcgggcaaca

SEQ ID NO: 21914 - RNA, 18 nt, artificial
  Chemically synthesized
guguauugacgacguugc

SEQ ID NO: 21915 - RNA, 18 nt, artificial
  Chemically synthesized
gacuguggcacuugccug

SEQ ID NO: 21916 - RNA, 18 nt, artificial
  Chemically synthesized
caacugcgagaucaaccu

SEQ ID NO: 21917 - RNA, 18 nt, artificial
  Chemically synthesized
gagcuucuccugugucug

SEQ ID NO: 21918 - RNA, 18 nt, artificial
  Chemically synthesized
ugcgagguggacaucgau

SEQ ID NO: 21919 - RNA, 18 nt, artificial
  Chemically synthesized
cagccucaagcccggcgu

SEQ ID NO: 21920 - RNA, 18 nt, artificial
  Chemically synthesized
cgggcuucgagggcgcca

SEQ ID NO: 21921 - RNA, 18 nt, artificial
  Chemically synthesized
ccugggucacacacggag

SEQ ID NO: 21922 - RNA, 18 nt, artificial
  Chemically synthesized
cugcguccuuugguccug

SEQ ID NO: 21923 - RNA, 18 nt, artificial
  Chemically synthesized
caacgaggucggcuccua

SEQ ID NO: 21924 - RNA, 18 nt, artificial
  Chemically synthesized
uaugagagcuucuccugu

SEQ ID NO: 21925 - RNA, 18 nt, artificial
  Chemically synthesized
ggaaggccagugcaaccc

SEQ ID NO: 21926 - RNA, 18 nt, artificial
  Chemically synthesized
agacgugcagccacuggg

SEQ ID NO: 21927 - RNA, 18 nt, artificial
  Chemically synthesized
ugcuugugaaaauguguu

SEQ ID NO: 21928 - RNA, 18 nt, artificial
  Chemically synthesized
gaaagcauauggguuaga

SEQ ID NO: 21929 - RNA, 18 nt, artificial
  Chemically synthesized
cgucugugugcgcucugu

SEQ ID NO: 21930 - RNA, 18 nt, artificial
  Chemically synthesized
agcaagaagaagcggcgg

SEQ ID NO: 21931 - RNA, 18 nt, artificial
  Chemically synthesized
cccaccugccggcaggau

SEQ ID NO: 21932 - RNA, 18 nt, artificial
  Chemically synthesized
ggcgucgccaccuucacc

SEQ ID NO: 21933 - RNA, 18 nt, artificial
  Chemically synthesized
cugcucacgcugacggag

SEQ ID NO: 21934 - RNA, 18 nt, artificial
  Chemically synthesized
ccuacaucugccacugcc

SEQ ID NO: 21935 - RNA, 18 nt, artificial
  Chemically synthesized
gcaccugccucgaccucc

SEQ ID NO: 21936 - RNA, 18 nt, artificial
  Chemically synthesized
cccucgcagcacagcuac

SEQ ID NO: 21937 - RNA, 18 nt, artificial
  Chemically synthesized
ccgcagaggcguggcaga

SEQ ID NO: 21938 - RNA, 18 nt, artificial
  Chemically synthesized
ccaccugggcaucgggca

SEQ ID NO: 21939 - RNA, 18 nt, artificial
  Chemically synthesized
cguggacagcuacacgug

SEQ ID NO: 21940 - RNA, 18 nt, artificial
  Chemically synthesized
ugggcugcguccuuuggu

SEQ ID NO: 21941 - RNA, 18 nt, artificial
  Chemically synthesized
gguggcaccugcguggac

SEQ ID NO: 21942 - RNA, 18 nt, artificial
  Chemically synthesized
cccgcucugcucgcccaa

SEQ ID NO: 21943 - RNA, 18 nt, artificial
  Chemically synthesized
ucuaccuggagauugaca

SEQ ID NO: 21944 - RNA, 18 nt, artificial
  Chemically synthesized
ccaccggcaguggacuca

SEQ ID NO: 21945 - RNA, 18 nt, artificial
  Chemically synthesized
ccugaguggagagccgag

SEQ ID NO: 21946 - RNA, 18 nt, artificial
  Chemically synthesized
ggccaagcccgagauggc

SEQ ID NO: 21947 - RNA, 18 nt, artificial
  Chemically synthesized
augguaccaaucaugaau

SEQ ID NO: 21948 - RNA, 18 nt, artificial
  Chemically synthesized
cgaggauguggacgagug

SEQ ID NO: 21949 - RNA, 18 nt, artificial
  Chemically synthesized
gugcccucauggacgaca

SEQ ID NO: 21950 - RNA, 18 nt, artificial
  Chemically synthesized
ccugcucacgcugacgga

SEQ ID NO: 21951 - RNA, 18 nt, artificial
  Chemically synthesized
caccucagccugcacagu

SEQ ID NO: 21952 - RNA, 18 nt, artificial
  Chemically synthesized
uccaccaguuugaauggu

SEQ ID NO: 21953 - RNA, 18 nt, artificial
  Chemically synthesized
ccgcggguucaucugcaa

SEQ ID NO: 21954 - RNA, 18 nt, artificial
  Chemically synthesized
caacagcgaggaagagga

SEQ ID NO: 21955 - RNA, 18 nt, artificial
  Chemically synthesized
aaccagggcacguguauu

SEQ ID NO: 21956 - RNA, 18 nt, artificial
  Chemically synthesized
cgagaccgccaaggugcu

SEQ ID NO: 21957 - RNA, 18 nt, artificial
  Chemically synthesized
gcaccagcaccguccugg

SEQ ID NO: 21958 - RNA, 18 nt, artificial
  Chemically synthesized
ugggcagccucaacaucc

SEQ ID NO: 21959 - RNA, 18 nt, artificial
  Chemically synthesized
gcacggaggccugcgucu

SEQ ID NO: 21960 - RNA, 18 nt, artificial
  Chemically synthesized
ugcccacccagcuuccau

SEQ ID NO: 21961 - RNA, 18 nt, artificial
  Chemically synthesized
uguaacaucaacaucgau

SEQ ID NO: 21962 - RNA, 18 nt, artificial
  Chemically synthesized
accgcagcccaguuccug

SEQ ID NO: 21963 - RNA, 18 nt, artificial
  Chemically synthesized
gggcuccaacugcgacac

SEQ ID NO: 21964 - RNA, 18 nt, artificial
  Chemically synthesized
gugugaagcggccaaugg

SEQ ID NO: 21965 - RNA, 18 nt, artificial
  Chemically synthesized
aagcaugcuugugaaaau

SEQ ID NO: 21966 - RNA, 18 nt, artificial
  Chemically synthesized
gcaaacggaggcaaagcu

SEQ ID NO: 21967 - RNA, 18 nt, artificial
  Chemically synthesized
ccaauacaacccucugcg

SEQ ID NO: 21968 - RNA, 18 nt, artificial
  Chemically synthesized
caucaauggcuucaccug

SEQ ID NO: 21969 - RNA, 18 nt, artificial
  Chemically synthesized
gugccgugcuggucacac

SEQ ID NO: 21970 - RNA, 18 nt, artificial
  Chemically synthesized
ggccuccucgcagugcuu

SEQ ID NO: 21971 - RNA, 18 nt, artificial
  Chemically synthesized
gacgaguacaaccuggug

SEQ ID NO: 21972 - RNA, 18 nt, artificial
  Chemically synthesized
cgagugugccugugagcc

SEQ ID NO: 21973 - RNA, 18 nt, artificial
  Chemically synthesized
gaauggucaaugcgagug

SEQ ID NO: 21974 - RNA, 18 nt, artificial
  Chemically synthesized
gcuggacagcuccggcau

SEQ ID NO: 21975 - RNA, 18 nt, artificial
  Chemically synthesized
ccacgugugagguggugc

SEQ ID NO: 21976 - RNA, 18 nt, artificial
  Chemically synthesized
caaauucaacgggcucuu

SEQ ID NO: 21977 - RNA, 18 nt, artificial
  Chemically synthesized
cugcaagaacggcggcaa

SEQ ID NO: 21978 - RNA, 18 nt, artificial
  Chemically synthesized
gucaucuccgacuucauc

SEQ ID NO: 21979 - RNA, 18 nt, artificial
  Chemically synthesized
gcgcagcgacaagguguu

SEQ ID NO: 21980 - RNA, 18 nt, artificial
  Chemically synthesized
cccagcccggugagaccu

SEQ ID NO: 21981 - RNA, 18 nt, artificial
  Chemically synthesized
cuccuaguuugggaggag

SEQ ID NO: 21982 - RNA, 18 nt, artificial
  Chemically synthesized
cacgagugugccugccug

SEQ ID NO: 21983 - RNA, 18 nt, artificial
  Chemically synthesized
caccuggugcagacccag

SEQ ID NO: 21984 - RNA, 18 nt, artificial
  Chemically synthesized
cccagcguguccugugag

SEQ ID NO: 21985 - RNA, 18 nt, artificial
  Chemically synthesized
gucaugccagugagggac

SEQ ID NO: 21986 - RNA, 18 nt, artificial
  Chemically synthesized
agugcaacugccugcugc

SEQ ID NO: 21987 - RNA, 18 nt, artificial
  Chemically synthesized
gagggcagcuacgagacc

SEQ ID NO: 21988 - RNA, 18 nt, artificial
  Chemically synthesized
gacuggugaggacugcag

SEQ ID NO: 21989 - RNA, 18 nt, artificial
  Chemically synthesized
acccagaacugcgugcag

SEQ ID NO: 21990 - RNA, 18 nt, artificial
  Chemically synthesized
ccacgucgcugccauccu

SEQ ID NO: 21991 - RNA, 18 nt, artificial
  Chemically synthesized
uuugaauggucaaugcga

SEQ ID NO: 21992 - RNA, 18 nt, artificial
  Chemically synthesized
ggagggcucuguguggac

SEQ ID NO: 21993 - RNA, 18 nt, artificial
  Chemically synthesized
acauccagcagcagcaaa

SEQ ID NO: 21994 - RNA, 18 nt, artificial
  Chemically synthesized
caacccugucaauggcaa

SEQ ID NO: 21995 - RNA, 18 nt, artificial
  Chemically synthesized
gcacggaggaagaagucc

SEQ ID NO: 21996 - RNA, 18 nt, artificial
  Chemically synthesized
gugagcccacauccgaga

SEQ ID NO: 21997 - RNA, 18 nt, artificial
  Chemically synthesized
cucacagcccugccugca

SEQ ID NO: 21998 - RNA, 18 nt, artificial
  Chemically synthesized
gacuucaucuaccagggc

SEQ ID NO: 21999 - RNA, 18 nt, artificial
  Chemically synthesized
ggucugcagccugcagug

SEQ ID NO: 22000 - RNA, 18 nt, artificial
  Chemically synthesized
caagaagguccgcaagcc

SEQ ID NO: 22001 - RNA, 18 nt, artificial
  Chemically synthesized
gccagcagaugaucuucc

SEQ ID NO: 22002 - RNA, 18 nt, artificial
  Chemically synthesized
ggcaugaccagaugcguc

SEQ ID NO: 22003 - RNA, 18 nt, artificial
  Chemically synthesized
cgacaacgccuaccucug

SEQ ID NO: 22004 - RNA, 18 nt, artificial
  Chemically synthesized
gaggauguggacgagugc

SEQ ID NO: 22005 - RNA, 18 nt, artificial
  Chemically synthesized
ugagggacgucagacuug

SEQ ID NO: 22006 - RNA, 18 nt, artificial
  Chemically synthesized
cuugugaaaauguguucu

SEQ ID NO: 22007 - RNA, 18 nt, artificial
  Chemically synthesized
caacgacgcaugcaucag

SEQ ID NO: 22008 - RNA, 18 nt, artificial
  Chemically synthesized
cccucauggacgacaacc

SEQ ID NO: 22009 - RNA, 18 nt, artificial
  Chemically synthesized
caacaucaacgagugugc

SEQ ID NO: 22010 - RNA, 18 nt, artificial
  Chemically synthesized
uggcagacccacacccag

SEQ ID NO: 22011 - RNA, 18 nt, artificial
  Chemically synthesized
cugcaugcggcugugucu

SEQ ID NO: 22012 - RNA, 18 nt, artificial
  Chemically synthesized
caaccuggugcgcagccc

SEQ ID NO: 22013 - RNA, 18 nt, artificial
  Chemically synthesized
cacccagaacugcgugca

SEQ ID NO: 22014 - RNA, 18 nt, artificial
  Chemically synthesized
agcauguacccgagaggc

SEQ ID NO: 22015 - RNA, 18 nt, artificial
  Chemically synthesized
cgaggaggagcugcgcaa

SEQ ID NO: 22016 - RNA, 18 nt, artificial
  Chemically synthesized
caugucaaacaugagaug

SEQ ID NO: 22017 - RNA, 18 nt, artificial
  Chemically synthesized
gugccuggacggacccaa

SEQ ID NO: 22018 - RNA, 18 nt, artificial
  Chemically synthesized
cagccucaacggguacaa

SEQ ID NO: 22019 - RNA, 18 nt, artificial
  Chemically synthesized
cacgugguggaccgcaga

SEQ ID NO: 22020 - RNA, 18 nt, artificial
  Chemically synthesized
ggcggcacaugcaucucc

SEQ ID NO: 22021 - RNA, 18 nt, artificial
  Chemically synthesized
agaagggaaguugaacga

SEQ ID NO: 22022 - RNA, 18 nt, artificial
  Chemically synthesized
gcaaggacggcgucgcca

SEQ ID NO: 22023 - RNA, 18 nt, artificial
  Chemically synthesized
cugguggacgagugcuca

SEQ ID NO: 22024 - RNA, 18 nt, artificial
  Chemically synthesized
ccacccagcuuccauggc

SEQ ID NO: 22025 - RNA, 18 nt, artificial
  Chemically synthesized
aucugugccaguacgaug

SEQ ID NO: 22026 - RNA, 18 nt, artificial
  Chemically synthesized
ccucaaggcacggaggaa

SEQ ID NO: 22027 - RNA, 18 nt, artificial
  Chemically synthesized
ugaccgcagcccaguucc

SEQ ID NO: 22028 - RNA, 18 nt, artificial
  Chemically synthesized
cuuagccgcccaugcacu

SEQ ID NO: 22029 - RNA, 18 nt, artificial
  Chemically synthesized
cggcggagggagcuggac

SEQ ID NO: 22030 - RNA, 18 nt, artificial
  Chemically synthesized
cuguccaaucccugcgac

SEQ ID NO: 22031 - RNA, 18 nt, artificial
  Chemically synthesized
cugugggcggguccacca

SEQ ID NO: 22032 - RNA, 18 nt, artificial
  Chemically synthesized
ggcaucugugccaguacg

SEQ ID NO: 22033 - RNA, 18 nt, artificial
  Chemically synthesized
caacugccagaaccuugu

SEQ ID NO: 22034 - RNA, 18 nt, artificial
  Chemically synthesized
ggucugcugugccaccuc

SEQ ID NO: 22035 - RNA, 18 nt, artificial
  Chemically synthesized
gcgacugccugcccggcu

SEQ ID NO: 22036 - RNA, 18 nt, artificial
  Chemically synthesized
ccaacacuuacaccugug

SEQ ID NO: 22037 - RNA, 18 nt, artificial
  Chemically synthesized
cgggcucuugugccacau

SEQ ID NO: 22038 - RNA, 18 nt, artificial
  Chemically synthesized
caucuaccagggcgccag

SEQ ID NO: 22039 - RNA, 18 nt, artificial
  Chemically synthesized
acaaggugucuuccagau

SEQ ID NO: 22040 - RNA, 18 nt, artificial
  Chemically synthesized
gaccaagaaguuccgguu

SEQ ID NO: 22041 - RNA, 18 nt, artificial
  Chemically synthesized
cagcucugguucccugag

SEQ ID NO: 22042 - RNA, 18 nt, artificial
  Chemically synthesized
cuggaugcccgcaugcau

SEQ ID NO: 22043 - RNA, 18 nt, artificial
  Chemically synthesized
cugcguggacagcuacac

SEQ ID NO: 22044 - RNA, 18 nt, artificial
  Chemically synthesized
caucaacgagugcuccag

SEQ ID NO: 22045 - RNA, 18 nt, artificial
  Chemically synthesized
ggucccuccagaaccacc

SEQ ID NO: 22046 - RNA, 18 nt, artificial
  Chemically synthesized
gcgaggucaacacagacg

SEQ ID NO: 22047 - RNA, 18 nt, artificial
  Chemically synthesized
cucccugcagcauggcau

SEQ ID NO: 22048 - RNA, 18 nt, artificial
  Chemically synthesized
caaacggaggcaaagcug

SEQ ID NO: 22049 - RNA, 18 nt, artificial
  Chemically synthesized
ccaccaccacagccgcac

SEQ ID NO: 22050 - RNA, 18 nt, artificial
  Chemically synthesized
aaucuuuguuucagguuc

SEQ ID NO: 22051 - RNA, 18 nt, artificial
  Chemically synthesized
uggacggacccaacacuu

SEQ ID NO: 22052 - RNA, 18 nt, artificial
  Chemically synthesized
cguccaggccgcgcccuu

SEQ ID NO: 22053 - RNA, 18 nt, artificial
  Chemically synthesized
cuccgacuucaucuacca

SEQ ID NO: 22054 - RNA, 18 nt, artificial
  Chemically synthesized
gagggcgucuccagcccu

SEQ ID NO: 22055 - RNA, 18 nt, artificial
  Chemically synthesized
gccucuucgacggcuuug

SEQ ID NO: 22056 - RNA, 18 nt, artificial
  Chemically synthesized
aacaagcaaguucugaga

SEQ ID NO: 22057 - RNA, 18 nt, artificial
  Chemically synthesized
gacaggucaguacuguac

SEQ ID NO: 22058 - RNA, 18 nt, artificial
  Chemically synthesized
cagcauggagggcucugu

SEQ ID NO: 22059 - RNA, 18 nt, artificial
  Chemically synthesized
agggcagcuacgagaccg

SEQ ID NO: 22060 - RNA, 18 nt, artificial
  Chemically synthesized
cacgcgugcggcugggac

SEQ ID NO: 22061 - RNA, 18 nt, artificial
  Chemically synthesized
gcaagcccagcagcaaag

SEQ ID NO: 22062 - RNA, 18 nt, artificial
  Chemically synthesized
ccagcaucaccugccugu

SEQ ID NO: 22063 - RNA, 18 nt, artificial
  Chemically synthesized
ugagauguguggacugug

SEQ ID NO: 22064 - RNA, 18 nt, artificial
  Chemically synthesized
ccagagugccaccgacgu

SEQ ID NO: 22065 - RNA, 18 nt, artificial
  Chemically synthesized
gcagcaaagccugcagcc

SEQ ID NO: 22066 - RNA, 18 nt, artificial
  Chemically synthesized
gccaggguuuuccuacgu

SEQ ID NO: 22067 - RNA, 18 nt, artificial
  Chemically synthesized
gaagcugcauccagaggc

SEQ ID NO: 22068 - RNA, 18 nt, artificial
  Chemically synthesized
cggcuggaccggccuuua

SEQ ID NO: 22069 - RNA, 18 nt, artificial
  Chemically synthesized
ccugguggcagcgagggu

SEQ ID NO: 22070 - RNA, 18 nt, artificial
  Chemically synthesized
acgccuaccucugcuucu

SEQ ID NO: 22071 - RNA, 18 nt, artificial
  Chemically synthesized
guccaccaguuugaaugg

SEQ ID NO: 22072 - RNA, 18 nt, artificial
  Chemically synthesized
gcgggaagugugaagcgg

SEQ ID NO: 22073 - RNA, 18 nt, artificial
  Chemically synthesized
agggugagguugacgccg

SEQ ID NO: 22074 - RNA, 18 nt, artificial
  Chemically synthesized
ccaggaaacaacugcaag

SEQ ID NO: 22075 - RNA, 18 nt, artificial
  Chemically synthesized
cacuuacaccugugugug

SEQ ID NO: 22076 - RNA, 18 nt, artificial
  Chemically synthesized
cgcauuccugggagcgcu

SEQ ID NO: 22077 - RNA, 18 nt, artificial
  Chemically synthesized
ggcaacacgcaccacugc

SEQ ID NO: 22078 - RNA, 18 nt, artificial
  Chemically synthesized
cacugauccuggcugccc

SEQ ID NO: 22079 - RNA, 18 nt, artificial
  Chemically synthesized
ugaaaauguguucucgga

SEQ ID NO: 22080 - RNA, 18 nt, artificial
  Chemically synthesized
augcgagaucgacgucaa

SEQ ID NO: 22081 - RNA, 18 nt, artificial
  Chemically synthesized
gagggacgucagacuugg

SEQ ID NO: 22082 - RNA, 18 nt, artificial
  Chemically synthesized
cagacuaugccugcagcu

SEQ ID NO: 22083 - RNA, 18 nt, artificial
  Chemically synthesized
ugccauguguuuuagaug

SEQ ID NO: 22084 - RNA, 18 nt, artificial
  Chemically synthesized
cgaccagacagaccaccg

SEQ ID NO: 22085 - RNA, 18 nt, artificial
  Chemically synthesized
ccgggacagccucaacgg

SEQ ID NO: 22086 - RNA, 18 nt, artificial
  Chemically synthesized
ggaagugugaagcggcca

SEQ ID NO: 22087 - RNA, 18 nt, artificial
  Chemically synthesized
ugcacugugagaucaacg

SEQ ID NO: 22088 - RNA, 18 nt, artificial
  Chemically synthesized
caucuccgacuucaucua

SEQ ID NO: 22089 - RNA, 18 nt, artificial
  Chemically synthesized
cgggccaccacugcgaga

SEQ ID NO: 22090 - RNA, 18 nt, artificial
  Chemically synthesized
cgccagaguggacagguc

SEQ ID NO: 22091 - RNA, 18 nt, artificial
  Chemically synthesized
augacuuccacugcgagu

SEQ ID NO: 22092 - RNA, 18 nt, artificial
  Chemically synthesized
gagcagauuuuugcaaua

SEQ ID NO: 22093 - RNA, 18 nt, artificial
  Chemically synthesized
cccgcaugcaugauggca

SEQ ID NO: 22094 - RNA, 18 nt, artificial
  Chemically synthesized
gcugaugccgccggagca

SEQ ID NO: 22095 - RNA, 18 nt, artificial
  Chemically synthesized
cgacgcccguggcaccca

SEQ ID NO: 22096 - RNA, 18 nt, artificial
  Chemically synthesized
cggcgucgccaccuucac

SEQ ID NO: 22097 - RNA, 18 nt, artificial
  Chemically synthesized
cgacgccacugauccugg

SEQ ID NO: 22098 - RNA, 18 nt, artificial
  Chemically synthesized
gcggcaccugucaggacg

SEQ ID NO: 22099 - RNA, 18 nt, artificial
  Chemically synthesized
ugcucccucaacuucaau

SEQ ID NO: 22100 - RNA, 18 nt, artificial
  Chemically synthesized
aggagccuuuuuaaaaca

SEQ ID NO: 22101 - RNA, 18 nt, artificial
  Chemically synthesized
aucuccgacuucaucuac

SEQ ID NO: 22102 - RNA, 18 nt, artificial
  Chemically synthesized
cugggcuccuucgagugc

SEQ ID NO: 22103 - RNA, 18 nt, artificial
  Chemically synthesized
gugagguugacgccgacu

SEQ ID NO: 22104 - RNA, 18 nt, artificial
  Chemically synthesized
cgccuaccucugcuucug

SEQ ID NO: 22105 - RNA, 18 nt, artificial
  Chemically synthesized
ugaaaagauucuucugug

SEQ ID NO: 22106 - RNA, 18 nt, artificial
  Chemically synthesized
caccuggugcagacccag

SEQ ID NO: 22107 - RNA, 18 nt, artificial
  Chemically synthesized
gcagugcuggaaguacuu

SEQ ID NO: 22108 - RNA, 18 nt, artificial
  Chemically synthesized
gaguacaagugccgcugc

SEQ ID NO: 22109 - RNA, 18 nt, artificial
  Chemically synthesized
ggugcgcagcccgcagcu

SEQ ID NO: 22110 - RNA, 18 nt, artificial
  Chemically synthesized
acccagaacugcgugcag

SEQ ID NO: 22111 - RNA, 18 nt, artificial
  Chemically synthesized
ggcggcuacagcugcacc

SEQ ID NO: 22112 - RNA, 18 nt, artificial
  Chemically synthesized
acaacagggaggagacac

SEQ ID NO: 22113 - RNA, 18 nt, artificial
  Chemically synthesized
cucagccugcacaguguc

SEQ ID NO: 22114 - RNA, 18 nt, artificial
  Chemically synthesized
gggaaaucgugccagcag

SEQ ID NO: 22115 - RNA, 18 nt, artificial
  Chemically synthesized
cgcagaugccaacaucca

SEQ ID NO: 22116 - RNA, 18 nt, artificial
  Chemically synthesized
cugccauccucgcugguc

SEQ ID NO: 22117 - RNA, 18 nt, artificial
  Chemically synthesized
aggucggcuccuaccgcu

SEQ ID NO: 22118 - RNA, 18 nt, artificial
  Chemically synthesized
gccggcgcagcugcacuu

SEQ ID NO: 22119 - RNA, 18 nt, artificial
  Chemically synthesized
cgugcggaaggccagugc

SEQ ID NO: 22120 - RNA, 18 nt, artificial
  Chemically synthesized
gggccgccgccgugaaca

SEQ ID NO: 22121 - RNA, 18 nt, artificial
  Chemically synthesized
gcacuugccugggucaca

SEQ ID NO: 22122 - RNA, 18 nt, artificial
  Chemically synthesized
aagauaugcagaacaaca

SEQ ID NO: 22123 - RNA, 18 nt, artificial
  Chemically synthesized
ggacagcuacacgugcac

SEQ ID NO: 22124 - RNA, 18 nt, artificial
  Chemically synthesized
ggcaagggcugccugcug

SEQ ID NO: 22125 - RNA, 18 nt, artificial
  Chemically synthesized
ugggaccaacugugacau

SEQ ID NO: 22126 - RNA, 18 nt, artificial
  Chemically synthesized
guggacgacugcaauccc

SEQ ID NO: 22127 - RNA, 18 nt, artificial
  Chemically synthesized
guguggccuccuucuacu

SEQ ID NO: 22128 - RNA, 18 nt, artificial
  Chemically synthesized
cugcugcccuacacaggu

SEQ ID NO: 22129 - RNA, 18 nt, artificial
  Chemically synthesized
gaccgacaucgacgacug

SEQ ID NO: 22130 - RNA, 18 nt, artificial
  Chemically synthesized
gaacaacagggaggagac

SEQ ID NO: 22131 - RNA, 18 nt, artificial
  Chemically synthesized
ggcagcuacugccagcac

SEQ ID NO: 22132 - RNA, 18 nt, artificial
  Chemically synthesized
ccagaguggacaggucag

SEQ ID NO: 22133 - RNA, 18 nt, artificial
  Chemically synthesized
caacgacgcaugcaucag

SEQ ID NO: 22134 - RNA, 18 nt, artificial
  Chemically synthesized
agugcgucucgaacccgu

SEQ ID NO: 22135 - RNA, 18 nt, artificial
  Chemically synthesized
gugcguccaacccauguc

SEQ ID NO: 22136 - RNA, 18 nt, artificial
  Chemically synthesized
cagagccgggcacauuga

SEQ ID NO: 22137 - RNA, 18 nt, artificial
  Chemically synthesized
ugacugcucccucaacuu

SEQ ID NO: 22138 - RNA, 18 nt, artificial
  Chemically synthesized
ccuguggaagcaaggagg

SEQ ID NO: 22139 - RNA, 18 nt, artificial
  Chemically synthesized
ccagaacgacgccaccug

SEQ ID NO: 22140 - RNA, 18 nt, artificial
  Chemically synthesized
agugagaccguggagccg

SEQ ID NO: 22141 - RNA, 18 nt, artificial
  Chemically synthesized
gagguggcugcgcagcga

SEQ ID NO: 22142 - RNA, 18 nt, artificial
  Chemically synthesized
gugaggaccugguggacg

SEQ ID NO: 22143 - RNA, 18 nt, artificial
  Chemically synthesized
gagccgggcacauugagc

SEQ ID NO: 22144 - RNA, 18 nt, artificial
  Chemically synthesized
gccaagcgccugcuggag

SEQ ID NO: 22145 - RNA, 18 nt, artificial
  Chemically synthesized
cucgcuggucccacccgu

SEQ ID NO: 22146 - RNA, 18 nt, artificial
  Chemically synthesized
gaccagggcugcaacagc

SEQ ID NO: 22147 - RNA, 18 nt, artificial
  Chemically synthesized
cgcugcacaguagccuug

SEQ ID NO: 22148 - RNA, 18 nt, artificial
  Chemically synthesized
ccggcuggucagggaaau

SEQ ID NO: 22149 - RNA, 18 nt, artificial
  Chemically synthesized
cacaggugccacguguga

SEQ ID NO: 22150 - RNA, 18 nt, artificial
  Chemically synthesized
gaggaagaagucccagga

SEQ ID NO: 22151 - RNA, 18 nt, artificial
  Chemically synthesized
ucauguacguggcggcgg

SEQ ID NO: 22152 - RNA, 18 nt, artificial
  Chemically synthesized
ccgcaggcuucagcggga

SEQ ID NO: 22153 - RNA, 18 nt, artificial
  Chemically synthesized
caaggcacggaggaagaa

SEQ ID NO: 22154 - RNA, 18 nt, artificial
  Chemically synthesized
ccugcccguucuugaaau

SEQ ID NO: 22155 - RNA, 18 nt, artificial
  Chemically synthesized
ggaguguggcaccaggcc

SEQ ID NO: 22156 - RNA, 18 nt, artificial
  Chemically synthesized
gggcggcuacagcugcac

SEQ ID NO: 22157 - RNA, 18 nt, artificial
  Chemically synthesized
agaugaugagcuaccagg

SEQ ID NO: 22158 - RNA, 18 nt, artificial
  Chemically synthesized
aagugaaagcauaugggu

SEQ ID NO: 22159 - RNA, 18 nt, artificial
  Chemically synthesized
gcaagcaugcuugugaaa

SEQ ID NO: 22160 - RNA, 18 nt, artificial
  Chemically synthesized
guuuuguaggagacuugc

SEQ ID NO: 22161 - RNA, 18 nt, artificial
  Chemically synthesized
ggacuccgugggccucaa

SEQ ID NO: 22162 - RNA, 18 nt, artificial
  Chemically synthesized
gugaaagcauauggguua

SEQ ID NO: 22163 - RNA, 18 nt, artificial
  Chemically synthesized
gcuacacaggcagcuacu

SEQ ID NO: 22164 - RNA, 18 nt, artificial
  Chemically synthesized
cccuugugucaacggcgg

SEQ ID NO: 22165 - RNA, 18 nt, artificial
  Chemically synthesized
ugcaagaacgccgggaca

SEQ ID NO: 22166 - RNA, 18 nt, artificial
  Chemically synthesized
ggaagaggaggacgcgcc

SEQ ID NO: 22167 - RNA, 18 nt, artificial
  Chemically synthesized
ccgacaucgacgacugcc

SEQ ID NO: 22168 - RNA, 18 nt, artificial
  Chemically synthesized
ccuguguccacccggcuu

SEQ ID NO: 22169 - RNA, 18 nt, artificial
  Chemically synthesized
caacggcggcacaugcau

SEQ ID NO: 22170 - RNA, 18 nt, artificial
  Chemically synthesized
gggcugcguccuuugguc

SEQ ID NO: 22171 - RNA, 18 nt, artificial
  Chemically synthesized
cugcgacaccaacccugu

SEQ ID NO: 22172 - RNA, 18 nt, artificial
  Chemically synthesized
gcuacucacgcucugaug

SEQ ID NO: 22173 - RNA, 18 nt, artificial
  Chemically synthesized
cgcaacugcgagaccgac

SEQ ID NO: 22174 - RNA, 18 nt, artificial
  Chemically synthesized
auccacugugagaacaac

SEQ ID NO: 22175 - RNA, 18 nt, artificial
  Chemically synthesized
cagacccacacccaguac

SEQ ID NO: 22176 - RNA, 18 nt, artificial
  Chemically synthesized
ugccgacgcacaaggugu

SEQ ID NO: 22177 - RNA, 18 nt, artificial
  Chemically synthesized
ggcccgcugcacaguagc

SEQ ID NO: 22178 - RNA, 18 nt, artificial
  Chemically synthesized
ccugugugugcacggaag

SEQ ID NO: 22179 - RNA, 18 nt, artificial
  Chemically synthesized
cuggugcagacccagcag

SEQ ID NO: 22180 - RNA, 18 nt, artificial
  Chemically synthesized
acaguagccuugcugcca

SEQ ID NO: 22181 - RNA, 18 nt, artificial
  Chemically synthesized
cugggcagccucaacauc

SEQ ID NO: 22182 - RNA, 18 nt, artificial
  Chemically synthesized
augaguuccagugcgagu

SEQ ID NO: 22183 - RNA, 18 nt, artificial
  Chemically synthesized
guguggacuguggcacuu

SEQ ID NO: 22184 - RNA, 18 nt, artificial
  Chemically synthesized
ggcaacaaggucugcagc

SEQ ID NO: 22185 - RNA, 18 nt, artificial
  Chemically synthesized
gaggaggcgugcgagcug

SEQ ID NO: 22186 - RNA, 18 nt, artificial
  Chemically synthesized
ggcacguguauugacgac

SEQ ID NO: 22187 - RNA, 18 nt, artificial
  Chemically synthesized
cgugccgccugcacuccu

SEQ ID NO: 22188 - RNA, 18 nt, artificial
  Chemically synthesized
cauccagcagcagcaaag

SEQ ID NO: 22189 - RNA, 18 nt, artificial
  Chemically synthesized
ggugcugaugccgccgga

SEQ ID NO: 22190 - RNA, 18 nt, artificial
  Chemically synthesized
ggaccggccuuuacugcg

SEQ ID NO: 22191 - RNA, 18 nt, artificial
  Chemically synthesized
gacaccaacccugucaau

SEQ ID NO: 22192 - RNA, 18 nt, artificial
  Chemically synthesized
gugucugcagggcuacac

SEQ ID NO: 22193 - RNA, 18 nt, artificial
  Chemically synthesized
gcuccugcaaggacggcg

SEQ ID NO: 22194 - RNA, 18 nt, artificial
  Chemically synthesized
auuccaacgucuccgacu

SEQ ID NO: 22195 - RNA, 18 nt, artificial
  Chemically synthesized
aacaaggucugcagccug

SEQ ID NO: 22196 - RNA, 18 nt, artificial
  Chemically synthesized
gucuucaagcgugacgca

SEQ ID NO: 22197 - RNA, 18 nt, artificial
  Chemically synthesized
ccugucugaggucaauga

SEQ ID NO: 22198 - RNA, 18 nt, artificial
  Chemically synthesized
gcuaacaaagauaugcag

SEQ ID NO: 22199 - RNA, 18 nt, artificial
  Chemically synthesized
ccagagccgggcacauug

SEQ ID NO: 22200 - RNA, 18 nt, artificial
  Chemically synthesized
cugcacuccucagggcag

SEQ ID NO: 22201 - RNA, 18 nt, artificial
  Chemically synthesized
ccgaugcgagaucgacgu

SEQ ID NO: 22202 - RNA, 18 nt, artificial
  Chemically synthesized
agccugcgcugccucaac

SEQ ID NO: 22203 - RNA, 18 nt, artificial
  Chemically synthesized
gucaguacuguaccgagg

SEQ ID NO: 22204 - RNA, 18 nt, artificial
  Chemically synthesized
ccgugggcugcguccuuu

SEQ ID NO: 22205 - RNA, 18 nt, artificial
  Chemically synthesized
caugcagucccagaucgc

SEQ ID NO: 22206 - RNA, 18 nt, artificial
  Chemically synthesized
cgucaacgagugcgucuc

SEQ ID NO: 22207 - RNA, 18 nt, artificial
  Chemically synthesized
cuacaacugcgugugugu

SEQ ID NO: 22208 - RNA, 18 nt, artificial
  Chemically synthesized
cucugaugccgccaagcg

SEQ ID NO: 22209 - RNA, 18 nt, artificial
  Chemically synthesized
ugccagugagggacguca

SEQ ID NO: 22210 - RNA, 18 nt, artificial
  Chemically synthesized
gcaauccgaggacuauga

SEQ ID NO: 22211 - RNA, 18 nt, artificial
  Chemically synthesized
uauagccuauggcagaaa

SEQ ID NO: 22212 - RNA, 18 nt, artificial
  Chemically synthesized
cgaguacaaccuggugcg

SEQ ID NO: 22213 - RNA, 18 nt, artificial
  Chemically synthesized
agcaaacauccagcagca

SEQ ID NO: 22214 - RNA, 18 nt, artificial
  Chemically synthesized
accucaucaacucacacg

SEQ ID NO: 22215 - RNA, 18 nt, artificial
  Chemically synthesized
uggagaccaagaaguucc

SEQ ID NO: 22216 - RNA, 18 nt, artificial
  Chemically synthesized
caucgucuaccuggagau

SEQ ID NO: 22217 - RNA, 18 nt, artificial
  Chemically synthesized
agcuacugccagcacgau

SEQ ID NO: 22218 - RNA, 18 nt, artificial
  Chemically synthesized
acugcgaggucaacacag

SEQ ID NO: 22219 - RNA, 18 nt, artificial
  Chemically synthesized
cugcaacagcgcggagug

SEQ ID NO: 22220 - RNA, 18 nt, artificial
  Chemically synthesized
ccaggaggacgcgggcaa

SEQ ID NO: 22221 - RNA, 18 nt, artificial
  Chemically synthesized
gugcugcugucccgcaag

SEQ ID NO: 22222 - RNA, 18 nt, artificial
  Chemically synthesized
gcggcuaccgcugccacu

SEQ ID NO: 22223 - RNA, 18 nt, artificial
  Chemically synthesized
cguggagggcaugcugga

SEQ ID NO: 22224 - RNA, 18 nt, artificial
  Chemically synthesized
gccagcugaugccaaaug

SEQ ID NO: 22225 - RNA, 18 nt, artificial
  Chemically synthesized
cggcuggacuggugagga

SEQ ID NO: 22226 - RNA, 18 nt, artificial
  Chemically synthesized
cccaagccuucgggcguc

SEQ ID NO: 22227 - RNA, 18 nt, artificial
  Chemically synthesized
gcccuacgugcccugcag

SEQ ID NO: 22228 - RNA, 18 nt, artificial
  Chemically synthesized
ccgccacggaggcaccug

SEQ ID NO: 22229 - RNA, 18 nt, artificial
  Chemically synthesized
gagugcguucugagcccg

SEQ ID NO: 22230 - RNA, 18 nt, artificial
  Chemically synthesized
cuccuucgagugccagug

SEQ ID NO: 22231 - RNA, 18 nt, artificial
  Chemically synthesized
cuuacaccugugugugca

SEQ ID NO: 22232 - RNA, 18 nt, artificial
  Chemically synthesized
caaccagacagaccgcac

SEQ ID NO: 22233 - RNA, 18 nt, artificial
  Chemically synthesized
caggccuccucgcagugc

SEQ ID NO: 22234 - RNA, 18 nt, artificial
  Chemically synthesized
gcuuccugaguggagagc

SEQ ID NO: 22235 - RNA, 18 nt, artificial
  Chemically synthesized
aaagauaugcagaacaac

SEQ ID NO: 22236 - RNA, 18 nt, artificial
  Chemically synthesized
aggacggcaucaauggcu

SEQ ID NO: 22237 - RNA, 18 nt, artificial
  Chemically synthesized
cgcuccaccagcaucacc

SEQ ID NO: 22238 - RNA, 18 nt, artificial
  Chemically synthesized
gcugccucuucgacggcu

SEQ ID NO: 22239 - RNA, 18 nt, artificial
  Chemically synthesized
ccaagcccgagauggcgg

SEQ ID NO: 22240 - RNA, 18 nt, artificial
  Chemically synthesized
aaugagugcaacagcaac

SEQ ID NO: 22241 - RNA, 18 nt, artificial
  Chemically synthesized
ucugagaaaacaagcaag

SEQ ID NO: 22242 - RNA, 18 nt, artificial
  Chemically synthesized
cuggguggagugggacca

SEQ ID NO: 22243 - RNA, 18 nt, artificial
  Chemically synthesized
agugggaccaacugugac

SEQ ID NO: 22244 - RNA, 18 nt, artificial
  Chemically synthesized
agcaaagccugcagccgc

SEQ ID NO: 22245 - RNA, 18 nt, artificial
  Chemically synthesized
accaagaaguuccgguuc

SEQ ID NO: 22246 - RNA, 18 nt, artificial
  Chemically synthesized
ucaucuaccagggcgcca

SEQ ID NO: 22247 - RNA, 18 nt, artificial
  Chemically synthesized
cguccuuugguccugucc

SEQ ID NO: 22248 - RNA, 18 nt, artificial
  Chemically synthesized
uggacgaguacaaccugg

SEQ ID NO: 22249 - RNA, 18 nt, artificial
  Chemically synthesized
ugugaggucgacaucaac

SEQ ID NO: 22250 - RNA, 18 nt, artificial
  Chemically synthesized
cggagugcgagugggacg

SEQ ID NO: 22251 - RNA, 18 nt, artificial
  Chemically synthesized
uaggagaagcugcaucca

SEQ ID NO: 22252 - RNA, 18 nt, artificial
  Chemically synthesized
gcagccagcaaacaucca

SEQ ID NO: 22253 - RNA, 18 nt, artificial
  Chemically synthesized
gggaaaucgugccagcag

SEQ ID NO: 22254 - RNA, 18 nt, artificial
  Chemically synthesized
cgagccaggcagacgugc

SEQ ID NO: 22255 - RNA, 18 nt, artificial
  Chemically synthesized
ugaaccagggcacgugua

SEQ ID NO: 22256 - RNA, 18 nt, artificial
  Chemically synthesized
gaagaagcggcgggagcc

SEQ ID NO: 22257 - RNA, 18 nt, artificial
  Chemically synthesized
cgccgugggcugcguccu

SEQ ID NO: 22258 - RNA, 18 nt, artificial
  Chemically synthesized
cugcgaccagggcugcaa

SEQ ID NO: 22259 - RNA, 18 nt, artificial
  Chemically synthesized
cugcacaguagccuugcu

SEQ ID NO: 22260 - RNA, 18 nt, artificial
  Chemically synthesized
ggccugauggcuucaccc

SEQ ID NO: 22261 - RNA, 18 nt, artificial
  Chemically synthesized
ccuguacgaccaguacug

SEQ ID NO: 22262 - RNA, 18 nt, artificial
  Chemically synthesized
cggccgcuccaccagcau

SEQ ID NO: 22263 - RNA, 18 nt, artificial
  Chemically synthesized
ugcacgcagucucugcag

SEQ ID NO: 22264 - RNA, 18 nt, artificial
  Chemically synthesized
ccagcaacacagccuggg

SEQ ID NO: 22265 - RNA, 18 nt, artificial
  Chemically synthesized
agugucugaggccagcaa

SEQ ID NO: 22266 - RNA, 18 nt, artificial
  Chemically synthesized
ccuaguuugggaggagca

SEQ ID NO: 22267 - RNA, 18 nt, artificial
  Chemically synthesized
gcaccugacgcccugcug

SEQ ID NO: 22268 - RNA, 18 nt, artificial
  Chemically synthesized
uuccgcacgcggauuaau

SEQ ID NO: 22269 - RNA, 18 nt, artificial
  Chemically synthesized
ccgcugcgaguccgucau

SEQ ID NO: 22270 - RNA, 18 nt, artificial
  Chemically synthesized
cuggagacgggcaacagc

SEQ ID NO: 22271 - RNA, 18 nt, artificial
  Chemically synthesized
ccagcaggcugacccgug

SEQ ID NO: 22272 - RNA, 18 nt, artificial
  Chemically synthesized
ucaaugaguuccagugcg

SEQ ID NO: 22273 - RNA, 18 nt, artificial
  Chemically synthesized
gcgaccagggcugcaaca

SEQ ID NO: 22274 - RNA, 18 nt, artificial
  Chemically synthesized
gcaugcgggcaagugcau

SEQ ID NO: 22275 - RNA, 18 nt, artificial
  Chemically synthesized
cggguucaucugcaagug

SEQ ID NO: 22276 - RNA, 18 nt, artificial
  Chemically synthesized
gacugccagcgugcggaa

SEQ ID NO: 22277 - RNA, 18 nt, artificial
  Chemically synthesized
gccaagugccuggacgga

SEQ ID NO: 22278 - RNA, 18 nt, artificial
  Chemically synthesized
ccuguaacgagggcucca

SEQ ID NO: 22279 - RNA, 18 nt, artificial
  Chemically synthesized
cggccgccuuugugcuuc

SEQ ID NO: 22280 - RNA, 18 nt, artificial
  Chemically synthesized
gucgccaccuucaccugc

SEQ ID NO: 22281 - RNA, 18 nt, artificial
  Chemically synthesized
uugugcuccugaagaacg

SEQ ID NO: 22282 - RNA, 18 nt, artificial
  Chemically synthesized
gaucauauggaccgccug

SEQ ID NO: 22283 - RNA, 18 nt, artificial
  Chemically synthesized
gccgucaucuccgacuuc

SEQ ID NO: 22284 - RNA, 18 nt, artificial
  Chemically synthesized
ccucgccuguggacaaca

SEQ ID NO: 22285 - RNA, 18 nt, artificial
  Chemically synthesized
guggcugcgcagcgacaa

SEQ ID NO: 22286 - RNA, 18 nt, artificial
  Chemically synthesized
cgcccugcaagaacggcg

SEQ ID NO: 22287 - RNA, 18 nt, artificial
  Chemically synthesized
gcggcuacagcugcaccu

SEQ ID NO: 22288 - RNA, 18 nt, artificial
  Chemically synthesized
aaagcauauggguuagau

SEQ ID NO: 22289 - RNA, 18 nt, artificial
  Chemically synthesized
ggccugcgucuguggcgg

SEQ ID NO: 22290 - RNA, 18 nt, artificial
  Chemically synthesized
agcgggauccacugugag

SEQ ID NO: 22291 - RNA, 18 nt, artificial
  Chemically synthesized
ggcagcauggccagcucu

SEQ ID NO: 22292 - RNA, 18 nt, artificial
  Chemically synthesized
guucguugguuauacaag

SEQ ID NO: 22293 - RNA, 18 nt, artificial
  Chemically synthesized
gaugcgucccaagauguu

SEQ ID NO: 22294 - RNA, 18 nt, artificial
  Chemically synthesized
caaugacuuccacugcga

SEQ ID NO: 22295 - RNA, 18 nt, artificial
  Chemically synthesized
ccagcaccucagccugca

SEQ ID NO: 22296 - RNA, 18 nt, artificial
  Chemically synthesized
caacccuugugucaacgg

SEQ ID NO: 22297 - RNA, 18 nt, artificial
  Chemically synthesized
cacuggugugacuccucg

SEQ ID NO: 22298 - RNA, 18 nt, artificial
  Chemically synthesized
ccugcaagugcguggccg

SEQ ID NO: 22299 - RNA, 18 nt, artificial
  Chemically synthesized
gcugccugcuggacagcu

SEQ ID NO: 22300 - RNA, 18 nt, artificial
  Chemically synthesized
accugucuggacaagauc

SEQ ID NO: 22301 - RNA, 18 nt, artificial
  Chemically synthesized
guguggacggcgugaaca

SEQ ID NO: 22302 - RNA, 18 nt, artificial
  Chemically synthesized
cucccagcccggugagac

SEQ ID NO: 22303 - RNA, 18 nt, artificial
  Chemically synthesized
cacccacgguggcuacaa

SEQ ID NO: 22304 - RNA, 18 nt, artificial
  Chemically synthesized
acguguauugacgacguu

SEQ ID NO: 22305 - RNA, 18 nt, artificial
  Chemically synthesized
cgagggugugcacugcga

SEQ ID NO: 22306 - RNA, 18 nt, artificial
  Chemically synthesized
aggaugaaaagauucuuc

SEQ ID NO: 22307 - RNA, 18 nt, artificial
  Chemically synthesized
gagugugccugugagccg

SEQ ID NO: 22308 - RNA, 18 nt, artificial
  Chemically synthesized
cugaccugcgcaugucug

SEQ ID NO: 22309 - RNA, 18 nt, artificial
  Chemically synthesized
cugccugaauggcgggaa

SEQ ID NO: 22310 - RNA, 18 nt, artificial
  Chemically synthesized
gaaaagauucuucugugu

SEQ ID NO: 22311 - RNA, 18 nt, artificial
  Chemically synthesized
gcaaagcuggcucaccuu

SEQ ID NO: 22312 - RNA, 18 nt, artificial
  Chemically synthesized
acccacacccaguaccgc

SEQ ID NO: 22313 - RNA, 18 nt, artificial
  Chemically synthesized
gaucaacguggacgacug

SEQ ID NO: 22314 - RNA, 18 nt, artificial
  Chemically synthesized
aguuguucguugguuaua

SEQ ID NO: 22315 - RNA, 18 nt, artificial
  Chemically synthesized
gcguggcagacuaugccu

SEQ ID NO: 22316 - RNA, 18 nt, artificial
  Chemically synthesized
accagaggagccuuuuua

SEQ ID NO: 22317 - RNA, 18 nt, artificial
  Chemically synthesized
cuggugcagacccagcag

SEQ ID NO: 22318 - RNA, 18 nt, artificial
  Chemically synthesized
cugccugcauggcggcac

SEQ ID NO: 22319 - RNA, 18 nt, artificial
  Chemically synthesized
gcucaugaucgccuccug

SEQ ID NO: 22320 - RNA, 18 nt, artificial
  Chemically synthesized
gcugggcuccuucgagug

SEQ ID NO: 22321 - RNA, 18 nt, artificial
  Chemically synthesized
gcuucaacgguggcaccu

SEQ ID NO: 22322 - RNA, 18 nt, artificial
  Chemically synthesized
aacagcgcggagugcgag

SEQ ID NO: 22323 - RNA, 18 nt, artificial
  Chemically synthesized
ccagcaggugcagccaca

SEQ ID NO: 22324 - RNA, 18 nt, artificial
  Chemically synthesized
cccuguuucuggccgccc

SEQ ID NO: 22325 - RNA, 18 nt, artificial
  Chemically synthesized
aacaacagggaggagaca

SEQ ID NO: 22326 - RNA, 18 nt, artificial
  Chemically synthesized
ccuguuaggagaagcugc

SEQ ID NO: 22327 - RNA, 18 nt, artificial
  Chemically synthesized
ugaaauguaggcaucaug

SEQ ID NO: 22328 - RNA, 18 nt, artificial
  Chemically synthesized
cauaguccaaaaagcucc

SEQ ID NO: 22329 - RNA, 18 nt, artificial
  Chemically synthesized
cacugcgagugccgugcu

SEQ ID NO: 22330 - RNA, 18 nt, artificial
  Chemically synthesized
cagugggcgcaacugcga

SEQ ID NO: 22331 - RNA, 18 nt, artificial
  Chemically synthesized
ggugccaagugccuggac

SEQ ID NO: 22332 - RNA, 18 nt, artificial
  Chemically synthesized
cgagggcuccaacugcga

SEQ ID NO: 22333 - RNA, 18 nt, artificial
  Chemically synthesized
ggcaugcucucgcccgug

SEQ ID NO: 22334 - RNA, 18 nt, artificial
  Chemically synthesized
cauccucgcuggucccac

SEQ ID NO: 22335 - RNA, 18 nt, artificial
  Chemically synthesized
ggccgcaccugacgcccu

SEQ ID NO: 22336 - RNA, 18 nt, artificial
  Chemically synthesized
aggaccucaucaacucac

SEQ ID NO: 22337 - RNA, 18 nt, artificial
  Chemically synthesized
gugcaggccuccucgcag

SEQ ID NO: 22338 - RNA, 18 nt, artificial
  Chemically synthesized
cagauuuuugcaauacca

SEQ ID NO: 22339 - RNA, 18 nt, artificial
  Chemically synthesized
gagcucagcagccagcgg

SEQ ID NO: 22340 - RNA, 18 nt, artificial
  Chemically synthesized
gagaccgacaucgacgac

SEQ ID NO: 22341 - RNA, 18 nt, artificial
  Chemically synthesized
ccacaacgaggucggcuc

SEQ ID NO: 22342 - RNA, 18 nt, artificial
  Chemically synthesized
caagaaguuccgguucga

SEQ ID NO: 22343 - RNA, 18 nt, artificial
  Chemically synthesized
acagcuccuuccacuucc

SEQ ID NO: 22344 - RNA, 18 nt, artificial
  Chemically synthesized
cugcgcaacagcuccuuc

SEQ ID NO: 22345 - RNA, 18 nt, artificial
  Chemically synthesized
uguuuuguaggagacuug

SEQ ID NO: 22346 - RNA, 18 nt, artificial
  Chemically synthesized
auuucacugugggcgggu

SEQ ID NO: 22347 - RNA, 18 nt, artificial
  Chemically synthesized
gcaucaacacggccuucu

SEQ ID NO: 22348 - RNA, 18 nt, artificial
  Chemically synthesized
cugcacuccucagggcag

SEQ ID NO: 22349 - RNA, 18 nt, artificial
  Chemically synthesized
gcccgcagcugcacggag

SEQ ID NO: 22350 - RNA, 18 nt, artificial
  Chemically synthesized
gggagcucagccgcgugc

SEQ ID NO: 22351 - RNA, 18 nt, artificial
  Chemically synthesized
gaggccuccuacaucugc

SEQ ID NO: 22352 - RNA, 18 nt, artificial
  Chemically synthesized
gcggccaagcccgagaug

SEQ ID NO: 22353 - RNA, 18 nt, artificial
  Chemically synthesized
gaccugguggacgagugc

SEQ ID NO: 22354 - RNA, 18 nt, artificial
  Chemically synthesized
cuggaagaacugcacgca

SEQ ID NO: 22355 - RNA, 18 nt, artificial
  Chemically synthesized
cgccuguggacaacaccc

SEQ ID NO: 22356 - RNA, 18 nt, artificial
  Chemically synthesized
uggacgagugccagcuga

SEQ ID NO: 22357 - RNA, 18 nt, artificial
  Chemically synthesized
agcguguccugugaggug

SEQ ID NO: 22358 - RNA, 18 nt, artificial
  Chemically synthesized
ugugugcacggaagggua

SEQ ID NO: 22359 - RNA, 18 nt, artificial
  Chemically synthesized
ugaguuccagugcgagug

SEQ ID NO: 22360 - RNA, 18 nt, artificial
  Chemically synthesized
gucgacaucaacgagugc

SEQ ID NO: 22361 - RNA, 18 nt, artificial
  Chemically synthesized
cgggcacauugagcugug

SEQ ID NO: 22362 - RNA, 18 nt, artificial
  Chemically synthesized
aacgagugccuguccaau

SEQ ID NO: 22363 - RNA, 18 nt, artificial
  Chemically synthesized
gccagaacacccacggcg

SEQ ID NO: 22364 - RNA, 18 nt, artificial
  Chemically synthesized
agugcuuccagagugcca

SEQ ID NO: 22365 - RNA, 18 nt, artificial
  Chemically synthesized
gccgcgcgacaucgcaca

SEQ ID NO: 22366 - RNA, 18 nt, artificial
  Chemically synthesized
uuagaugguuucuugcaa

SEQ ID NO: 22367 - RNA, 18 nt, artificial
  Chemically synthesized
acugccugcugcccuaca

SEQ ID NO: 22368 - RNA, 18 nt, artificial
  Chemically synthesized
cccgcggguucaucugca

SEQ ID NO: 22369 - RNA, 18 nt, artificial
  Chemically synthesized
cccaccagcaugcagucc

SEQ ID NO: 22370 - RNA, 18 nt, artificial
  Chemically synthesized
ccugcacaauggccgcug

SEQ ID NO: 22371 - RNA, 18 nt, artificial
  Chemically synthesized
cagugcaucugcaugccc

SEQ ID NO: 22372 - RNA, 18 nt, artificial
  Chemically synthesized
gcccuacgugcccugcag

SEQ ID NO: 22373 - RNA, 18 nt, artificial
  Chemically synthesized
acgccgacgucaacgccg

SEQ ID NO: 22374 - RNA, 18 nt, artificial
  Chemically synthesized
ucugagagccaggguuuu

SEQ ID NO: 22375 - RNA, 18 nt, artificial
  Chemically synthesized
gacgagugccucucccac

SEQ ID NO: 22376 - RNA, 18 nt, artificial
  Chemically synthesized
cugccagaaccuugugca

SEQ ID NO: 22377 - RNA, 18 nt, artificial
  Chemically synthesized
cauauggguuagauguug

SEQ ID NO: 22378 - RNA, 18 nt, artificial
  Chemically synthesized
ccacgugguggaccgcag

SEQ ID NO: 22379 - RNA, 18 nt, artificial
  Chemically synthesized
gccgaaccaauacaaccc

SEQ ID NO: 22380 - RNA, 18 nt, artificial
  Chemically synthesized
cugcauggcggcaccugu

SEQ ID NO: 22381 - RNA, 18 nt, artificial
  Chemically synthesized
cugcacuucauguacgug

SEQ ID NO: 22382 - RNA, 18 nt, artificial
  Chemically synthesized
gcugcagagcggcauggu

SEQ ID NO: 22383 - RNA, 18 nt, artificial
  Chemically synthesized
gcaccucagccugcacag

SEQ ID NO: 22384 - RNA, 18 nt, artificial
  Chemically synthesized
cucagggugugcacugug

SEQ ID NO: 22385 - RNA, 18 nt, artificial
  Chemically synthesized
ccuuccacuuccugcggg

SEQ ID NO: 22386 - RNA, 18 nt, artificial
  Chemically synthesized
aggacaacaugggccgca

SEQ ID NO: 22387 - RNA, 18 nt, artificial
  Chemically synthesized
auagaguguaguuuacag

SEQ ID NO: 22388 - RNA, 18 nt, artificial
  Chemically synthesized
ggacagcuccggcaugcu

SEQ ID NO: 22389 - RNA, 18 nt, artificial
  Chemically synthesized
gcggcauggugccgaacc

SEQ ID NO: 22390 - RNA, 18 nt, artificial
  Chemically synthesized
gcaccacugccgcugcca

SEQ ID NO: 22391 - RNA, 18 nt, artificial
  Chemically synthesized
caccugggccggagcuuc

SEQ ID NO: 22392 - RNA, 18 nt, artificial
  Chemically synthesized
gcccgugguucugccuga

SEQ ID NO: 22393 - RNA, 18 nt, artificial
  Chemically synthesized
gcagugcaacaaccacgc

SEQ ID NO: 22394 - RNA, 18 nt, artificial
  Chemically synthesized
cgcaggcuucagcgggau

SEQ ID NO: 22395 - RNA, 18 nt, artificial
  Chemically synthesized
ccugcaaggacggcgucg

SEQ ID NO: 22396 - RNA, 18 nt, artificial
  Chemically synthesized
guugaacgagcauagucc

SEQ ID NO: 22397 - RNA, 18 nt, artificial
  Chemically synthesized
caaugccugccucaccaa

SEQ ID NO: 22398 - RNA, 18 nt, artificial
  Chemically synthesized
ucccucaacuucaaugac

SEQ ID NO: 22399 - RNA, 18 nt, artificial
  Chemically synthesized
cagacagaccaccggcag

SEQ ID NO: 22400 - RNA, 18 nt, artificial
  Chemically synthesized
ccuacacaggugccacgu

SEQ ID NO: 22401 - RNA, 18 nt, artificial
  Chemically synthesized
gcgcgacaucgcacagga

SEQ ID NO: 22402 - RNA, 18 nt, artificial
  Chemically synthesized
caccuuggcgugagcuca

SEQ ID NO: 22403 - RNA, 18 nt, artificial
  Chemically synthesized
ugcaauaccaaguauagc

SEQ ID NO: 22404 - RNA, 18 nt, artificial
  Chemically synthesized
cugcauggacgucaaugu

SEQ ID NO: 22405 - RNA, 18 nt, artificial
  Chemically synthesized
gagaccugccugaauggc

SEQ ID NO: 22406 - RNA, 18 nt, artificial
  Chemically synthesized
ugaccagugguccagcuc

SEQ ID NO: 22407 - RNA, 18 nt, artificial
  Chemically synthesized
ggugugcacugcgagguc

SEQ ID NO: 22408 - RNA, 18 nt, artificial
  Chemically synthesized
cgccagccugcacaacca

SEQ ID NO: 22409 - RNA, 18 nt, artificial
  Chemically synthesized
ugucaugccagugaggga

SEQ ID NO: 22410 - RNA, 18 nt, artificial
  Chemically synthesized
acgugugagaaugacgcu

SEQ ID NO: 22411 - RNA, 18 nt, artificial
  Chemically synthesized
ucccaagccuucgggcgu

SEQ ID NO: 22412 - RNA, 18 nt, artificial
  Chemically synthesized
cggguacaagugcgacug

SEQ ID NO: 22413 - RNA, 18 nt, artificial
  Chemically synthesized
accugucagacguggccu

SEQ ID NO: 22414 - RNA, 18 nt, artificial
  Chemically synthesized
aggugggcggcuacagcu

SEQ ID NO: 22415 - RNA, 18 nt, artificial
  Chemically synthesized
ccugcuucaacgguggca

SEQ ID NO: 22416 - RNA, 18 nt, artificial
  Chemically synthesized
ccgccaagcgccugcugg

SEQ ID NO: 22417 - RNA, 18 nt, artificial
  Chemically synthesized
gaggaccuggagaccaag

SEQ ID NO: 22418 - RNA, 18 nt, artificial
  Chemically synthesized
gcgccguggccuccaaca

SEQ ID NO: 22419 - RNA, 18 nt, artificial
  Chemically synthesized
cgagaccgccuugcaccu

SEQ ID NO: 22420 - RNA, 18 nt, artificial
  Chemically synthesized
ccacuucagcgacgggca

SEQ ID NO: 22421 - RNA, 18 nt, artificial
  Chemically synthesized
acgaguacaaccuggugc

SEQ ID NO: 22422 - RNA, 18 nt, artificial
  Chemically synthesized
auggcacgacgccacuga

SEQ ID NO: 22423 - RNA, 18 nt, artificial
  Chemically synthesized
gccgcacaggucugcugu

SEQ ID NO: 22424 - RNA, 18 nt, artificial
  Chemically synthesized
cugcguggacggcaucaa

SEQ ID NO: 22425 - RNA, 18 nt, artificial
  Chemically synthesized
aaagugaucuacaugagg

SEQ ID NO: 22426 - RNA, 18 nt, artificial
  Chemically synthesized
acuuccugcgggagcuca

SEQ ID NO: 22427 - RNA, 18 nt, artificial
  Chemically synthesized
auucuugcagggcuugcc

SEQ ID NO: 22428 - RNA, 18 nt, artificial
  Chemically synthesized
agucaucaauguucucgc

SEQ ID NO: 22429 - RNA, 18 nt, artificial
  Chemically synthesized
acuacauaauacugaacc

SEQ ID NO: 22430 - RNA, 18 nt, artificial
  Chemically synthesized
guucaacuucccuucucc

SEQ ID NO: 22431 - RNA, 18 nt, artificial
  Chemically synthesized
auucuugcagggcuugcc

SEQ ID NO: 22432 - RNA, 18 nt, artificial
  Chemically synthesized
uucuuggucuccaggucc

SEQ ID NO: 22433 - RNA, 18 nt, artificial
  Chemically synthesized
acucguugauguuggucu

SEQ ID NO: 22434 - RNA, 18 nt, artificial
  Chemically synthesized
uacauaauacugaaccug

SEQ ID NO: 22435 - RNA, 18 nt, artificial
  Chemically synthesized
uuuuuucugccauaggcu

SEQ ID NO: 22436 - RNA, 18 nt, artificial
  Chemically synthesized
uaugcucguucaacuucc

SEQ ID NO: 22437 - RNA, 18 nt, artificial
  Chemically synthesized
agucaucaauguucucgc

SEQ ID NO: 22438 - RNA, 18 nt, artificial
  Chemically synthesized
auucaaacugguggaccc

SEQ ID NO: 22439 - RNA, 18 nt, artificial
  Chemically synthesized
auucucacacguggcgcc

SEQ ID NO: 22440 - RNA, 18 nt, artificial
  Chemically synthesized
agaagaaucuuuucaucc

SEQ ID NO: 22441 - RNA, 18 nt, artificial
  Chemically synthesized
agaugcacuggaacuccc

SEQ ID NO: 22442 - RNA, 18 nt, artificial
  Chemically synthesized
uuguucucacaguggauc

SEQ ID NO: 22443 - RNA, 18 nt, artificial
  Chemically synthesized
aucuguaaguuuuguggc

SEQ ID NO: 22444 - RNA, 18 nt, artificial
  Chemically synthesized
uucuuggucuccaggucc

SEQ ID NO: 22445 - RNA, 18 nt, artificial
  Chemically synthesized
auucaggcaggucucacc

SEQ ID NO: 22446 - RNA, 18 nt, artificial
  Chemically synthesized
ucagaugcaaauuaaucc

SEQ ID NO: 22447 - RNA, 18 nt, artificial
  Chemically synthesized
aucucacagugcacaccc

SEQ ID NO: 22448 - RNA, 18 nt, artificial
  Chemically synthesized
uuggauucacacucauug

SEQ ID NO: 22449 - RNA, 18 nt, artificial
  Chemically synthesized
uugcggaccuucuugccc

SEQ ID NO: 22450 - RNA, 18 nt, artificial
  Chemically synthesized
guucaacuucccuucucc

SEQ ID NO: 22451 - RNA, 18 nt, artificial
  Chemically synthesized
ucuggaugcagcuucucc

SEQ ID NO: 22452 - RNA, 18 nt, artificial
  Chemically synthesized
uuuucacaagcaugcuug

SEQ ID NO: 22453 - RNA, 18 nt, artificial
  Chemically synthesized
agaugcaaauuaauccgc

SEQ ID NO: 22454 - RNA, 18 nt, artificial
  Chemically synthesized
acucguugauguuggucu

SEQ ID NO: 22455 - RNA, 18 nt, artificial
  Chemically synthesized
auuuuuucugccauaggc

SEQ ID NO: 22456 - RNA, 18 nt, artificial
  Chemically synthesized
acgucaacaccuugucgc

SEQ ID NO: 22457 - RNA, 18 nt, artificial
  Chemically synthesized
agaacagaagcacaaagg

SEQ ID NO: 22458 - RNA, 18 nt, artificial
  Chemically synthesized
guuggucccacuccaccc

SEQ ID NO: 22459 - RNA, 18 nt, artificial
  Chemically synthesized
uaugauccgugauguccc

SEQ ID NO: 22460 - RNA, 18 nt, artificial
  Chemically synthesized
uggguuggacgcacacuc

SEQ ID NO: 22461 - RNA, 18 nt, artificial
  Chemically synthesized
uuucuguaaacuacacuc

SEQ ID NO: 22462 - RNA, 18 nt, artificial
  Chemically synthesized
acucguugacauccugcc

SEQ ID NO: 22463 - RNA, 18 nt, artificial
  Chemically synthesized
aaguuuuguggcugcacc

SEQ ID NO: 22464 - RNA, 18 nt, artificial
  Chemically synthesized
cucgguacaguacugacc

SEQ ID NO: 22465 - RNA, 18 nt, artificial
  Chemically synthesized
aacucauugaucuugucc

SEQ ID NO: 22466 - RNA, 18 nt, artificial
  Chemically synthesized
caucuguaaguuuugugg

SEQ ID NO: 22467 - RNA, 18 nt, artificial
  Chemically synthesized
aaaucaacaucuugggac

SEQ ID NO: 22468 - RNA, 18 nt, artificial
  Chemically synthesized
guucuugcaguuguuucc

SEQ ID NO: 22469 - RNA, 18 nt, artificial
  Chemically synthesized
acugcgugcaguucuucc

SEQ ID NO: 22470 - RNA, 18 nt, artificial
  Chemically synthesized
uaauacugaaccugaaac

SEQ ID NO: 22471 - RNA, 18 nt, artificial
  Chemically synthesized
aauguucucgcugcaguc

SEQ ID NO: 22472 - RNA, 18 nt, artificial
  Chemically synthesized
acggucucacucugcacg

SEQ ID NO: 22473 - RNA, 18 nt, artificial
  Chemically synthesized
auucaaacugguggaccc

SEQ ID NO: 22474 - RNA, 18 nt, artificial
  Chemically synthesized
uuuuguggcugcaccugc

SEQ ID NO: 22475 - RNA, 18 nt, artificial
  Chemically synthesized
auucucacacguggcgcc

SEQ ID NO: 22476 - RNA, 18 nt, artificial
  Chemically synthesized
agugcacaagguucuggc

SEQ ID NO: 22477 - RNA, 18 nt, artificial
  Chemically synthesized
acuggaacucauugaucu

SEQ ID NO: 22478 - RNA, 18 nt, artificial
  Chemically synthesized
aaacugguggacccgccc

SEQ ID NO: 22479 - RNA, 18 nt, artificial
  Chemically synthesized
ucuccacucaggaagcuc

SEQ ID NO: 22480 - RNA, 18 nt, artificial
  Chemically synthesized
acucgucuguguugaccu

SEQ ID NO: 22481 - RNA, 18 nt, artificial
  Chemically synthesized
uucccuucuccaacauca

SEQ ID NO: 22482 - RNA, 18 nt, artificial
  Chemically synthesized
uuuccuggacaaucgucg

SEQ ID NO: 22483 - RNA, 18 nt, artificial
  Chemically synthesized
uacauaauacugaaccug

SEQ ID NO: 22484 - RNA, 18 nt, artificial
  Chemically synthesized
gacacucgcaguagaagg

SEQ ID NO: 22485 - RNA, 18 nt, artificial
  Chemically synthesized
aacucauugaucuugucc

SEQ ID NO: 22486 - RNA, 18 nt, artificial
  Chemically synthesized
uugauguuggucucgcag

SEQ ID NO: 22487 - RNA, 18 nt, artificial
  Chemically synthesized
aucuguaaguuuuguggc

SEQ ID NO: 22488 - RNA, 18 nt, artificial
  Chemically synthesized
ucuuguccagacaggugc

SEQ ID NO: 22489 - RNA, 18 nt, artificial
  Chemically synthesized
uugauguuacacaugcuc

SEQ ID NO: 22490 - RNA, 18 nt, artificial
  Chemically synthesized
auucaggcaggucucacc

SEQ ID NO: 22491 - RNA, 18 nt, artificial
  Chemically synthesized
uaaguguuggguccgucc

SEQ ID NO: 22492 - RNA, 18 nt, artificial
  Chemically synthesized
uagccaucgaucuugucc

SEQ ID NO: 22493 - RNA, 18 nt, artificial
  Chemically synthesized
aucucacagugcacaccc

SEQ ID NO: 22494 - RNA, 18 nt, artificial
  Chemically synthesized
ugccgguugucaaucucc

SEQ ID NO: 22495 - RNA, 18 nt, artificial
  Chemically synthesized
aguuguagguguucacgc

SEQ ID NO: 22496 - RNA, 18 nt, artificial
  Chemically synthesized
acucguugaugucgaccu

SEQ ID NO: 22497 - RNA, 18 nt, artificial
  Chemically synthesized
uacaugcuccgcacaguc

SEQ ID NO: 22498 - RNA, 18 nt, artificial
  Chemically synthesized
gcacuugcagaugaaccc

SEQ ID NO: 22499 - RNA, 18 nt, artificial
  Chemically synthesized
cuuuuuggacuaugcucg

SEQ ID NO: 22500 - RNA, 18 nt, artificial
  Chemically synthesized
uaugcucguucaacuucc

SEQ ID NO: 22501 - RNA, 18 nt, artificial
  Chemically synthesized
auuuuuucugccauaggc

SEQ ID NO: 22502 - RNA, 18 nt, artificial
  Chemically synthesized
cagccacucgcauugacc

SEQ ID NO: 22503 - RNA, 18 nt, artificial
  Chemically synthesized
uugaugucacaguugguc

SEQ ID NO: 22504 - RNA, 18 nt, artificial
  Chemically synthesized
aaucgucgauauuuuccu

SEQ ID NO: 22505 - RNA, 18 nt, artificial
  Chemically synthesized
uacauuucaagaacgggc

SEQ ID NO: 22506 - RNA, 18 nt, artificial
  Chemically synthesized
acucauugaucuugucca

SEQ ID NO: 22507 - RNA, 18 nt, artificial
  Chemically synthesized
ucggcgucaaccucaccc

SEQ ID NO: 22508 - RNA, 18 nt, artificial
  Chemically synthesized
cauugaccauucaaacug

SEQ ID NO: 22509 - RNA, 18 nt, artificial
  Chemically synthesized
agucauccagguugaucu

SEQ ID NO: 22510 - RNA, 18 nt, artificial
  Chemically synthesized
acucguugacgucgaucu

SEQ ID NO: 22511 - RNA, 18 nt, artificial
  Chemically synthesized
aagucuccuacaaaacac

SEQ ID NO: 22512 - RNA, 18 nt, artificial
  Chemically synthesized
cuguugcacucauugacc

SEQ ID NO: 22513 - RNA, 18 nt, artificial
  Chemically synthesized
acucguugacauccugcc

SEQ ID NO: 22514 - RNA, 18 nt, artificial
  Chemically synthesized
ucuccucccuguuguucu

SEQ ID NO: 22515 - RNA, 18 nt, artificial
  Chemically synthesized
uguaguccaggauguggc

SEQ ID NO: 22516 - RNA, 18 nt, artificial
  Chemically synthesized
cuucuuggucuccagguc

SEQ ID NO: 22517 - RNA, 18 nt, artificial
  Chemically synthesized
uagccacuggucaugucu

SEQ ID NO: 22518 - RNA, 18 nt, artificial
  Chemically synthesized
ucuccagguccucguccc

SEQ ID NO: 22519 - RNA, 18 nt, artificial
  Chemically synthesized
aggguuggauucacacuc

SEQ ID NO: 22520 - RNA, 18 nt, artificial
  Chemically synthesized
cuccucacagaaagugcc

SEQ ID NO: 22521 - RNA, 18 nt, artificial
  Chemically synthesized
gaacuugcuuguuuucuc

SEQ ID NO: 22522 - RNA, 18 nt, artificial
  Chemically synthesized
uuggucucgcaguggugg

SEQ ID NO: 22523 - RNA, 18 nt, artificial
  Chemically synthesized
uggaagacaccuugugcg

SEQ ID NO: 22524 - RNA, 18 nt, artificial
  Chemically synthesized
acucaucgauguugaugu

SEQ ID NO: 22525 - RNA, 18 nt, artificial
  Chemically synthesized
cuguugcacucauugacc

SEQ ID NO: 22526 - RNA, 18 nt, artificial
  Chemically synthesized
acagaagcacaaaggcgg

SEQ ID NO: 22527 - RNA, 18 nt, artificial
  Chemically synthesized
ggucugccagcauuugcc

SEQ ID NO: 22528 - RNA, 18 nt, artificial
  Chemically synthesized
uacaguacugaccugucc

SEQ ID NO: 22529 - RNA, 18 nt, artificial
  Chemically synthesized
cauucaaacugguggacc

SEQ ID NO: 22530 - RNA, 18 nt, artificial
  Chemically synthesized
acugcgugcaguucuucc

SEQ ID NO: 22531 - RNA, 18 nt, artificial
  Chemically synthesized
aauguucucgcugcaguc

SEQ ID NO: 22532 - RNA, 18 nt, artificial
  Chemically synthesized
gaccucacaggucugccc

SEQ ID NO: 22533 - RNA, 18 nt, artificial
  Chemically synthesized
uuguucucacaguggauc

SEQ ID NO: 22534 - RNA, 18 nt, artificial
  Chemically synthesized
uguucucacaguggaucc

SEQ ID NO: 22535 - RNA, 18 nt, artificial
  Chemically synthesized
ucuguaaguuuuguggcu

SEQ ID NO: 22536 - RNA, 18 nt, artificial
  Chemically synthesized
cagucaucaauguucucg

SEQ ID NO: 22537 - RNA, 18 nt, artificial
  Chemically synthesized
gugcaaggcggucucgcc

SEQ ID NO: 22538 - RNA, 18 nt, artificial
  Chemically synthesized
cucguucaacuucccuuc

SEQ ID NO: 22539 - RNA, 18 nt, artificial
  Chemically synthesized
acucguccacaucguacu

SEQ ID NO: 22540 - RNA, 18 nt, artificial
  Chemically synthesized
gucucacucugcacggcc

SEQ ID NO: 22541 - RNA, 18 nt, artificial
  Chemically synthesized
acggucucacucugcacg

SEQ ID NO: 22542 - RNA, 18 nt, artificial
  Chemically synthesized
uucccuucuccaacauca

SEQ ID NO: 22543 - RNA, 18 nt, artificial
  Chemically synthesized
auaugauccgugaugucc

SEQ ID NO: 22544 - RNA, 18 nt, artificial
  Chemically synthesized
uugucaaucuccagguag

SEQ ID NO: 22545 - RNA, 18 nt, artificial
  Chemically synthesized
acucgucgaucuccucag

SEQ ID NO: 22546 - RNA, 18 nt, artificial
  Chemically synthesized
aucucauguuugacaugc

SEQ ID NO: 22547 - RNA, 18 nt, artificial
  Chemically synthesized
cucgcaguagaaggaggc

SEQ ID NO: 22548 - RNA, 18 nt, artificial
  Chemically synthesized
uggucugucuggucgucc

SEQ ID NO: 22549 - RNA, 18 nt, artificial
  Chemically synthesized
ucucggguacaugcuccg

SEQ ID NO: 22550 - RNA, 18 nt, artificial
  Chemically synthesized
agugcacaagguucuggc

SEQ ID NO: 22551 - RNA, 18 nt, artificial
  Chemically synthesized
acuggaacucauugaucu

SEQ ID NO: 22552 - RNA, 18 nt, artificial
  Chemically synthesized
aguuggucccacuccacc

SEQ ID NO: 22553 - RNA, 18 nt, artificial
  Chemically synthesized
agccaagucugacguccc

SEQ ID NO: 22554 - RNA, 18 nt, artificial
  Chemically synthesized
agucguccacguugaucu

SEQ ID NO: 22555 - RNA, 18 nt, artificial
  Chemically synthesized
caucuguaaguuuugugg

SEQ ID NO: 22556 - RNA, 18 nt, artificial
  Chemically synthesized
auugaccauucaaacugg

SEQ ID NO: 22557 - RNA, 18 nt, artificial
  Chemically synthesized
cucgguacaguacugacc

SEQ ID NO: 22558 - RNA, 18 nt, artificial
  Chemically synthesized
uuggauucacacucauug

SEQ ID NO: 22559 - RNA, 18 nt, artificial
  Chemically synthesized
ucucguagcugcccuccc

SEQ ID NO: 22560 - RNA, 18 nt, artificial
  Chemically synthesized
guugcacuggccuuccgc

SEQ ID NO: 22561 - RNA, 18 nt, artificial
  Chemically synthesized
guucuggcaggaugcgcc

SEQ ID NO: 22562 - RNA, 18 nt, artificial
  Chemically synthesized
ucgcacucaucgaugucc

SEQ ID NO: 22563 - RNA, 18 nt, artificial
  Chemically synthesized
auguucucgcugcagucc

SEQ ID NO: 22564 - RNA, 18 nt, artificial
  Chemically synthesized
cagucucaaaggccagcc

SEQ ID NO: 22565 - RNA, 18 nt, artificial
  Chemically synthesized
ugcuugcaagaaaccauc

SEQ ID NO: 22566 - RNA, 18 nt, artificial
  Chemically synthesized
ugaugucacaguuggucc

SEQ ID NO: 22567 - RNA, 18 nt, artificial
  Chemically synthesized
uugcggaccuucuugccc

SEQ ID NO: 22568 - RNA, 18 nt, artificial
  Chemically synthesized
gaacuucuuggucuccag

SEQ ID NO: 22569 - RNA, 18 nt, artificial
  Chemically synthesized
caacuucccuucuccaac

SEQ ID NO: 22570 - RNA, 18 nt, artificial
  Chemically synthesized
ucuggaugcagcuucucc

SEQ ID NO: 22571 - RNA, 18 nt, artificial
  Chemically synthesized
ugauugguaccaugggug

SEQ ID NO: 22572 - RNA, 18 nt, artificial
  Chemically synthesized
acucgucuguguugaccu

SEQ ID NO: 22573 - RNA, 18 nt, artificial
  Chemically synthesized
ucuguggcucgguuccgg

SEQ ID NO: 22574 - RNA, 18 nt, artificial
  Chemically synthesized
gcacuugcaggaguagcc

SEQ ID NO: 22575 - RNA, 18 nt, artificial
  Chemically synthesized
ccgcguccacacagagcc

SEQ ID NO: 22576 - RNA, 18 nt, artificial
  Chemically synthesized
uuuggacuaugcucguuc

SEQ ID NO: 22577 - RNA, 18 nt, artificial
  Chemically synthesized
uucuguaaacuacacucu

SEQ ID NO: 22578 - RNA, 18 nt, artificial
  Chemically synthesized
acucgcaguagaaggagg

SEQ ID NO: 22579 - RNA, 18 nt, artificial
  Chemically synthesized
uguugauguuacacaugc

SEQ ID NO: 22580 - RNA, 18 nt, artificial
  Chemically synthesized
aguacuggucguacaggg

SEQ ID NO: 22581 - RNA, 18 nt, artificial
  Chemically synthesized
acgcuggcagucaaagcc

SEQ ID NO: 22582 - RNA, 18 nt, artificial
  Chemically synthesized
ucuuguccaggcagcggc

SEQ ID NO: 22583 - RNA, 18 nt, artificial
  Chemically synthesized
uucucacaguggaucccg

SEQ ID NO: 22584 - RNA, 18 nt, artificial
  Chemically synthesized
cacuggucaugucuuugc

SEQ ID NO: 22585 - RNA, 18 nt, artificial
  Chemically synthesized
uagcugccuguguagccc

SEQ ID NO: 22586 - RNA, 18 nt, artificial
  Chemically synthesized
ugaguugcacuggcuguc

SEQ ID NO: 22587 - RNA, 18 nt, artificial
  Chemically synthesized
uuguugcacugcaggcug

SEQ ID NO: 22588 - RNA, 18 nt, artificial
  Chemically synthesized
uuggcaccauucuugcag

SEQ ID NO: 22589 - RNA, 18 nt, artificial
  Chemically synthesized
ugccuggcucggcucucc

SEQ ID NO: 22590 - RNA, 18 nt, artificial
  Chemically synthesized
ucaucaauguucucgcug

SEQ ID NO: 22591 - RNA, 18 nt, artificial
  Chemically synthesized
uggucaugucuuugcagg

SEQ ID NO: 22592 - RNA, 18 nt, artificial
  Chemically synthesized
guucuugcaguuguuucc

SEQ ID NO: 22593 - RNA, 18 nt, artificial
  Chemically synthesized
cgucacugaaguacuucc

SEQ ID NO: 22594 - RNA, 18 nt, artificial
  Chemically synthesized
cuggaugcagcuucuccu

SEQ ID NO: 22595 - RNA, 18 nt, artificial
  Chemically synthesized
ucacuggcacacucguug

SEQ ID NO: 22596 - RNA, 18 nt, artificial
  Chemically synthesized
aggugaagccauugaugc

SEQ ID NO: 22597 - RNA, 18 nt, artificial
  Chemically synthesized
agaugcccagugaagccc

SEQ ID NO: 22598 - RNA, 18 nt, artificial
  Chemically synthesized
ucuggaagacaccuugug

SEQ ID NO: 22599 - RNA, 18 nt, artificial
  Chemically synthesized
uugcuguugcacucauug

SEQ ID NO: 22600 - RNA, 18 nt, artificial
  Chemically synthesized
uguuugacaugcaugaug

SEQ ID NO: 22601 - RNA, 18 nt, artificial
  Chemically synthesized
ucgucaauacacgugccc

SEQ ID NO: 22602 - RNA, 18 nt, artificial
  Chemically synthesized
aaauuaauccgcgugcgg

SEQ ID NO: 22603 - RNA, 18 nt, artificial
  Chemically synthesized
cacacucguugauguugg

SEQ ID NO: 22604 - RNA, 18 nt, artificial
  Chemically synthesized
cacucaggaagcuccggc

SEQ ID NO: 22605 - RNA, 18 nt, artificial
  Chemically synthesized
agaagaaucuuuucaucc

SEQ ID NO: 22606 - RNA, 18 nt, artificial
  Chemically synthesized
aguuguagguguucacgc

SEQ ID NO: 22607 - RNA, 18 nt, artificial
  Chemically synthesized
agagguaggcguugucgc

SEQ ID NO: 22608 - RNA, 18 nt, artificial
  Chemically synthesized
gagaagcucucauagucc

SEQ ID NO: 22609 - RNA, 18 nt, artificial
  Chemically synthesized
uacacacuccgagaacac

SEQ ID NO: 22610 - RNA, 18 nt, artificial
  Chemically synthesized
guacuggcacagaugccc

SEQ ID NO: 22611 - RNA, 18 nt, artificial
  Chemically synthesized
acucguugaugucgaccu

SEQ ID NO: 22612 - RNA, 18 nt, artificial
  Chemically synthesized
cuccuugcuuccacaggc

SEQ ID NO: 22613 - RNA, 18 nt, artificial
  Chemically synthesized
cacucuggaagcacugcg

SEQ ID NO: 22614 - RNA, 18 nt, artificial
  Chemically synthesized
uccacggucucacucugc

SEQ ID NO: 22615 - RNA, 18 nt, artificial
  Chemically synthesized
ugaagucggagaugacgg

SEQ ID NO: 22616 - RNA, 18 nt, artificial
  Chemically synthesized
aagcucucauaguccucg

SEQ ID NO: 22617 - RNA, 18 nt, artificial
  Chemically synthesized
agaugcacuggaacuccc

SEQ ID NO: 22618 - RNA, 18 nt, artificial
  Chemically synthesized
aaccugaaacaaagauuc

SEQ ID NO: 22619 - RNA, 18 nt, artificial
  Chemically synthesized
aaggcuugggaaaggaag

SEQ ID NO: 22620 - RNA, 18 nt, artificial
  Chemically synthesized
ucaaucuccagguagacg

SEQ ID NO: 22621 - RNA, 18 nt, artificial
  Chemically synthesized
acucaucgauguccaccu

SEQ ID NO: 22622 - RNA, 18 nt, artificial
  Chemically synthesized
uuugcuggcugcagguuc

SEQ ID NO: 22623 - RNA, 18 nt, artificial
  Chemically synthesized
uuguuguugaugucacag

SEQ ID NO: 22624 - RNA, 18 nt, artificial
  Chemically synthesized
augacacacaacagacuc

SEQ ID NO: 22625 - RNA, 18 nt, artificial
  Chemically synthesized
cagaugcacuggaacucc

SEQ ID NO: 22626 - RNA, 18 nt, artificial
  Chemically synthesized
acagugaaauucagggcc

SEQ ID NO: 22627 - RNA, 18 nt, artificial
  Chemically synthesized
guuguagguguucacgcc

SEQ ID NO: 22628 - RNA, 18 nt, artificial
  Chemically synthesized
cugggugagcacucgucc

SEQ ID NO: 22629 - RNA, 18 nt, artificial
  Chemically synthesized
uugcgcccacuguagccg

SEQ ID NO: 22630 - RNA, 18 nt, artificial
  Chemically synthesized
acucaggaagcuccggcc

SEQ ID NO: 22631 - RNA, 18 nt, artificial
  Chemically synthesized
auguuggucucgcagugg

SEQ ID NO: 22632 - RNA, 18 nt, artificial
  Chemically synthesized
cguccugggacuucuucc

SEQ ID NO: 22633 - RNA, 18 nt, artificial
  Chemically synthesized
uauuuuccucacaguucu

SEQ ID NO: 22634 - RNA, 18 nt, artificial
  Chemically synthesized
agggcuugccuuugcagc

SEQ ID NO: 22635 - RNA, 18 nt, artificial
  Chemically synthesized
aaucgucgauauuuuccu

SEQ ID NO: 22636 - RNA, 18 nt, artificial
  Chemically synthesized
guuguugcacugcaggcu

SEQ ID NO: 22637 - RNA, 18 nt, artificial
  Chemically synthesized
auccuacguaggaaaacc

SEQ ID NO: 22638 - RNA, 18 nt, artificial
  Chemically synthesized
ucggauugccugcacucc

SEQ ID NO: 22639 - RNA, 18 nt, artificial
  Chemically synthesized
ugucuuugcaggugccgc

SEQ ID NO: 22640 - RNA, 18 nt, artificial
  Chemically synthesized
uucaacuucccuucucca

SEQ ID NO: 22641 - RNA, 18 nt, artificial
  Chemically synthesized
ugcauaucuuuguuagcc

SEQ ID NO: 22642 - RNA, 18 nt, artificial
  Chemically synthesized
augugggcucacaggucc

SEQ ID NO: 22643 - RNA, 18 nt, artificial
  Chemically synthesized
augcuugcaagaaaccau

SEQ ID NO: 22644 - RNA, 18 nt, artificial
  Chemically synthesized
acucguccacauccucgg

SEQ ID NO: 22645 - RNA, 18 nt, artificial
  Chemically synthesized
auguuugcuggcugcagg

SEQ ID NO: 22646 - RNA, 18 nt, artificial
  Chemically synthesized
ucgcacucauugacaucg

SEQ ID NO: 22647 - RNA, 18 nt, artificial
  Chemically synthesized
cguguuguucucacagug

SEQ ID NO: 22648 - RNA, 18 nt, artificial
  Chemically synthesized
uccuacguaggaaaaccc

SEQ ID NO: 22649 - RNA, 18 nt, artificial
  Chemically synthesized
gacacucgcaguagaagg

SEQ ID NO: 22650 - RNA, 18 nt, artificial
  Chemically synthesized
uugcccgcacacucaucg

SEQ ID NO: 22651 - RNA, 18 nt, artificial
  Chemically synthesized
agucauccagguugaucu

SEQ ID NO: 22652 - RNA, 18 nt, artificial
  Chemically synthesized
uuugcugcugggcuugcg

SEQ ID NO: 22653 - RNA, 18 nt, artificial
  Chemically synthesized
uuuuguggcugcaccugc

SEQ ID NO: 22654 - RNA, 18 nt, artificial
  Chemically synthesized
acuuguacccguugaggc

SEQ ID NO: 22655 - RNA, 18 nt, artificial
  Chemically synthesized
cacacaacagacucauuc

SEQ ID NO: 22656 - RNA, 18 nt, artificial
  Chemically synthesized
cuggcucucagaacuugc

SEQ ID NO: 22657 - RNA, 18 nt, artificial
  Chemically synthesized
acucguugacgucgaucu

SEQ ID NO: 22658 - RNA, 18 nt, artificial
  Chemically synthesized
ucugcagccgggacagcc

SEQ ID NO: 22659 - RNA, 18 nt, artificial
  Chemically synthesized
aagauucaugauugguac

SEQ ID NO: 22660 - RNA, 18 nt, artificial
  Chemically synthesized
cugggugagcacucgucc

SEQ ID NO: 22661 - RNA, 18 nt, artificial
  Chemically synthesized
acuugcagaugaacccgc

SEQ ID NO: 22662 - RNA, 18 nt, artificial
  Chemically synthesized
uuuccucacaguucuggc

SEQ ID NO: 22663 - RNA, 18 nt, artificial
  Chemically synthesized
uacguaggaaaacccugg

SEQ ID NO: 22664 - RNA, 18 nt, artificial
  Chemically synthesized
uuggacgcacacucguug

SEQ ID NO: 22665 - RNA, 18 nt, artificial
  Chemically synthesized
agucuccuacaaaacacg

SEQ ID NO: 22666 - RNA, 18 nt, artificial
  Chemically synthesized
aagucuccuacaaaacac

SEQ ID NO: 22667 - RNA, 18 nt, artificial
  Chemically synthesized
gcggcuccacggucucac

SEQ ID NO: 22668 - RNA, 18 nt, artificial
  Chemically synthesized
agaauagugugcaccgcc

SEQ ID NO: 22669 - RNA, 18 nt, artificial
  Chemically synthesized
gugcuggcacacucgucc

SEQ ID NO: 22670 - RNA, 18 nt, artificial
  Chemically synthesized
ucaugucuuugcaggugc

SEQ ID NO: 22671 - RNA, 18 nt, artificial
  Chemically synthesized
uccaggucaggcagaacc

SEQ ID NO: 22672 - RNA, 18 nt, artificial
  Chemically synthesized
ucugggacugcaugcugg

SEQ ID NO: 22673 - RNA, 18 nt, artificial
  Chemically synthesized
acuuguacuccgucagcg

SEQ ID NO: 22674 - RNA, 18 nt, artificial
  Chemically synthesized
ugucgaccucacaggucu

SEQ ID NO: 22675 - RNA, 18 nt, artificial
  Chemically synthesized
ccggcucuggcaagucuc

SEQ ID NO: 22676 - RNA, 18 nt, artificial
  Chemically synthesized
acuccgcgcuguugcagc

SEQ ID NO: 22677 - RNA, 18 nt, artificial
  Chemically synthesized
ucaggaucuggaagacac

SEQ ID NO: 22678 - RNA, 18 nt, artificial
  Chemically synthesized
ucgcuguugcccgucucc

SEQ ID NO: 22679 - RNA, 18 nt, artificial
  Chemically synthesized
uucaggagcacaacugcg

SEQ ID NO: 22680 - RNA, 18 nt, artificial
  Chemically synthesized
agcacucguugauguugg

SEQ ID NO: 22681 - RNA, 18 nt, artificial
  Chemically synthesized
uguguuuuaaaaaggcuc

SEQ ID NO: 22682 - RNA, 18 nt, artificial
  Chemically synthesized
uggcucggcucuccacuc

SEQ ID NO: 22683 - RNA, 18 nt, artificial
  Chemically synthesized
cuggcucucagaacuugc

SEQ ID NO: 22684 - RNA, 18 nt, artificial
  Chemically synthesized
uugcacuggcugucacag

SEQ ID NO: 22685 - RNA, 18 nt, artificial
  Chemically synthesized
augcagucggcgucaacc

SEQ ID NO: 22686 - RNA, 18 nt, artificial
  Chemically synthesized
acucaucgauguugaugu

SEQ ID NO: 22687 - RNA, 18 nt, artificial
  Chemically synthesized
uugaugucgaccucacag

SEQ ID NO: 22688 - RNA, 18 nt, artificial
  Chemically synthesized
aaaaggguaggaugccuc

SEQ ID NO: 22689 - RNA, 18 nt, artificial
  Chemically synthesized
ggucauugaaguugaggg

SEQ ID NO: 22690 - RNA, 18 nt, artificial
  Chemically synthesized
gucauucucacacguggc

SEQ ID NO: 22691 - RNA, 18 nt, artificial
  Chemically synthesized
ucauucugguugucgucc

SEQ ID NO: 22692 - RNA, 18 nt, artificial
  Chemically synthesized
uuguucugcauaucuuug

SEQ ID NO: 22693 - RNA, 18 nt, artificial
  Chemically synthesized
ugcaaggcggucucgccc

SEQ ID NO: 22694 - RNA, 18 nt, artificial
  Chemically synthesized
agaugcaaauuaauccgc

SEQ ID NO: 22695 - RNA, 18 nt, artificial
  Chemically synthesized
gggcugggagcaucgcgg

SEQ ID NO: 22696 - RNA, 18 nt, artificial
  Chemically synthesized
gauucacacucauuguug

SEQ ID NO: 22697 - RNA, 18 nt, artificial
  Chemically synthesized
uagcuguccacgcagucc

SEQ ID NO: 22698 - RNA, 18 nt, artificial
  Chemically synthesized
guccuugcaguacugguc

SEQ ID NO: 22699 - RNA, 18 nt, artificial
  Chemically synthesized
cagcuucuccuaacaggc

SEQ ID NO: 22700 - RNA, 18 nt, artificial
  Chemically synthesized
ugagucgcacucauugac

SEQ ID NO: 22701 - RNA, 18 nt, artificial
  Chemically synthesized
guuguuaaagcacuuggg

SEQ ID NO: 22702 - RNA, 18 nt, artificial
  Chemically synthesized
cacagugaaauucagggc

SEQ ID NO: 22703 - RNA, 18 nt, artificial
  Chemically synthesized
ugcgcaccagguuguacu

SEQ ID NO: 22704 - RNA, 18 nt, artificial
  Chemically synthesized
augaagugcagcugcgcc

SEQ ID NO: 22705 - RNA, 18 nt, artificial
  Chemically synthesized
aauacugaaccugaaaca

SEQ ID NO: 22706 - RNA, 18 nt, artificial
  Chemically synthesized
ugccauaggcuauacuug

SEQ ID NO: 22707 - RNA, 18 nt, artificial
  Chemically synthesized
gaucuggaagacaccuug

SEQ ID NO: 22708 - RNA, 18 nt, artificial
  Chemically synthesized
uuuccuggacaaucgucg

SEQ ID NO: 22709 - RNA, 18 nt, artificial
  Chemically synthesized
ugauguuacacaugcucc

SEQ ID NO: 22710 - RNA, 18 nt, artificial
  Chemically synthesized
uaaguuuuguggcugcac

SEQ ID NO: 22711 - RNA, 18 nt, artificial
  Chemically synthesized
gcaguugcacuuguaccc

SEQ ID NO: 22712 - RNA, 18 nt, artificial
  Chemically synthesized
gaugcaaauuaauccgcg

SEQ ID NO: 22713 - RNA, 18 nt, artificial
  Chemically synthesized
cuuuuuggacuaugcucg

SEQ ID NO: 22714 - RNA, 18 nt, artificial
  Chemically synthesized
aggcuuugcugcugcugg

SEQ ID NO: 22715 - RNA, 18 nt, artificial
  Chemically synthesized
aacuucuuggucuccagg

SEQ ID NO: 22716 - RNA, 18 nt, artificial
  Chemically synthesized
uuuuccucacaguucugg

SEQ ID NO: 22717 - RNA, 18 nt, artificial
  Chemically synthesized
caaacugguggacccgcc

SEQ ID NO: 22718 - RNA, 18 nt, artificial
  Chemically synthesized
uugcgggacagcagcacc

SEQ ID NO: 22719 - RNA, 18 nt, artificial
  Chemically synthesized
ucaggaacugggcugcgg

SEQ ID NO: 22720 - RNA, 18 nt, artificial
  Chemically synthesized
uguucucgcugcaguccu

SEQ ID NO: 22721 - RNA, 18 nt, artificial
  Chemically synthesized
uugauguuggucucgcag

SEQ ID NO: 22722 - RNA, 18 nt, artificial
  Chemically synthesized
cuccgagaacacauuuuc

SEQ ID NO: 22723 - RNA, 18 nt, artificial
  Chemically synthesized
guucuggcaggcauuugg

SEQ ID NO: 22724 - RNA, 18 nt, artificial
  Chemically synthesized
uugcacuggccuuccgca

SEQ ID NO: 22725 - RNA, 18 nt, artificial
  Chemically synthesized
accagguuguacucgucc

SEQ ID NO: 22726 - RNA, 18 nt, artificial
  Chemically synthesized
ugaccuguccacucuggc

SEQ ID NO: 22727 - RNA, 18 nt, artificial
  Chemically synthesized
accuguccacucuggcgg

SEQ ID NO: 22728 - RNA, 18 nt, artificial
  Chemically synthesized
acugggugugggucugcc

SEQ ID NO: 22729 - RNA, 18 nt, artificial
  Chemically synthesized
ucgguacaguacugaccu

SEQ ID NO: 22730 - RNA, 18 nt, artificial
  Chemically synthesized
caacgucgucaauacacg

SEQ ID NO: 22731 - RNA, 18 nt, artificial
  Chemically synthesized
acuucuuggucuccaggu

SEQ ID NO: 22732 - RNA, 18 nt, artificial
  Chemically synthesized
auuugccgccguucuugc

SEQ ID NO: 22733 - RNA, 18 nt, artificial
  Chemically synthesized
uucucacacguggcgccc

SEQ ID NO: 22734 - RNA, 18 nt, artificial
  Chemically synthesized
ugucggucucgcaguugc

SEQ ID NO: 22735 - RNA, 18 nt, artificial
  Chemically synthesized
aaugugcccggcucuggc

SEQ ID NO: 22736 - RNA, 18 nt, artificial
  Chemically synthesized
acucguccacaucguacu

SEQ ID NO: 22737 - RNA, 18 nt, artificial
  Chemically synthesized
uugauguuacacaugcuc

SEQ ID NO: 22738 - RNA, 18 nt, artificial
  Chemically synthesized
uguugcacucauugaccu

SEQ ID NO: 22739 - RNA, 18 nt, artificial
  Chemically synthesized
gcacuugcagaugaaccc

SEQ ID NO: 22740 - RNA, 18 nt, artificial
  Chemically synthesized
auugcaaaaaucugcucc

SEQ ID NO: 22741 - RNA, 18 nt, artificial
  Chemically synthesized
ugacgucgaucucgcauc

SEQ ID NO: 22742 - RNA, 18 nt, artificial
  Chemically synthesized
cauccacauuguucacgg

SEQ ID NO: 22743 - RNA, 18 nt, artificial
  Chemically synthesized
ucuuggcauacacacucc

SEQ ID NO: 22744 - RNA, 18 nt, artificial
  Chemically synthesized
aguggaagucauugacgc

SEQ ID NO: 22745 - RNA, 18 nt, artificial
  Chemically synthesized
uagccgcccaccuggucc

SEQ ID NO: 22746 - RNA, 18 nt, artificial
  Chemically synthesized
ucauucucacacguggcg

SEQ ID NO: 22747 - RNA, 18 nt, artificial
  Chemically synthesized
acugguggacccgcccac

SEQ ID NO: 22748 - RNA, 18 nt, artificial
  Chemically synthesized
auaugauccgugaugucc

SEQ ID NO: 22749 - RNA, 18 nt, artificial
  Chemically synthesized
cauugaccauucaaacug

SEQ ID NO: 22750 - RNA, 18 nt, artificial
  Chemically synthesized
acucgucgaucuccucag

SEQ ID NO: 22751 - RNA, 18 nt, artificial
  Chemically synthesized
uaaguguuggguccgucc

SEQ ID NO: 22752 - RNA, 18 nt, artificial
  Chemically synthesized
acccguugaggcuguccc

SEQ ID NO: 22753 - RNA, 18 nt, artificial
  Chemically synthesized
uagccaucgaucuugucc

SEQ ID NO: 22754 - RNA, 18 nt, artificial
  Chemically synthesized
aucucauguuugacaugc

SEQ ID NO: 22755 - RNA, 18 nt, artificial
  Chemically synthesized
cugcuggcacagucaucc

SEQ ID NO: 22756 - RNA, 18 nt, artificial
  Chemically synthesized
augucgugaugcaugcgc

SEQ ID NO: 22757 - RNA, 18 nt, artificial
  Chemically synthesized
acucauugacaucgugcu

SEQ ID NO: 22758 - RNA, 18 nt, artificial
  Chemically synthesized
acauuuucacaagcaugc

SEQ ID NO: 22759 - RNA, 18 nt, artificial
  Chemically synthesized
ugggcuugcggaccuucu

SEQ ID NO: 22760 - RNA, 18 nt, artificial
  Chemically synthesized
aaccugaaacaaagauuc

SEQ ID NO: 22761 - RNA, 18 nt, artificial
  Chemically synthesized
uucucacaguggaucccg

SEQ ID NO: 22762 - RNA, 18 nt, artificial
  Chemically synthesized
uacaucaucuacaguucc

SEQ ID NO: 22763 - RNA, 18 nt, artificial
  Chemically synthesized
augcuuucacuuguuucc

SEQ ID NO: 22764 - RNA, 18 nt, artificial
  Chemically synthesized
guacuuccagcacugcag

SEQ ID NO: 22765 - RNA, 18 nt, artificial
  Chemically synthesized
ccacagugaaauucaggg

SEQ ID NO: 22766 - RNA, 18 nt, artificial
  Chemically synthesized
ucucugugcagucaggcg

SEQ ID NO: 22767 - RNA, 18 nt, artificial
  Chemically synthesized
cuucuugcccugcacgcc

SEQ ID NO: 22768 - RNA, 18 nt, artificial
  Chemically synthesized
aucuucuucggaaccugg

SEQ ID NO: 22769 - RNA, 18 nt, artificial
  Chemically synthesized
gggacaggaccaaaggac

SEQ ID NO: 22770 - RNA, 18 nt, artificial
  Chemically synthesized
cucuuggcauacacacuc

SEQ ID NO: 22771 - RNA, 18 nt, artificial
  Chemically synthesized
ugccgguugucaaucucc

SEQ ID NO: 22772 - RNA, 18 nt, artificial
  Chemically synthesized
aguuggucccacuccacc

SEQ ID NO: 22773 - RNA, 18 nt, artificial
  Chemically synthesized
agucguccacguugaucu

SEQ ID NO: 22774 - RNA, 18 nt, artificial
  Chemically synthesized
agccaagucugacguccc

SEQ ID NO: 22775 - RNA, 18 nt, artificial
  Chemically synthesized
uugguaccaugggugcac

SEQ ID NO: 22776 - RNA, 18 nt, artificial
  Chemically synthesized
ucguccacaucguacugg

SEQ ID NO: 22777 - RNA, 18 nt, artificial
  Chemically synthesized
ccgucugaagcguucuuc

SEQ ID NO: 22778 - RNA, 18 nt, artificial
  Chemically synthesized
auugaccauucaaacugg

SEQ ID NO: 22779 - RNA, 18 nt, artificial
  Chemically synthesized
cacggucucacucugcac

SEQ ID NO: 22780 - RNA, 18 nt, artificial
  Chemically synthesized
acucguugauguccuccu

SEQ ID NO: 22781 - RNA, 18 nt, artificial
  Chemically synthesized
ucaacaccuugucgcugc

SEQ ID NO: 22782 - RNA, 18 nt, artificial
  Chemically synthesized
aggccugcacacacugcc

SEQ ID NO: 22783 - RNA, 18 nt, artificial
  Chemically synthesized
cugcuggcacagucaucc

SEQ ID NO: 22784 - RNA, 18 nt, artificial
  Chemically synthesized
ugaucucgcaguuggguc

SEQ ID NO: 22785 - RNA, 18 nt, artificial
  Chemically synthesized
cuccucacagaaagugcc

SEQ ID NO: 22786 - RNA, 18 nt, artificial
  Chemically synthesized
acucauccacguccuggc

SEQ ID NO: 22787 - RNA, 18 nt, artificial
  Chemically synthesized
acucgugggugacgucgc

SEQ ID NO: 22788 - RNA, 18 nt, artificial
  Chemically synthesized
uggcugcugagcucacgc

SEQ ID NO: 22789 - RNA, 18 nt, artificial
  Chemically synthesized
cacucgucuguguugacc

SEQ ID NO: 22790 - RNA, 18 nt, artificial
  Chemically synthesized
uuugacaugcaugaugcc

SEQ ID NO: 22791 - RNA, 18 nt, artificial
  Chemically synthesized
uugggaccgcugaagccc

SEQ ID NO: 22792 - RNA, 18 nt, artificial
  Chemically synthesized
acucauuguuguugaugu

SEQ ID NO: 22793 - RNA, 18 nt, artificial
  Chemically synthesized
ucuucaggagcacaacug

SEQ ID NO: 22794 - RNA, 18 nt, artificial
  Chemically synthesized
acgccuccucgaucagcg

SEQ ID NO: 22795 - RNA, 18 nt, artificial
  Chemically synthesized
uggcucucagaacuugcu

SEQ ID NO: 22796 - RNA, 18 nt, artificial
  Chemically synthesized
uuugccucuggaugcagc

SEQ ID NO: 22797 - RNA, 18 nt, artificial
  Chemically synthesized
aggcgguccauaugaucc

SEQ ID NO: 22798 - RNA, 18 nt, artificial
  Chemically synthesized
uacaugcuccgcacaguc

SEQ ID NO: 22799 - RNA, 18 nt, artificial
  Chemically synthesized
cuugcggaccuucuugcc

SEQ ID NO: 22800 - RNA, 18 nt, artificial
  Chemically synthesized
guuugacaugcaugaugc

SEQ ID NO: 22801 - RNA, 18 nt, artificial
  Chemically synthesized
cauugaugacggacucgc

SEQ ID NO: 22802 - RNA, 18 nt, artificial
  Chemically synthesized
uguugaugcacuugcccg

SEQ ID NO: 22803 - RNA, 18 nt, artificial
  Chemically synthesized
uugcccaggucaucuacg

SEQ ID NO: 22804 - RNA, 18 nt, artificial
  Chemically synthesized
cauucaaacugguggacc

SEQ ID NO: 22805 - RNA, 18 nt, artificial
  Chemically synthesized
acucgcaguagaaggagg

SEQ ID NO: 22806 - RNA, 18 nt, artificial
  Chemically synthesized
ugaugccuacauuucaag

SEQ ID NO: 22807 - RNA, 18 nt, artificial
  Chemically synthesized
acucgcagcgguacuggg

SEQ ID NO: 22808 - RNA, 18 nt, artificial
  Chemically synthesized
guacugaccuguccacuc

SEQ ID NO: 22809 - RNA, 18 nt, artificial
  Chemically synthesized
aguacuggucguacaggg

SEQ ID NO: 22810 - RNA, 18 nt, artificial
  Chemically synthesized
aacaucuaacccauaugc

SEQ ID NO: 22811 - RNA, 18 nt, artificial
  Chemically synthesized
acgcuggcagucaaagcc

SEQ ID NO: 22812 - RNA, 18 nt, artificial
  Chemically synthesized
cuugcaggaguagccgcc

SEQ ID NO: 22813 - RNA, 18 nt, artificial
  Chemically synthesized
cauccaggucuguggcuc

SEQ ID NO: 22814 - RNA, 18 nt, artificial
  Chemically synthesized
ucaggagcacaacugcgg

SEQ ID NO: 22815 - RNA, 18 nt, artificial
  Chemically synthesized
aucuugggacgcaucugg

SEQ ID NO: 22816 - RNA, 18 nt, artificial
  Chemically synthesized
cucacaggucugcccuug

SEQ ID NO: 22817 - RNA, 18 nt, artificial
  Chemically synthesized
acugaaguacuuccagca

SEQ ID NO: 22818 - RNA, 18 nt, artificial
  Chemically synthesized
agaacgcacucguugaug

SEQ ID NO: 22819 - RNA, 18 nt, artificial
  Chemically synthesized
uaugcuuucacuuguuuc

SEQ ID NO: 22820 - RNA, 18 nt, artificial
  Chemically synthesized
ucugucuggucguccagg

SEQ ID NO: 22821 - RNA, 18 nt, artificial
  Chemically synthesized
uugaugucacaguugguc

SEQ ID NO: 22822 - RNA, 18 nt, artificial
  Chemically synthesized
acugcaggcugcagaccu

SEQ ID NO: 22823 - RNA, 18 nt, artificial
  Chemically synthesized
ggucugccagcauuugcc

SEQ ID NO: 22824 - RNA, 18 nt, artificial
  Chemically synthesized
augcgucguugagguggc

SEQ ID NO: 22825 - RNA, 18 nt, artificial
  Chemically synthesized
agucgucgaugucggucu

SEQ ID NO: 22826 - RNA, 18 nt, artificial
  Chemically synthesized
gcuugcggaccuucuugc

SEQ ID NO: 22827 - RNA, 18 nt, artificial
  Chemically synthesized
ucugucugguugugcagg

SEQ ID NO: 22828 - RNA, 18 nt, artificial
  Chemically synthesized
uacaugaagugcagcugc

SEQ ID NO: 22829 - RNA, 18 nt, artificial
  Chemically synthesized
uacauuucaagaacgggc

SEQ ID NO: 22830 - RNA, 18 nt, artificial
  Chemically synthesized
cucguucaacuucccuuc

SEQ ID NO: 22831 - RNA, 18 nt, artificial
  Chemically synthesized
guugaagcaggagcucuc

SEQ ID NO: 22832 - RNA, 18 nt, artificial
  Chemically synthesized
guguuguucucacagugg

SEQ ID NO: 22833 - RNA, 18 nt, artificial
  Chemically synthesized
ucuccagguagacgaugg

SEQ ID NO: 22834 - RNA, 18 nt, artificial
  Chemically synthesized
ucggcgucaaccucaccc

SEQ ID NO: 22835 - RNA, 18 nt, artificial
  Chemically synthesized
ucauugacaucgugcugg

SEQ ID NO: 22836 - RNA, 18 nt, artificial
  Chemically synthesized
acucguagccaucgaucu

SEQ ID NO: 22837 - RNA, 18 nt, artificial
  Chemically synthesized
cuccacucaggaagcucc

SEQ ID NO: 22838 - RNA, 18 nt, artificial
  Chemically synthesized
gaccucacaggucugccc

SEQ ID NO: 22839 - RNA, 18 nt, artificial
  Chemically synthesized
aggugaagccauugaugc

SEQ ID NO: 22840 - RNA, 18 nt, artificial
  Chemically synthesized
acugggcugcggucacgg

SEQ ID NO: 22841 - RNA, 18 nt, artificial
  Chemically synthesized
gucugacgucccucacug

SEQ ID NO: 22842 - RNA, 18 nt, artificial
  Chemically synthesized
uuggucuccagguccucg

SEQ ID NO: 22843 - RNA, 18 nt, artificial
  Chemically synthesized
cucucggguacaugcucc

SEQ ID NO: 22844 - RNA, 18 nt, artificial
  Chemically synthesized
uugauguuggucuggcag

SEQ ID NO: 22845 - RNA, 18 nt, artificial
  Chemically synthesized
cacuggaacucauugauc

SEQ ID NO: 22846 - RNA, 18 nt, artificial
  Chemically synthesized
acagucgcacuuguaccc

SEQ ID NO: 22847 - RNA, 18 nt, artificial
  Chemically synthesized
uguugaugccgucugugc

SEQ ID NO: 22848 - RNA, 18 nt, artificial
  Chemically synthesized
gugcaaggcggucucgcc

SEQ ID NO: 22849 - RNA, 18 nt, artificial
  Chemically synthesized
cauccagguugaucucgc

SEQ ID NO: 22850 - RNA, 18 nt, artificial
  Chemically synthesized
aacagaagcacaaaggcg

SEQ ID NO: 22851 - RNA, 18 nt, artificial
  Chemically synthesized
uggaacucauugaucuug

SEQ ID NO: 22852 - RNA, 18 nt, artificial
  Chemically synthesized
augucccggcguucuugc

SEQ ID NO: 22853 - RNA, 18 nt, artificial
  Chemically synthesized
ucauguuugacaugcaug

SEQ ID NO: 22854 - RNA, 18 nt, artificial
  Chemically synthesized
ucuccucccuguuguucu

SEQ ID NO: 22855 - RNA, 18 nt, artificial
  Chemically synthesized
acccuggcucucagaacu

SEQ ID NO: 22856 - RNA, 18 nt, artificial
  Chemically synthesized
gucucacucugcacggcc

SEQ ID NO: 22857 - RNA, 18 nt, artificial
  Chemically synthesized
cgagcgucauucucacac

SEQ ID NO: 22858 - RNA, 18 nt, artificial
  Chemically synthesized
aaggcuacugugcagcgg

SEQ ID NO: 22859 - RNA, 18 nt, artificial
  Chemically synthesized
uguaguccaggauguggc

SEQ ID NO: 22860 - RNA, 18 nt, artificial
  Chemically synthesized
uagccacuggucaugucu

SEQ ID NO: 22861 - RNA, 18 nt, artificial
  Chemically synthesized
acucauugaccucagaca

SEQ ID NO: 22862 - RNA, 18 nt, artificial
  Chemically synthesized
cacucaucgauguccacc

SEQ ID NO: 22863 - RNA, 18 nt, artificial
  Chemically synthesized
gggcuugccuuugcagcc

SEQ ID NO: 22864 - RNA, 18 nt, artificial
  Chemically synthesized
uucuugcagggcuugccu

SEQ ID NO: 22865 - RNA, 18 nt, artificial
  Chemically synthesized
acgucugccuggcucggc

SEQ ID NO: 22866 - RNA, 18 nt, artificial
  Chemically synthesized
augcaugcgucguugagg

SEQ ID NO: 22867 - RNA, 18 nt, artificial
  Chemically synthesized
caaucgucgauauuuucc

SEQ ID NO: 22868 - RNA, 18 nt, artificial
  Chemically synthesized
aacuucuuggucuccagg

SEQ ID NO: 22869 - RNA, 18 nt, artificial
  Chemically synthesized
guugcuggagcaucuucu

SEQ ID NO: 22870 - RNA, 18 nt, artificial
  Chemically synthesized
augcucccuguguagccc

SEQ ID NO: 22871 - RNA, 18 nt, artificial
  Chemically synthesized
ugguuguugcacugcagg

SEQ ID NO: 22872 - RNA, 18 nt, artificial
  Chemically synthesized
agcuguccacgcaguccg

SEQ ID NO: 22873 - RNA, 18 nt, artificial
  Chemically synthesized
ucugguugugcaggcugg

SEQ ID NO: 22874 - RNA, 18 nt, artificial
  Chemically synthesized
aguuuuguggcugcaccu

SEQ ID NO: 22875 - RNA, 18 nt, artificial
  Chemically synthesized
uuguugcccgcguccucc

SEQ ID NO: 22876 - RNA, 18 nt, artificial
  Chemically synthesized
guggcugcacgucugccu

SEQ ID NO: 22877 - RNA, 18 nt, artificial
  Chemically synthesized
uucaacuucccuucucca

SEQ ID NO: 22878 - RNA, 18 nt, artificial
  Chemically synthesized
uuggucucgcaguggugg

SEQ ID NO: 22879 - RNA, 18 nt, artificial
  Chemically synthesized
uggaagacaccuugugcg

SEQ ID NO: 22880 - RNA, 18 nt, artificial
  Chemically synthesized
uuguacucguccagcagc

SEQ ID NO: 22881 - RNA, 18 nt, artificial
  Chemically synthesized
ucugcaccaggugaggcu

SEQ ID NO: 22882 - RNA, 18 nt, artificial
  Chemically synthesized
ucuucuucggaaccuggg

SEQ ID NO: 22883 - RNA, 18 nt, artificial
  Chemically synthesized
uggagacgcccucggacc

SEQ ID NO: 22884 - RNA, 18 nt, artificial
  Chemically synthesized
cacucguugaugucgacc

SEQ ID NO: 22885 - RNA, 18 nt, artificial
  Chemically synthesized
aacccuggcucucagaac

SEQ ID NO: 22886 - RNA, 18 nt, artificial
  Chemically synthesized
ugcagaccuuguugcccg

SEQ ID NO: 22887 - RNA, 18 nt, artificial
  Chemically synthesized
acagcugcaggcauaguc

SEQ ID NO: 22888 - RNA, 18 nt, artificial
  Chemically synthesized
aggaggcgaucaugagcg

SEQ ID NO: 22889 - RNA, 18 nt, artificial
  Chemically synthesized
uuggcggucucguagcug

SEQ ID NO: 22890 - RNA, 18 nt, artificial
  Chemically synthesized
auauuuuccucacaguuc

SEQ ID NO: 22891 - RNA, 18 nt, artificial
  Chemically synthesized
cagaugcaaauuaauccg

SEQ ID NO: 22892 - RNA, 18 nt, artificial
  Chemically synthesized
uguuguccuggauguugg

SEQ ID NO: 22893 - RNA, 18 nt, artificial
  Chemically synthesized
aagucugacgucccucac

SEQ ID NO: 22894 - RNA, 18 nt, artificial
  Chemically synthesized
ucugguccaggcaggugg

SEQ ID NO: 22895 - RNA, 18 nt, artificial
  Chemically synthesized
uguacucguccagcagcc

SEQ ID NO: 22896 - RNA, 18 nt, artificial
  Chemically synthesized
ccgcuucacacuucccgc

SEQ ID NO: 22897 - RNA, 18 nt, artificial
  Chemically synthesized
cagucucaaaggccagcc

SEQ ID NO: 22898 - RNA, 18 nt, artificial
  Chemically synthesized
acgcaucuggucaugccc

SEQ ID NO: 22899 - RNA, 18 nt, artificial
  Chemically synthesized
uugaugagguccuccagc

SEQ ID NO: 22900 - RNA, 18 nt, artificial
  Chemically synthesized
gucuuugcaggugccgcc

SEQ ID NO: 22901 - RNA, 18 nt, artificial
  Chemically synthesized
acgcgugguuguugcacu

SEQ ID NO: 22902 - RNA, 18 nt, artificial
  Chemically synthesized
agucaggcguguuguucu

SEQ ID NO: 22903 - RNA, 18 nt, artificial
  Chemically synthesized
aagacaccuugugcgucg

SEQ ID NO: 22904 - RNA, 18 nt, artificial
  Chemically synthesized
ucguugacauccugccgg

SEQ ID NO: 22905 - RNA, 18 nt, artificial
  Chemically synthesized
gcaggugcacacguagcc

SEQ ID NO: 22906 - RNA, 18 nt, artificial
  Chemically synthesized
ggcucuccacucaggaag

SEQ ID NO: 22907 - RNA, 18 nt, artificial
  Chemically synthesized
acugaaccugaaacaaag

SEQ ID NO: 22908 - RNA, 18 nt, artificial
  Chemically synthesized
cacucauugacaucgugc

SEQ ID NO: 22909 - RNA, 18 nt, artificial
  Chemically synthesized
aaaggguaggaugccucc

SEQ ID NO: 22910 - RNA, 18 nt, artificial
  Chemically synthesized
uguaaguuuuguggcugc

SEQ ID NO: 22911 - RNA, 18 nt, artificial
  Chemically synthesized
uccucagagcaguucacc

SEQ ID NO: 22912 - RNA, 18 nt, artificial
  Chemically synthesized
aagcucucauaguccucg

SEQ ID NO: 22913 - RNA, 18 nt, artificial
  Chemically synthesized
caacgucaacaccuuguc

SEQ ID NO: 22914 - RNA, 18 nt, artificial
  Chemically synthesized
cacucguccaccaggucc

SEQ ID NO: 22915 - RNA, 18 nt, artificial
  Chemically synthesized
cuccgcacaguccagccc

SEQ ID NO: 22916 - RNA, 18 nt, artificial
  Chemically synthesized
cuggcugcagguucugcu

SEQ ID NO: 22917 - RNA, 18 nt, artificial
  Chemically synthesized
aggccaggccuuugcugc

SEQ ID NO: 22918 - RNA, 18 nt, artificial
  Chemically synthesized
cggucucacucugcacgg

SEQ ID NO: 22919 - RNA, 18 nt, artificial
  Chemically synthesized
cucagaacgcacucguug

SEQ ID NO: 22920 - RNA, 18 nt, artificial
  Chemically synthesized
cggucucgcaguugcgcc

SEQ ID NO: 22921 - RNA, 18 nt, artificial
  Chemically synthesized
uacaguacugaccugucc

SEQ ID NO: 22922 - RNA, 18 nt, artificial
  Chemically synthesized
aaggcuugggaaaggaag

SEQ ID NO: 22923 - RNA, 18 nt, artificial
  Chemically synthesized
uugcgcagcugcuccggc

SEQ ID NO: 22924 - RNA, 18 nt, artificial
  Chemically synthesized
augggugcacucuuggca

SEQ ID NO: 22925 - RNA, 18 nt, artificial
  Chemically synthesized
guugcacuggccuuccgc

SEQ ID NO: 22926 - RNA, 18 nt, artificial
  Chemically synthesized
acucaucgauguccaccu

SEQ ID NO: 22927 - RNA, 18 nt, artificial
  Chemically synthesized
cucauugaccucagacag

SEQ ID NO: 22928 - RNA, 18 nt, artificial
  Chemically synthesized
gcaaggcuacugugcagc

SEQ ID NO: 22929 - RNA, 18 nt, artificial
  Chemically synthesized
cuccgugccuugaggucc

SEQ ID NO: 22930 - RNA, 18 nt, artificial
  Chemically synthesized
ugucugguugugcaggcu

SEQ ID NO: 22931 - RNA, 18 nt, artificial
  Chemically synthesized
aaggugcggcuguggugg

SEQ ID NO: 22932 - RNA, 18 nt, artificial
  Chemically synthesized
ugcacacccugagugccc

SEQ ID NO: 22933 - RNA, 18 nt, artificial
  Chemically synthesized
cgucauucucacacgugg

SEQ ID NO: 22934 - RNA, 18 nt, artificial
  Chemically synthesized
ucgaugucggucucgcag

SEQ ID NO: 22935 - RNA, 18 nt, artificial
  Chemically synthesized
uucaggagcacaacugcg

SEQ ID NO: 22936 - RNA, 18 nt, artificial
  Chemically synthesized
agcccaggacggugcugg

SEQ ID NO: 22937 - RNA, 18 nt, artificial
  Chemically synthesized
ugaagugcagcugcgccg

SEQ ID NO: 22938 - RNA, 18 nt, artificial
  Chemically synthesized
agaggguuguauugguuc

SEQ ID NO: 22939 - RNA, 18 nt, artificial
  Chemically synthesized
ucuccacucaggaagcuc

SEQ ID NO: 22940 - RNA, 18 nt, artificial
  Chemically synthesized
uuugccuccguuugccuc

SEQ ID NO: 22941 - RNA, 18 nt, artificial
  Chemically synthesized
augacacacaacagacuc

SEQ ID NO: 22942 - RNA, 18 nt, artificial
  Chemically synthesized
gaacuucuuggucuccag

SEQ ID NO: 22943 - RNA, 18 nt, artificial
  Chemically synthesized
uugguucggcaccaugcc

SEQ ID NO: 22944 - RNA, 18 nt, artificial
  Chemically synthesized
cacuggucaugucuuugc

SEQ ID NO: 22945 - RNA, 18 nt, artificial
  Chemically synthesized
acagugaaauucagggcc

SEQ ID NO: 22946 - RNA, 18 nt, artificial
  Chemically synthesized
accuuggcggucucguag

SEQ ID NO: 22947 - RNA, 18 nt, artificial
  Chemically synthesized
gaacuuguauaaccaacg

SEQ ID NO: 22948 - RNA, 18 nt, artificial
  Chemically synthesized
cucagacacuuugaagcc

SEQ ID NO: 22949 - RNA, 18 nt, artificial
  Chemically synthesized
uuguugaugucacaguug

SEQ ID NO: 22950 - RNA, 18 nt, artificial
  Chemically synthesized
uuguuuccuggacaaucg

SEQ ID NO: 22951 - RNA, 18 nt, artificial
  Chemically synthesized
ucacugaaguacuuccag

SEQ ID NO: 22952 - RNA, 18 nt, artificial
  Chemically synthesized
guucuucaggagcacaac

SEQ ID NO: 22953 - RNA, 18 nt, artificial
  Chemically synthesized
uugccuuugcagccauug

SEQ ID NO: 22954 - RNA, 18 nt, artificial
  Chemically synthesized
ugcagggcacguagggcc

SEQ ID NO: 22955 - RNA, 18 nt, artificial
  Chemically synthesized
acucaggaagcuccggcc

SEQ ID NO: 22956 - RNA, 18 nt, artificial
  Chemically synthesized
auguuggucucgcagugg

SEQ ID NO: 22957 - RNA, 18 nt, artificial
  Chemically synthesized
cgucgucaauacacgugc

SEQ ID NO: 22958 - RNA, 18 nt, artificial
  Chemically synthesized
uagccgcccagguagucc

SEQ ID NO: 22959 - RNA, 18 nt, artificial
  Chemically synthesized
gcacuugcaggaguagcc

SEQ ID NO: 22960 - RNA, 18 nt, artificial
  Chemically synthesized
cuggcugcagguucugcu

SEQ ID NO: 22961 - RNA, 18 nt, artificial
  Chemically synthesized
aguggcugcacgucugcc

SEQ ID NO: 22962 - RNA, 18 nt, artificial
  Chemically synthesized
agggcuugccuuugcagc

SEQ ID NO: 22963 - RNA, 18 nt, artificial
  Chemically synthesized
aggugagccagcuuugcc

SEQ ID NO: 22964 - RNA, 18 nt, artificial
  Chemically synthesized
auccuacguaggaaaacc

SEQ ID NO: 22965 - RNA, 18 nt, artificial
  Chemically synthesized
ugugaguugaugaggucc

SEQ ID NO: 22966 - RNA, 18 nt, artificial
  Chemically synthesized
ucuuuucauccuacguag

SEQ ID NO: 22967 - RNA, 18 nt, artificial
  Chemically synthesized
ucgcacuggaacucauug

SEQ ID NO: 22968 - RNA, 18 nt, artificial
  Chemically synthesized
aagaacagaagcacaaag

SEQ ID NO: 22969 - RNA, 18 nt, artificial
  Chemically synthesized
ucgugggugacgucgccc

SEQ ID NO: 22970 - RNA, 18 nt, artificial
  Chemically synthesized
ucucauguuugacaugca

SEQ ID NO: 22971 - RNA, 18 nt, artificial
  Chemically synthesized
ucggguacaugcuccgca

SEQ ID NO: 22972 - RNA, 18 nt, artificial
  Chemically synthesized
cgucacugaaguacuucc

SEQ ID NO: 22973 - RNA, 18 nt, artificial
  Chemically synthesized
augugggcucacaggucc

SEQ ID NO: 22974 - RNA, 18 nt, artificial
  Chemically synthesized
ucacaggucugcccuugc

SEQ ID NO: 22975 - RNA, 18 nt, artificial
  Chemically synthesized
aacuucccuucuccaaca

SEQ ID NO: 22976 - RNA, 18 nt, artificial
  Chemically synthesized
augcuugcaagaaaccau

SEQ ID NO: 22977 - RNA, 18 nt, artificial
  Chemically synthesized
acucguccacauccucgg

SEQ ID NO: 22978 - RNA, 18 nt, artificial
  Chemically synthesized
ucggaugugggcucacag

SEQ ID NO: 22979 - RNA, 18 nt, artificial
  Chemically synthesized
gagacugcgugcaguucu

SEQ ID NO: 22980 - RNA, 18 nt, artificial
  Chemically synthesized
aaacugguggacccgccc

SEQ ID NO: 22981 - RNA, 18 nt, artificial
  Chemically synthesized
aggcuacugugcagcggg

SEQ ID NO: 22982 - RNA, 18 nt, artificial
  Chemically synthesized
auguuugcuggcugcagg

SEQ ID NO: 22983 - RNA, 18 nt, artificial
  Chemically synthesized
uugucaaucuccagguag

SEQ ID NO: 22984 - RNA, 18 nt, artificial
  Chemically synthesized
ggucucgcaguugcgccc

SEQ ID NO: 22985 - RNA, 18 nt, artificial
  Chemically synthesized
ucguugacgucgaucucg

SEQ ID NO: 22986 - RNA, 18 nt, artificial
  Chemically synthesized
uggucugucuggucgucc

SEQ ID NO: 22987 - RNA, 18 nt, artificial
  Chemically synthesized
uuuuaaaaaggcuccucu

SEQ ID NO: 22988 - RNA, 18 nt, artificial
  Chemically synthesized
cgauuucccugaccagcc

SEQ ID NO: 22989 - RNA, 18 nt, artificial
  Chemically synthesized
uucuggcaggcauuuggc

SEQ ID NO: 22990 - RNA, 18 nt, artificial
  Chemically synthesized
cucucggguacaugcucc

SEQ ID NO: 22991 - RNA, 18 nt, artificial
  Chemically synthesized
gcaucuguaaguuuugug

SEQ ID NO: 22992 - RNA, 18 nt, artificial
  Chemically synthesized
ucuccucagagcaguuca

SEQ ID NO: 22993 - RNA, 18 nt, artificial
  Chemically synthesized
acuuguacccguugaggc

SEQ ID NO: 22994 - RNA, 18 nt, artificial
  Chemically synthesized
ucacaguuggucccacuc

SEQ ID NO: 22995 - RNA, 18 nt, artificial
  Chemically synthesized
ugucgugaugcaugcgcu

SEQ ID NO: 22996 - RNA, 18 nt, artificial
  Chemically synthesized
cugucugguugugcaggc

SEQ ID NO: 22997 - RNA, 18 nt, artificial
  Chemically synthesized
cacagucaucaauguucu

SEQ ID NO: 22998 - RNA, 18 nt, artificial
  Chemically synthesized
gagcgucauucucacacg

SEQ ID NO: 22999 - RNA, 18 nt, artificial
  Chemically synthesized
cucguugauguuggucuc

SEQ ID NO: 23000 - RNA, 18 nt, artificial
  Chemically synthesized
agguuguacucguccagc

SEQ ID NO: 23001 - RNA, 18 nt, artificial
  Chemically synthesized
aagcuguaguccaggaug

SEQ ID NO: 23002 - RNA, 18 nt, artificial
  Chemically synthesized
uguucuggcaggaugcgc

SEQ ID NO: 23003 - RNA, 18 nt, artificial
  Chemically synthesized
acuugcagaugaacccgc

SEQ ID NO: 23004 - RNA, 18 nt, artificial
  Chemically synthesized
agguguaaguguuggguc

SEQ ID NO: 23005 - RNA, 18 nt, artificial
  Chemically synthesized
aguuggguccuguggucc

SEQ ID NO: 23006 - RNA, 18 nt, artificial
  Chemically synthesized
ccuucuccaacaucauuu

SEQ ID NO: 23007 - RNA, 18 nt, artificial
  Chemically synthesized
cagguuguacucguccag

SEQ ID NO: 23008 - RNA, 18 nt, artificial
  Chemically synthesized
guugagggagcagucacc

SEQ ID NO: 23009 - RNA, 18 nt, artificial
  Chemically synthesized
cuucccuucuccaacauc

SEQ ID NO: 23010 - RNA, 18 nt, artificial
  Chemically synthesized
ucgucuguguugaccucg

SEQ ID NO: 23011 - RNA, 18 nt, artificial
  Chemically synthesized
acucauucugguugucgu

SEQ ID NO: 23012 - RNA, 18 nt, artificial
  Chemically synthesized
gcugcacgcaguucuggg

SEQ ID NO: 23013 - RNA, 18 nt, artificial
  Chemically synthesized
auacaucaucuacaguuc

SEQ ID NO: 23014 - RNA, 18 nt, artificial
  Chemically synthesized
acacacgcaguuguagcc

SEQ ID NO: 23015 - RNA, 18 nt, artificial
  Chemically synthesized
ugcuccgcacaguccagc

SEQ ID NO: 23016 - RNA, 18 nt, artificial
  Chemically synthesized
acucguccaccagguccu

SEQ ID NO: 23017 - RNA, 18 nt, artificial
  Chemically synthesized
acuuguacuccgucagcg

SEQ ID NO: 23018 - RNA, 18 nt, artificial
  Chemically synthesized
uuggucccacuccaccca

SEQ ID NO: 23019 - RNA, 18 nt, artificial
  Chemically synthesized
cuacauaauacugaaccu

SEQ ID NO: 23020 - RNA, 18 nt, artificial
  Chemically synthesized
acacaucucauguuugac

SEQ ID NO: 23021 - RNA, 18 nt, artificial
  Chemically synthesized
uacugaccuguccacucu

SEQ ID NO: 23022 - RNA, 18 nt, artificial
  Chemically synthesized
gaucucgcaguugggucc

SEQ ID NO: 23023 - RNA, 18 nt, artificial
  Chemically synthesized
guucucacaguggauccc

SEQ ID NO: 23024 - RNA, 18 nt, artificial
  Chemically synthesized
agcccugcagacacuggc

SEQ ID NO: 23025 - RNA, 18 nt, artificial
  Chemically synthesized
gagcuuuuuggacuaugc

SEQ ID NO: 23026 - RNA, 18 nt, artificial
  Chemically synthesized
ugccuacauuucaagaac

SEQ ID NO: 23027 - RNA, 18 nt, artificial
  Chemically synthesized
caucaauguucucgcugc

SEQ ID NO: 23028 - RNA, 18 nt, artificial
  Chemically synthesized
ugaugucgaccucacagg

SEQ ID NO: 23029 - RNA, 18 nt, artificial
  Chemically synthesized
acuccgcgcuguugcagc

SEQ ID NO: 23030 - RNA, 18 nt, artificial
  Chemically synthesized
uugacacaaggguuggau

SEQ ID NO: 23031 - RNA, 18 nt, artificial
  Chemically synthesized
uugcugcugggcuugcgg

SEQ ID NO: 23032 - RNA, 18 nt, artificial
  Chemically synthesized
cacacucguugauguugg

SEQ ID NO: 23033 - RNA, 18 nt, artificial
  Chemically synthesized
cucguugauguuggucug

SEQ ID NO: 23034 - RNA, 18 nt, artificial
  Chemically synthesized
gauguuacacaugcuccc

SEQ ID NO: 23035 - RNA, 18 nt, artificial
  Chemically synthesized
ugcaaauuaauccgcgug

SEQ ID NO: 23036 - RNA, 18 nt, artificial
  Chemically synthesized
ucgcacucaucgaugucc

SEQ ID NO: 23037 - RNA, 18 nt, artificial
  Chemically synthesized
cuugggaaaggaagccgg

SEQ ID NO: 23038 - RNA, 18 nt, artificial
  Chemically synthesized
aguuccucauguagauca

SEQ ID NO: 23039 - RNA, 18 nt, artificial
  Chemically synthesized
augccuccgugugugacc

SEQ ID NO: 23040 - RNA, 18 nt, artificial
  Chemically synthesized
agcacugcagagacugcg

SEQ ID NO: 23041 - RNA, 18 nt, artificial
  Chemically synthesized
agcacucguugauguugg

SEQ ID NO: 23042 - RNA, 18 nt, artificial
  Chemically synthesized
uggcuggagcacucguug

SEQ ID NO: 23043 - RNA, 18 nt, artificial
  Chemically synthesized
ucgugaugcaugcgcucc

SEQ ID NO: 23044 - RNA, 18 nt, artificial
  Chemically synthesized
uguguugcuggagcaucu

SEQ ID NO: 23045 - RNA, 18 nt, artificial
  Chemically synthesized
cgaacaacuacauaauac

SEQ ID NO: 23046 - RNA, 18 nt, artificial
  Chemically synthesized
agcgguacuggguguggg

SEQ ID NO: 23047 - RNA, 18 nt, artificial
  Chemically synthesized
cacucaggaagcuccggc

SEQ ID NO: 23048 - RNA, 18 nt, artificial
  Chemically synthesized
aggucuguggcucgguuc

SEQ ID NO: 23049 - RNA, 18 nt, artificial
  Chemically synthesized
uuguauugguucggcacc

SEQ ID NO: 23050 - RNA, 18 nt, artificial
  Chemically synthesized
agcccagcguguugaugc

SEQ ID NO: 23051 - RNA, 18 nt, artificial
  Chemically synthesized
cuguaaguuuuguggcug

SEQ ID NO: 23052 - RNA, 18 nt, artificial
  Chemically synthesized
agaacuugcuuguuuucu

SEQ ID NO: 23053 - RNA, 18 nt, artificial
  Chemically synthesized
augcagucggcgucaacc

SEQ ID NO: 23054 - RNA, 18 nt, artificial
  Chemically synthesized
aaaaggguaggaugccuc

SEQ ID NO: 23055 - RNA, 18 nt, artificial
  Chemically synthesized
cauucucacacguggcgc

SEQ ID NO: 23056 - RNA, 18 nt, artificial
  Chemically synthesized
gagccaagucugacgucc

SEQ ID NO: 23057 - RNA, 18 nt, artificial
  Chemically synthesized
cugcaggcauagucugcc

SEQ ID NO: 23058 - RNA, 18 nt, artificial
  Chemically synthesized
gaacucauugaucuuguc

SEQ ID NO: 23059 - RNA, 18 nt, artificial
  Chemically synthesized
guaggaaaacccuggcuc

SEQ ID NO: 23060 - RNA, 18 nt, artificial
  Chemically synthesized
ccugguagaugaagucgg

SEQ ID NO: 23061 - RNA, 18 nt, artificial
  Chemically synthesized
ugaccagcacggcacucg

SEQ ID NO: 23062 - RNA, 18 nt, artificial
  Chemically synthesized
uggcugcacgucugccug

SEQ ID NO: 23063 - RNA, 18 nt, artificial
  Chemically synthesized
auucacacucauuguugu

SEQ ID NO: 23064 - RNA, 18 nt, artificial
  Chemically synthesized
acgccucugcgguccacc

SEQ ID NO: 23065 - RNA, 18 nt, artificial
  Chemically synthesized
acguguagcuguccacgc

SEQ ID NO: 23066 - RNA, 18 nt, artificial
  Chemically synthesized
ucuccuacaaaacacggg

SEQ ID NO: 23067 - RNA, 18 nt, artificial
  Chemically synthesized
cacucuggaagcacugcg

SEQ ID NO: 23068 - RNA, 18 nt, artificial
  Chemically synthesized
gcuccacggucucacucu

SEQ ID NO: 23069 - RNA, 18 nt, artificial
  Chemically synthesized
cacucauugaccucagac

SEQ ID NO: 23070 - RNA, 18 nt, artificial
  Chemically synthesized
agcugagccaagucugac

SEQ ID NO: 23071 - RNA, 18 nt, artificial
  Chemically synthesized
uacugggugugggucugc

SEQ ID NO: 23072 - RNA, 18 nt, artificial
  Chemically synthesized
aggcuugggaaaggaagc

SEQ ID NO: 23073 - RNA, 18 nt, artificial
  Chemically synthesized
ucuacggcguugacgucg

SEQ ID NO: 23074 - RNA, 18 nt, artificial
  Chemically synthesized
uuccucacaguucuggcc

SEQ ID NO: 23075 - RNA, 18 nt, artificial
  Chemically synthesized
cuccuugcuuccacaggc

SEQ ID NO: 23076 - RNA, 18 nt, artificial
  Chemically synthesized
augaagugcagcugcgcc

SEQ ID NO: 23077 - RNA, 18 nt, artificial
  Chemically synthesized
acaguuggucccacucca

SEQ ID NO: 23078 - RNA, 18 nt, artificial
  Chemically synthesized
uuacuugaaggccuccgg

SEQ ID NO: 23079 - RNA, 18 nt, artificial
  Chemically synthesized
aggcguguuguucucaca

SEQ ID NO: 23080 - RNA, 18 nt, artificial
  Chemically synthesized
aggcacucgucgaucucc

SEQ ID NO: 23081 - RNA, 18 nt, artificial
  Chemically synthesized
aacagaagcacaaaggcg

SEQ ID NO: 23082 - RNA, 18 nt, artificial
  Chemically synthesized
gcucucagaacuugcuug

SEQ ID NO: 23083 - RNA, 18 nt, artificial
  Chemically synthesized
cucucugugcagucaggc

SEQ ID NO: 23084 - RNA, 18 nt, artificial
  Chemically synthesized
uguccacgcaguccgugc

SEQ ID NO: 23085 - RNA, 18 nt, artificial
  Chemically synthesized
auggagccgcggacgucc

SEQ ID NO: 23086 - RNA, 18 nt, artificial
  Chemically synthesized
uugcacucauugaccuca

SEQ ID NO: 23087 - RNA, 18 nt, artificial
  Chemically synthesized
ucaauguucucgcugcag

SEQ ID NO: 23088 - RNA, 18 nt, artificial
  Chemically synthesized
ugcacacguagccacugg

SEQ ID NO: 23089 - RNA, 18 nt, artificial
  Chemically synthesized
ucggucucgcaguugcgc

SEQ ID NO: 23090 - RNA, 18 nt, artificial
  Chemically synthesized
agccguugacacacacgc

SEQ ID NO: 23091 - RNA, 18 nt, artificial
  Chemically synthesized
aggcuuugcugcugcugg

SEQ ID NO: 23092 - RNA, 18 nt, artificial
  Chemically synthesized
guagcugccuguguagcc

SEQ ID NO: 23093 - RNA, 18 nt, artificial
  Chemically synthesized
guugauguuggucucgca

SEQ ID NO: 23094 - RNA, 18 nt, artificial
  Chemically synthesized
acuccagggaguccacgg

SEQ ID NO: 23095 - RNA, 18 nt, artificial
  Chemically synthesized
gagaagcucucauagucc

SEQ ID NO: 23096 - RNA, 18 nt, artificial
  Chemically synthesized
agaacuuguauaaccaac

SEQ ID NO: 23097 - RNA, 18 nt, artificial
  Chemically synthesized
cuucuccaacaucauuuc

SEQ ID NO: 23098 - RNA, 18 nt, artificial
  Chemically synthesized
uagcugccuguguagccc

SEQ ID NO: 23099 - RNA, 18 nt, artificial
  Chemically synthesized
aaaaaucaacaucuuggg

SEQ ID NO: 23100 - RNA, 18 nt, artificial
  Chemically synthesized
acacuuugaagcccucag

SEQ ID NO: 23101 - RNA, 18 nt, artificial
  Chemically synthesized
guacuggcacagaugccc

SEQ ID NO: 23102 - RNA, 18 nt, artificial
  Chemically synthesized
ugaguugcacuggcuguc

SEQ ID NO: 23103 - RNA, 18 nt, artificial
  Chemically synthesized
gucgugccaucaugcaug

SEQ ID NO: 23104 - RNA, 18 nt, artificial
  Chemically synthesized
cagaugcacuggaacucc

SEQ ID NO: 23105 - RNA, 18 nt, artificial
  Chemically synthesized
uugaggcugcccagguag

SEQ ID NO: 23106 - RNA, 18 nt, artificial
  Chemically synthesized
cugcaggcauagucugcc

SEQ ID NO: 23107 - RNA, 18 nt, artificial
  Chemically synthesized
uuguugcacugcaggcug

SEQ ID NO: 23108 - RNA, 18 nt, artificial
  Chemically synthesized
aagccauugaugccgucc

SEQ ID NO: 23109 - RNA, 18 nt, artificial
  Chemically synthesized
uuggcaccauucuugcag

SEQ ID NO: 23110 - RNA, 18 nt, artificial
  Chemically synthesized
accagguuguacucgucc

SEQ ID NO: 23111 - RNA, 18 nt, artificial
  Chemically synthesized
ugccuggcucggcucucc

SEQ ID NO: 23112 - RNA, 18 nt, artificial
  Chemically synthesized
accuguccacucuggcgg

SEQ ID NO: 23113 - RNA, 18 nt, artificial
  Chemically synthesized
ucguagccaucgaucuug

SEQ ID NO: 23114 - RNA, 18 nt, artificial
  Chemically synthesized
ucaucaauguucucgcug

SEQ ID NO: 23115 - RNA, 18 nt, artificial
  Chemically synthesized
uggcaggcaggcacacuc

SEQ ID NO: 23116 - RNA, 18 nt, artificial
  Chemically synthesized
uuggugugcagcacgcgg

SEQ ID NO: 23117 - RNA, 18 nt, artificial
  Chemically synthesized
ucuuccucgcuguugccc

SEQ ID NO: 23118 - RNA, 18 nt, artificial
  Chemically synthesized
guugugcaggcuggcgcc

SEQ ID NO: 23119 - RNA, 18 nt, artificial
  Chemically synthesized
ggcacuugcagaugaacc

SEQ ID NO: 23120 - RNA, 18 nt, artificial
  Chemically synthesized
uggccuuccgcacgcugg

SEQ ID NO: 23121 - RNA, 18 nt, artificial
  Chemically synthesized
ucuggaagcacugcgagg

SEQ ID NO: 23122 - RNA, 18 nt, artificial
  Chemically synthesized
caucuucuucggaaccug

SEQ ID NO: 23123 - RNA, 18 nt, artificial
  Chemically synthesized
uggcugucacaguggccg

SEQ ID NO: 23124 - RNA, 18 nt, artificial
  Chemically synthesized
agccucucggguacaugc

SEQ ID NO: 23125 - RNA, 18 nt, artificial
  Chemically synthesized
uggucaugucuuugcagg

SEQ ID NO: 23126 - RNA, 18 nt, artificial
  Chemically synthesized
auuugccgccguucuugc

SEQ ID NO: 23127 - RNA, 18 nt, artificial
  Chemically synthesized
auuguucacggcggcggc

SEQ ID NO: 23128 - RNA, 18 nt, artificial
  Chemically synthesized
cguccugggacuucuucc

SEQ ID NO: 23129 - RNA, 18 nt, artificial
  Chemically synthesized
acuuggcaccauucuugc

SEQ ID NO: 23130 - RNA, 18 nt, artificial
  Chemically synthesized
uagugugcaccgccaggc

SEQ ID NO: 23131 - RNA, 18 nt, artificial
  Chemically synthesized
ugugagucgcacucauug

SEQ ID NO: 23132 - RNA, 18 nt, artificial
  Chemically synthesized
gugguuguugcacugcag

SEQ ID NO: 23133 - RNA, 18 nt, artificial
  Chemically synthesized
guugaucucgcaguuggg

SEQ ID NO: 23134 - RNA, 18 nt, artificial
  Chemically synthesized
auaguccucggauugccu

SEQ ID NO: 23135 - RNA, 18 nt, artificial
  Chemically synthesized
ugcgguccaccacguggc

SEQ ID NO: 23136 - RNA, 18 nt, artificial
  Chemically synthesized
aaugugcccggcucuggc

SEQ ID NO: 23137 - RNA, 18 nt, artificial
  Chemically synthesized
uugauguccuccucacag

SEQ ID NO: 23138 - RNA, 18 nt, artificial
  Chemically synthesized
uugaucucacagugcaca

SEQ ID NO: 23139 - RNA, 18 nt, artificial
  Chemically synthesized
acuggucaugucuuugca

SEQ ID NO: 23140 - RNA, 18 nt, artificial
  Chemically synthesized
ucugaagcguucuucagg

SEQ ID NO: 23141 - RNA, 18 nt, artificial
  Chemically synthesized
cucggauugccugcacuc

SEQ ID NO: 23142 - RNA, 18 nt, artificial
  Chemically synthesized
uugcacagcucaaugugc

SEQ ID NO: 23143 - RNA, 18 nt, artificial
  Chemically synthesized
ucacuggcacacucguug

SEQ ID NO: 23144 - RNA, 18 nt, artificial
  Chemically synthesized
ugucuggucguccagguc

SEQ ID NO: 23145 - RNA, 18 nt, artificial
  Chemically synthesized
acaugcuccgcacagucc

SEQ ID NO: 23146 - RNA, 18 nt, artificial
  Chemically synthesized
aucagagcgugaguagcg

SEQ ID NO: 23147 - RNA, 18 nt, artificial
  Chemically synthesized
cguguuguucucacagug

SEQ ID NO: 23148 - RNA, 18 nt, artificial
  Chemically synthesized
uacagacauuuuuucugc

SEQ ID NO: 23149 - RNA, 18 nt, artificial
  Chemically synthesized
agacgcacucguugacgu

SEQ ID NO: 23150 - RNA, 18 nt, artificial
  Chemically synthesized
ucgauguugauguuacac

SEQ ID NO: 23151 - RNA, 18 nt, artificial
  Chemically synthesized
aguggaagucauugacgc

SEQ ID NO: 23152 - RNA, 18 nt, artificial
  Chemically synthesized
agguggcgucguucuggc

SEQ ID NO: 23153 - RNA, 18 nt, artificial
  Chemically synthesized
ugcaugggcggcuaaggc

SEQ ID NO: 23154 - RNA, 18 nt, artificial
  Chemically synthesized
aggcuguguugcuggagc

SEQ ID NO: 23155 - RNA, 18 nt, artificial
  Chemically synthesized
gacuaugcucguucaacu

SEQ ID NO: 23156 - RNA, 18 nt, artificial
  Chemically synthesized
ucauugaucuuguccagg

SEQ ID NO: 23157 - RNA, 18 nt, artificial
  Chemically synthesized
uguccuccucacagaaag

SEQ ID NO: 23158 - RNA, 18 nt, artificial
  Chemically synthesized
cguugauguuggucucgc

SEQ ID NO: 23159 - RNA, 18 nt, artificial
  Chemically synthesized
uguugaggcugcccagcg

SEQ ID NO: 23160 - RNA, 18 nt, artificial
  Chemically synthesized
cggauugccugcacuccc

SEQ ID NO: 23161 - RNA, 18 nt, artificial
  Chemically synthesized
ugcacgucugccuggcuc

SEQ ID NO: 23162 - RNA, 18 nt, artificial
  Chemically synthesized
auaaaaguuucuaccugg

SEQ ID NO: 23163 - RNA, 18 nt, artificial
  Chemically synthesized
cucacuggcaugacacac

SEQ ID NO: 23164 - RNA, 18 nt, artificial
  Chemically synthesized
uucuggccacacucguug

SEQ ID NO: 23165 - RNA, 18 nt, artificial
  Chemically synthesized
accagugcacaagguucu

SEQ ID NO: 23166 - RNA, 18 nt, artificial
  Chemically synthesized
guuguggcaggugccucc

SEQ ID NO: 23167 - RNA, 18 nt, artificial
  Chemically synthesized
gaucaguggcgucgugcc

SEQ ID NO: 23168 - RNA, 18 nt, artificial
  Chemically synthesized
agccgaccucguuguggc

SEQ ID NO: 23169 - RNA, 18 nt, artificial
  Chemically synthesized
augucgugaugcaugcgc

SEQ ID NO: 23170 - RNA, 18 nt, artificial
  Chemically synthesized
acucauugacaucgugcu

SEQ ID NO: 23171 - RNA, 18 nt, artificial
  Chemically synthesized
uggcacucguccacaucc

SEQ ID NO: 23172 - RNA, 18 nt, artificial
  Chemically synthesized
acauuuucacaagcaugc

SEQ ID NO: 23173 - RNA, 18 nt, artificial
  Chemically synthesized
uuguccagacaggugccc

SEQ ID NO: 23174 - RNA, 18 nt, artificial
  Chemically synthesized
ucccggcguucuugcagg

SEQ ID NO: 23175 - RNA, 18 nt, artificial
  Chemically synthesized
uugcaggaguagccgccc

SEQ ID NO: 23176 - RNA, 18 nt, artificial
  Chemically synthesized
uugcuguugcacucauug

SEQ ID NO: 23177 - RNA, 18 nt, artificial
  Chemically synthesized
acagaugcccagugaagc

SEQ ID NO: 23178 - RNA, 18 nt, artificial
  Chemically synthesized
guuguugcacugcaggcu

SEQ ID NO: 23179 - RNA, 18 nt, artificial
  Chemically synthesized
ugcagggcggacuugccc

SEQ ID NO: 23180 - RNA, 18 nt, artificial
  Chemically synthesized
uggugucgcaguuggagc

SEQ ID NO: 23181 - RNA, 18 nt, artificial
  Chemically synthesized
uacccguugaggcugucc

SEQ ID NO: 23182 - RNA, 18 nt, artificial
  Chemically synthesized
uugcagggcuugccuuug

SEQ ID NO: 23183 - RNA, 18 nt, artificial
  Chemically synthesized
uuguagguguucacgccg

SEQ ID NO: 23184 - RNA, 18 nt, artificial
  Chemically synthesized
accucacaggucugcccu

SEQ ID NO: 23185 - RNA, 18 nt, artificial
  Chemically synthesized
uugaugacggacucgcag

SEQ ID NO: 23186 - RNA, 18 nt, artificial
  Chemically synthesized
ucaucaucugggacaggg

SEQ ID NO: 23187 - RNA, 18 nt, artificial
  Chemically synthesized
aucuucuucggaaccugg

SEQ ID NO: 23188 - RNA, 18 nt, artificial
  Chemically synthesized
ucgucaauacacgugccc

SEQ ID NO: 23189 - RNA, 18 nt, artificial
  Chemically synthesized
uaggcguugucgcggucc

SEQ ID NO: 23190 - RNA, 18 nt, artificial
  Chemically synthesized
cguuguuaaagcacuugg

SEQ ID NO: 23191 - RNA, 18 nt, artificial
  Chemically synthesized
ucguugauguuggucucg

SEQ ID NO: 23192 - RNA, 18 nt, artificial
  Chemically synthesized
cgguugucaaucuccagg

SEQ ID NO: 23193 - RNA, 18 nt, artificial
  Chemically synthesized
acuggcugucacaguggc

SEQ ID NO: 23194 - RNA, 18 nt, artificial
  Chemically synthesized
gcgucaggaacugggcug

SEQ ID NO: 23195 - RNA, 18 nt, artificial
  Chemically synthesized
gucuccagguccucgucc

SEQ ID NO: 23196 - RNA, 18 nt, artificial
  Chemically synthesized
acauggcaacaucuaacc

SEQ ID NO: 23197 - RNA, 18 nt, artificial
  Chemically synthesized
gagcacucauccacgucc

SEQ ID NO: 23198 - RNA, 18 nt, artificial
  Chemically synthesized
augcucguucaacuuccc

SEQ ID NO: 23199 - RNA, 18 nt, artificial
  Chemically synthesized
gguccagcucccuccgcc

SEQ ID NO: 23200 - RNA, 18 nt, artificial
  Chemically synthesized
gucccacucgcacuccgc

SEQ ID NO: 23201 - RNA, 18 nt, artificial
  Chemically synthesized
guugcgcccacuguagcc

SEQ ID NO: 23202 - RNA, 18 nt, artificial
  Chemically synthesized
acucguugauguccuccu

SEQ ID NO: 23203 - RNA, 18 nt, artificial
  Chemically synthesized
ggcuccacggucucacuc

SEQ ID NO: 23204 - RNA, 18 nt, artificial
  Chemically synthesized
aggccugcacacacugcc

SEQ ID NO: 23205 - RNA, 18 nt, artificial
  Chemically synthesized
uugaucucgcaguugggu

SEQ ID NO: 23206 - RNA, 18 nt, artificial
  Chemically synthesized
cacuuggcaccauucuug

SEQ ID NO: 23207 - RNA, 18 nt, artificial
  Chemically synthesized
cugaaacaaagauucaug

SEQ ID NO: 23208 - RNA, 18 nt, artificial
  Chemically synthesized
ucaucuacggcguugacg

SEQ ID NO: 23209 - RNA, 18 nt, artificial
  Chemically synthesized
uccacucaggaagcuccg

SEQ ID NO: 23210 - RNA, 18 nt, artificial
  Chemically synthesized
ugccuccgugugugaccc

SEQ ID NO: 23211 - RNA, 18 nt, artificial
  Chemically synthesized
cugcugggcuugcggacc

SEQ ID NO: 23212 - RNA, 18 nt, artificial
  Chemically synthesized
acucauccacguccuggc

SEQ ID NO: 23213 - RNA, 18 nt, artificial
  Chemically synthesized
acucgugggugacgucgc

SEQ ID NO: 23214 - RNA, 18 nt, artificial
  Chemically synthesized
aucagcaccaccaccacc

SEQ ID NO: 23215 - RNA, 18 nt, artificial
  Chemically synthesized
ugccguccacgcaggugc

SEQ ID NO: 23216 - RNA, 18 nt, artificial
  Chemically synthesized
ggcugcagaccuuguugc

SEQ ID NO: 23217 - RNA, 18 nt, artificial
  Chemically synthesized
acaggcaacgguagaagg

SEQ ID NO: 23218 - RNA, 18 nt, artificial
  Chemically synthesized
ucgauauuuuccucacag

SEQ ID NO: 23219 - RNA, 18 nt, artificial
  Chemically synthesized
gguugaucucgcaguugg

SEQ ID NO: 23220 - RNA, 18 nt, artificial
  Chemically synthesized
gcggcuccacggucucac

SEQ ID NO: 23221 - RNA, 18 nt, artificial
  Chemically synthesized
gugcuggcacacucgucc

SEQ ID NO: 23222 - RNA, 18 nt, artificial
  Chemically synthesized
gcacagucaucaauguuc

SEQ ID NO: 23223 - RNA, 18 nt, artificial
  Chemically synthesized
ucggcucuccacucagga

SEQ ID NO: 23224 - RNA, 18 nt, artificial
  Chemically synthesized
cguucuugcaguuguuuc

SEQ ID NO: 23225 - RNA, 18 nt, artificial
  Chemically synthesized
uacucguccagcagccuc

SEQ ID NO: 23226 - RNA, 18 nt, artificial
  Chemically synthesized
aacuucccuucuccaaca

SEQ ID NO: 23227 - RNA, 18 nt, artificial
  Chemically synthesized
acucauuguuguugaugu

SEQ ID NO: 23228 - RNA, 18 nt, artificial
  Chemically synthesized
uaguccucggauugccug

SEQ ID NO: 23229 - RNA, 18 nt, artificial
  Chemically synthesized
acgccuccucgaucagcg

SEQ ID NO: 23230 - RNA, 18 nt, artificial
  Chemically synthesized
uccacggucucacucugc

SEQ ID NO: 23231 - RNA, 18 nt, artificial
  Chemically synthesized
agcaugcuugcaagaaac

SEQ ID NO: 23232 - RNA, 18 nt, artificial
  Chemically synthesized
cagcuucuccuaacaggc

SEQ ID NO: 23233 - RNA, 18 nt, artificial
  Chemically synthesized
aggcgguccauaugaucc

SEQ ID NO: 23234 - RNA, 18 nt, artificial
  Chemically synthesized
cacagugaaauucagggc

SEQ ID NO: 23235 - RNA, 18 nt, artificial
  Chemically synthesized
agcaucuucuucggaacc

SEQ ID NO: 23236 - RNA, 18 nt, artificial
  Chemically synthesized
agacgcagcgguaggagc

SEQ ID NO: 23237 - RNA, 18 nt, artificial
  Chemically synthesized
gcuggagcaucuucuucg

SEQ ID NO: 23238 - RNA, 18 nt, artificial
  Chemically synthesized
ucaaucuccagguagacg

SEQ ID NO: 23239 - RNA, 18 nt, artificial
  Chemically synthesized
uuugcagccauugaugac

SEQ ID NO: 23240 - RNA, 18 nt, artificial
  Chemically synthesized
uuguacccggcaacgucg

SEQ ID NO: 23241 - RNA, 18 nt, artificial
  Chemically synthesized
uguugcccgucuccaggc

SEQ ID NO: 23242 - RNA, 18 nt, artificial
  Chemically synthesized
aaggguaggaugccuccg

SEQ ID NO: 23243 - RNA, 18 nt, artificial
  Chemically synthesized
agucucaaaggccagccg

SEQ ID NO: 23244 - RNA, 18 nt, artificial
  Chemically synthesized
aguugcacuggcugucac

SEQ ID NO: 23245 - RNA, 18 nt, artificial
  Chemically synthesized
aucuccucagagcaguuc

SEQ ID NO: 23246 - RNA, 18 nt, artificial
  Chemically synthesized
ucuccagguccucguccc

SEQ ID NO: 23247 - RNA, 18 nt, artificial
  Chemically synthesized
uuugcuggcugcagguuc

SEQ ID NO: 23248 - RNA, 18 nt, artificial
  Chemically synthesized
acugcggcauccacauug

SEQ ID NO: 23249 - RNA, 18 nt, artificial
  Chemically synthesized
uacaguuccucauguaga

SEQ ID NO: 23250 - RNA, 18 nt, artificial
  Chemically synthesized
ggauguggcacaagagcc

SEQ ID NO: 23251 - RNA, 18 nt, artificial
  Chemically synthesized
uguuguucucacagugga

SEQ ID NO: 23252 - RNA, 18 nt, artificial
  Chemically synthesized
aguggaaggagcuguugc

SEQ ID NO: 23253 - RNA, 18 nt, artificial
  Chemically synthesized
caggugcaaggcggucuc

SEQ ID NO: 23254 - RNA, 18 nt, artificial
  Chemically synthesized
cucucugugcagucaggc

SEQ ID NO: 23255 - RNA, 18 nt, artificial
  Chemically synthesized
cugaaacaaagauucaug

SEQ ID NO: 23256 - RNA, 18 nt, artificial
  Chemically synthesized
cggcugaguugcacuggc

SEQ ID NO: 23257 - RNA, 18 nt, artificial
  Chemically synthesized
acccuuccgugcacacac

SEQ ID NO: 23258 - RNA, 18 nt, artificial
  Chemically synthesized
gacacuggcacucgaagg

SEQ ID NO: 23259 - RNA, 18 nt, artificial
  Chemically synthesized
ugagcaggucgcaggugc

SEQ ID NO: 23260 - RNA, 18 nt, artificial
  Chemically synthesized
cugcugggcuugcggacc

SEQ ID NO: 23261 - RNA, 18 nt, artificial
  Chemically synthesized
cacacacgcaguuguagc

SEQ ID NO: 23262 - RNA, 18 nt, artificial
  Chemically synthesized
cuggaagacaccuugugc

SEQ ID NO: 23263 - RNA, 18 nt, artificial
  Chemically synthesized
uuggugucgcaguuggag

SEQ ID NO: 23264 - RNA, 18 nt, artificial
  Chemically synthesized
ucgcagcgguacugggug

SEQ ID NO: 23265 - RNA, 18 nt, artificial
  Chemically synthesized
uucaugauugguaccaug

SEQ ID NO: 23266 - RNA, 18 nt, artificial
  Chemically synthesized
ucucggaugugggcucac

SEQ ID NO: 23267 - RNA, 18 nt, artificial
  Chemically synthesized
aacuugcuuguuuucuca

SEQ ID NO: 23268 - RNA, 18 nt, artificial
  Chemically synthesized
aagguucuggcaguuggg

SEQ ID NO: 23269 - RNA, 18 nt, artificial
  Chemically synthesized
aguucuggccggugaagc

SEQ ID NO: 23270 - RNA, 18 nt, artificial
  Chemically synthesized
acucgcagcgguacuggg

SEQ ID NO: 23271 - RNA, 18 nt, artificial
  Chemically synthesized
ggucauugaaguugaggg

SEQ ID NO: 23272 - RNA, 18 nt, artificial
  Chemically synthesized
gucauucucacacguggc

SEQ ID NO: 23273 - RNA, 18 nt, artificial
  Chemically synthesized
gaccauucaaacuggugg

SEQ ID NO: 23274 - RNA, 18 nt, artificial
  Chemically synthesized
ggugcaaggcggucucgc

SEQ ID NO: 23275 - RNA, 18 nt, artificial
  Chemically synthesized
aacaucuaacccauaugc

SEQ ID NO: 23276 - RNA, 18 nt, artificial
  Chemically synthesized
cacaguuggucccacucc

SEQ ID NO: 23277 - RNA, 18 nt, artificial
  Chemically synthesized
ucagcaccaccaccacca

SEQ ID NO: 23278 - RNA, 18 nt, artificial
  Chemically synthesized
cagcgagcacucauccac

SEQ ID NO: 23279 - RNA, 18 nt, artificial
  Chemically synthesized
cgagcugagccaagucug

SEQ ID NO: 23280 - RNA, 18 nt, artificial
  Chemically synthesized
caggcaggugguugaggg

SEQ ID NO: 23281 - RNA, 18 nt, artificial
  Chemically synthesized
gggcugggagcaucgcgg

SEQ ID NO: 23282 - RNA, 18 nt, artificial
  Chemically synthesized
gauucacacucauuguug

SEQ ID NO: 23283 - RNA, 18 nt, artificial
  Chemically synthesized
gugccaucaugcaugcgg

SEQ ID NO: 23284 - RNA, 18 nt, artificial
  Chemically synthesized
auuguuguugaugucaca

SEQ ID NO: 23285 - RNA, 18 nt, artificial
  Chemically synthesized
ugugcgucacgcuugaag

SEQ ID NO: 23286 - RNA, 18 nt, artificial
  Chemically synthesized
aucuugggacgcaucugg

SEQ ID NO: 23287 - RNA, 18 nt, artificial
  Chemically synthesized
uggcauacacacuccgag

SEQ ID NO: 23288 - RNA, 18 nt, artificial
  Chemically synthesized
guccuugcaguacugguc

SEQ ID NO: 23289 - RNA, 18 nt, artificial
  Chemically synthesized
uugcgcccacuguagccg

SEQ ID NO: 23290 - RNA, 18 nt, artificial
  Chemically synthesized
cacgucgcaguaaaggcc

SEQ ID NO: 23291 - RNA, 18 nt, artificial
  Chemically synthesized
acugaaguacuuccagca

SEQ ID NO: 23292 - RNA, 18 nt, artificial
  Chemically synthesized
cacucguccacaucguac

SEQ ID NO: 23293 - RNA, 18 nt, artificial
  Chemically synthesized
uuguacuccgucagcgug

SEQ ID NO: 23294 - RNA, 18 nt, artificial
  Chemically synthesized
guuguuaaagcacuuggg

SEQ ID NO: 23295 - RNA, 18 nt, artificial
  Chemically synthesized
aaaggacgcagcccacgg

SEQ ID NO: 23296 - RNA, 18 nt, artificial
  Chemically synthesized
caacgucgucaauacacg

SEQ ID NO: 23297 - RNA, 18 nt, artificial
  Chemically synthesized
acagguguaaguguuggg

SEQ ID NO: 23298 - RNA, 18 nt, artificial
  Chemically synthesized
acuugcuuguuuucucag

SEQ ID NO: 23299 - RNA, 18 nt, artificial
  Chemically synthesized
uuggcaaagugguccagc

SEQ ID NO: 23300 - RNA, 18 nt, artificial
  Chemically synthesized
gucacugaaguacuucca

SEQ ID NO: 23301 - RNA, 18 nt, artificial
  Chemically synthesized
agaagcucucauaguccu

SEQ ID NO: 23302 - RNA, 18 nt, artificial
  Chemically synthesized
acugcaggcugcagaccu

SEQ ID NO: 23303 - RNA, 18 nt, artificial
  Chemically synthesized
ggacauugacguccaugc

SEQ ID NO: 23304 - RNA, 18 nt, artificial
  Chemically synthesized
aagugguccagcagcacc

SEQ ID NO: 23305 - RNA, 18 nt, artificial
  Chemically synthesized
caaauuaauccgcgugcg

SEQ ID NO: 23306 - RNA, 18 nt, artificial
  Chemically synthesized
ucggauugccugcacucc

SEQ ID NO: 23307 - RNA, 18 nt, artificial
  Chemically synthesized
ggucugcccuugccagcc

SEQ ID NO: 23308 - RNA, 18 nt, artificial
  Chemically synthesized
augcgucguugagguggc

SEQ ID NO: 23309 - RNA, 18 nt, artificial
  Chemically synthesized
accggaacuucuuggucu

SEQ ID NO: 23310 - RNA, 18 nt, artificial
  Chemically synthesized
agucgucgaugucggucu

SEQ ID NO: 23311 - RNA, 18 nt, artificial
  Chemically synthesized
ugcggaccuucuugcccu

SEQ ID NO: 23312 - RNA, 18 nt, artificial
  Chemically synthesized
cacugaaguacuuccagc

SEQ ID NO: 23313 - RNA, 18 nt, artificial
  Chemically synthesized
cacucauucugguugucg

SEQ ID NO: 23314 - RNA, 18 nt, artificial
  Chemically synthesized
ugcauaucuuuguuagcc

SEQ ID NO: 23315 - RNA, 18 nt, artificial
  Chemically synthesized
acacguagccacugguca

SEQ ID NO: 23316 - RNA, 18 nt, artificial
  Chemically synthesized
auccaggucuguggcucg

SEQ ID NO: 23317 - RNA, 18 nt, artificial
  Chemically synthesized
gaucuggaagacaccuug

SEQ ID NO: 23318 - RNA, 18 nt, artificial
  Chemically synthesized
uuuguggcugcaccugcu

SEQ ID NO: 23319 - RNA, 18 nt, artificial
  Chemically synthesized
gcaguugcacuuguaccc

SEQ ID NO: 23320 - RNA, 18 nt, artificial
  Chemically synthesized
ucgcacucauugacaucg

SEQ ID NO: 23321 - RNA, 18 nt, artificial
  Chemically synthesized
auacacacuccgagaaca

SEQ ID NO: 23322 - RNA, 18 nt, artificial
  Chemically synthesized
uggucucgcagugguggc

SEQ ID NO: 23323 - RNA, 18 nt, artificial
  Chemically synthesized
acuuugaagcccucaggg

SEQ ID NO: 23324 - RNA, 18 nt, artificial
  Chemically synthesized
gggccagucucaaaggcc

SEQ ID NO: 23325 - RNA, 18 nt, artificial
  Chemically synthesized
uuccucauguagaucacu

SEQ ID NO: 23326 - RNA, 18 nt, artificial
  Chemically synthesized
cauccacauuguucacgg

SEQ ID NO: 23327 - RNA, 18 nt, artificial
  Chemically synthesized
uguuggucucgcaguggu

SEQ ID NO: 23328 - RNA, 18 nt, artificial
  Chemically synthesized
acucguagccaucgaucu

SEQ ID NO: 23329 - RNA, 18 nt, artificial
  Chemically synthesized
accucgcagugcacaccc

SEQ ID NO: 23330 - RNA, 18 nt, artificial
  Chemically synthesized
gcagcaaggcuacugugc

SEQ ID NO: 23331 - RNA, 18 nt, artificial
  Chemically synthesized
cacuggcugucacagugg

SEQ ID NO: 23332 - RNA, 18 nt, artificial
  Chemically synthesized
uugcccgcacacucaucg

SEQ ID NO: 23333 - RNA, 18 nt, artificial
  Chemically synthesized
cucuggcaagucuccuac

SEQ ID NO: 23334 - RNA, 18 nt, artificial
  Chemically synthesized
uugcaguacuggucguac

SEQ ID NO: 23335 - RNA, 18 nt, artificial
  Chemically synthesized
uuugcugcugggcuugcg

SEQ ID NO: 23336 - RNA, 18 nt, artificial
  Chemically synthesized
agugcacacccucguagc

SEQ ID NO: 23337 - RNA, 18 nt, artificial
  Chemically synthesized
uucaggugcccgaugccc

SEQ ID NO: 23338 - RNA, 18 nt, artificial
  Chemically synthesized
cacuuugaagcccucagg

SEQ ID NO: 23339 - RNA, 18 nt, artificial
  Chemically synthesized
guucuggcaggcauuugg

SEQ ID NO: 23340 - RNA, 18 nt, artificial
  Chemically synthesized
ucacuggcaugacacaca

SEQ ID NO: 23341 - RNA, 18 nt, artificial
  Chemically synthesized
auguugauguuacacaug

SEQ ID NO: 23342 - RNA, 18 nt, artificial
  Chemically synthesized
uagaaggaggccacacgg

SEQ ID NO: 23343 - RNA, 18 nt, artificial
  Chemically synthesized
caagguucuggcaguugg

SEQ ID NO: 23344 - RNA, 18 nt, artificial
  Chemically synthesized
acaucucauguuugacau

SEQ ID NO: 23345 - RNA, 18 nt, artificial
  Chemically synthesized
agcucucauaguccucgg

SEQ ID NO: 23346 - RNA, 18 nt, artificial
  Chemically synthesized
ugaagaccacguuggugu

SEQ ID NO: 23347 - RNA, 18 nt, artificial
  Chemically synthesized
augucgaccucacagguc

SEQ ID NO: 23348 - RNA, 18 nt, artificial
  Chemically synthesized
guugcacuuguacccggc

SEQ ID NO: 23349 - RNA, 18 nt, artificial
  Chemically synthesized
ccgcccacagugaaauuc

SEQ ID NO: 23350 - RNA, 18 nt, artificial
  Chemically synthesized
cugccagcauuugccgcc

SEQ ID NO: 23351 - RNA, 18 nt, artificial
  Chemically synthesized
uucuucaggagcacaacu

SEQ ID NO: 23352 - RNA, 18 nt, artificial
  Chemically synthesized
uuggacgcacacucguug

SEQ ID NO: 23353 - RNA, 18 nt, artificial
  Chemically synthesized
uacguaggaaaacccugg

SEQ ID NO: 23354 - RNA, 18 nt, artificial
  Chemically synthesized
ucgcugaagugguccuug

SEQ ID NO: 23355 - RNA, 18 nt, artificial
  Chemically synthesized
uuuacuugaaggccuccg

SEQ ID NO: 23356 - RNA, 18 nt, artificial
  Chemically synthesized
acagucgcacuuguaccc

SEQ ID NO: 23357 - RNA, 18 nt, artificial
  Chemically synthesized
caucaucuacaguuccuc

SEQ ID NO: 23358 - RNA, 18 nt, artificial
  Chemically synthesized
aucguacuggcacagaug

SEQ ID NO: 23359 - RNA, 18 nt, artificial
  Chemically synthesized
agauucaugauugguacc

SEQ ID NO: 23360 - RNA, 18 nt, artificial
  Chemically synthesized
aggucagcggcauccagg

SEQ ID NO: 23361 - RNA, 18 nt, artificial
  Chemically synthesized
augucccggcguucuugc

SEQ ID NO: 23362 - RNA, 18 nt, artificial
  Chemically synthesized
ucaugucuuugcaggugc

SEQ ID NO: 23363 - RNA, 18 nt, artificial
  Chemically synthesized
gcuguugcacucauugac

SEQ ID NO: 23364 - RNA, 18 nt, artificial
  Chemically synthesized
aggucugcccuugccagc

SEQ ID NO: 23365 - RNA, 18 nt, artificial
  Chemically synthesized
gugaggcaggcauugucc

SEQ ID NO: 23366 - RNA, 18 nt, artificial
  Chemically synthesized
uugaccauucaaacuggu

SEQ ID NO: 23367 - RNA, 18 nt, artificial
  Chemically synthesized
cacugugcaggcugaggu

SEQ ID NO: 23368 - RNA, 18 nt, artificial
  Chemically synthesized
cuccguggcggcaaagcc

SEQ ID NO: 23369 - RNA, 18 nt, artificial
  Chemically synthesized
uugaagaccacguuggug

SEQ ID NO: 23370 - RNA, 18 nt, artificial
  Chemically synthesized
ccacagugaaauucaggg

SEQ ID NO: 23371 - RNA, 18 nt, artificial
  Chemically synthesized
agaacacauuuucacaag

SEQ ID NO: 23372 - RNA, 18 nt, artificial
  Chemically synthesized
gaacugggcugcggucac

SEQ ID NO: 23373 - RNA, 18 nt, artificial
  Chemically synthesized
guucugggugccacgggc

SEQ ID NO: 23374 - RNA, 18 nt, artificial
  Chemically synthesized
cuucuugcccugcacgcc

SEQ ID NO: 23375 - RNA, 18 nt, artificial
  Chemically synthesized
aaggcuacugugcagcgg

SEQ ID NO: 23376 - RNA, 18 nt, artificial
  Chemically synthesized
ugacguccaugcagucgg

SEQ ID NO: 23377 - RNA, 18 nt, artificial
  Chemically synthesized
uccaggucaggcagaacc

SEQ ID NO: 23378 - RNA, 18 nt, artificial
  Chemically synthesized
acucauugaccucagaca

SEQ ID NO: 23379 - RNA, 18 nt, artificial
  Chemically synthesized
ugcacucuuggcauacac

SEQ ID NO: 23380 - RNA, 18 nt, artificial
  Chemically synthesized
ucucacagugcacacccu

SEQ ID NO: 23381 - RNA, 18 nt, artificial
  Chemically synthesized
uggucguccaggucaggc

SEQ ID NO: 23382 - RNA, 18 nt, artificial
  Chemically synthesized
acacuucccgccauucag

SEQ ID NO: 23383 - RNA, 18 nt, artificial
  Chemically synthesized
uaggcuauacuugguauu

SEQ ID NO: 23384 - RNA, 18 nt, artificial
  Chemically synthesized
acuggcacucgaaggagc

SEQ ID NO: 23385 - RNA, 18 nt, artificial
  Chemically synthesized
ccuucuccaacaucauuu

SEQ ID NO: 23386 - RNA, 18 nt, artificial
  Chemically synthesized
acgucugccuggcucggc

SEQ ID NO: 23387 - RNA, 18 nt, artificial
  Chemically synthesized
augcaugcgucguugagg

SEQ ID NO: 23388 - RNA, 18 nt, artificial
  Chemically synthesized
acucuuggcauacacacu

SEQ ID NO: 23389 - RNA, 18 nt, artificial
  Chemically synthesized
cucacgccaaggugcggc

SEQ ID NO: 23390 - RNA, 18 nt, artificial
  Chemically synthesized
augcucccuguguagccc

SEQ ID NO: 23391 - RNA, 18 nt, artificial
  Chemically synthesized
caggcguguuguucucac

SEQ ID NO: 23392 - RNA, 18 nt, artificial
  Chemically synthesized
ugcaggcuuugcugcugc

SEQ ID NO: 23393 - RNA, 18 nt, artificial
  Chemically synthesized
ucgcuguugcccgucucc

SEQ ID NO: 23394 - RNA, 18 nt, artificial
  Chemically synthesized
uuccggaucaggaucugg

SEQ ID NO: 23395 - RNA, 18 nt, artificial
  Chemically synthesized
aguacugaccuguccacu

SEQ ID NO: 23396 - RNA, 18 nt, artificial
  Chemically synthesized
uugaggcugcccagcgag

SEQ ID NO: 23397 - RNA, 18 nt, artificial
  Chemically synthesized
cauagucugccacgccuc

SEQ ID NO: 23398 - RNA, 18 nt, artificial
  Chemically synthesized
auguugaggcugcccagc

SEQ ID NO: 23399 - RNA, 18 nt, artificial
  Chemically synthesized
cacggucucacucugcac

SEQ ID NO: 23400 - RNA, 18 nt, artificial
  Chemically synthesized
uccguggcggcaaagccc

SEQ ID NO: 23401 - RNA, 18 nt, artificial
  Chemically synthesized
uucuugcccugcacgccg

SEQ ID NO: 23402 - RNA, 18 nt, artificial
  Chemically synthesized
gauguuggucucgcagug

SEQ ID NO: 23403 - RNA, 18 nt, artificial
  Chemically synthesized
agaagcagagguaggcgu

SEQ ID NO: 23404 - RNA, 18 nt, artificial
  Chemically synthesized
gucugaagcguucuucag

SEQ ID NO: 23405 - RNA, 18 nt, artificial
  Chemically synthesized
acaggucugcccuugcca

SEQ ID NO: 23406 - RNA, 18 nt, artificial
  Chemically synthesized
uggcucggcucuccacuc

SEQ ID NO: 23407 - RNA, 18 nt, artificial
  Chemically synthesized
cgucaggaacugggcugc

SEQ ID NO: 23408 - RNA, 18 nt, artificial
  Chemically synthesized
cguucaacuucccuucuc

SEQ ID NO: 23409 - RNA, 18 nt, artificial
  Chemically synthesized
gcaggugcagcuguagcc

SEQ ID NO: 23410 - RNA, 18 nt, artificial
  Chemically synthesized
ucgguggcacucuggaag

SEQ ID NO: 23411 - RNA, 18 nt, artificial
  Chemically synthesized
uugcacuggcugucacag

SEQ ID NO: 23412 - RNA, 18 nt, artificial
  Chemically synthesized
gcucucggaugugggcuc

SEQ ID NO: 23413 - RNA, 18 nt, artificial
  Chemically synthesized
ccgcggacauugacgucc

SEQ ID NO: 23414 - RNA, 18 nt, artificial
  Chemically synthesized
cucauuguuguugauguc

SEQ ID NO: 23415 - RNA, 18 nt, artificial
  Chemically synthesized
ucgcugccaccagggagc

SEQ ID NO: 23416 - RNA, 18 nt, artificial
  Chemically synthesized
acagcugcaggcauaguc

SEQ ID NO: 23417 - RNA, 18 nt, artificial
  Chemically synthesized
uccuugcuuccacaggcc

SEQ ID NO: 23418 - RNA, 18 nt, artificial
  Chemically synthesized
cuccaugcuggcacaggc

SEQ ID NO: 23419 - RNA, 18 nt, artificial
  Chemically synthesized
aggaggcgaucaugagcg

SEQ ID NO: 23420 - RNA, 18 nt, artificial
  Chemically synthesized
auauuuuccucacaguuc

SEQ ID NO: 23421 - RNA, 18 nt, artificial
  Chemically synthesized
aucaauguucucgcugca

SEQ ID NO: 23422 - RNA, 18 nt, artificial
  Chemically synthesized
uugaugucgaccucacag

SEQ ID NO: 23423 - RNA, 18 nt, artificial
  Chemically synthesized
aagucugacgucccucac

SEQ ID NO: 23424 - RNA, 18 nt, artificial
  Chemically synthesized
ccggaacuucuuggucuc

SEQ ID NO: 23425 - RNA, 18 nt, artificial
  Chemically synthesized
ucauucugguugucgucc

SEQ ID NO: 23426 - RNA, 18 nt, artificial
  Chemically synthesized
ugcacagcucaaugugcc

SEQ ID NO: 23427 - RNA, 18 nt, artificial
  Chemically synthesized
augauugguaccaugggu

SEQ ID NO: 23428 - RNA, 18 nt, artificial
  Chemically synthesized
uuguucugcauaucuuug

SEQ ID NO: 23429 - RNA, 18 nt, artificial
  Chemically synthesized
cguugacgucgaucucgc

SEQ ID NO: 23430 - RNA, 18 nt, artificial
  Chemically synthesized
acacucgcaguagaagga

SEQ ID NO: 23431 - RNA, 18 nt, artificial
  Chemically synthesized
ugcaaggcggucucgccc

SEQ ID NO: 23432 - RNA, 18 nt, artificial
  Chemically synthesized
gcuugaagaccacguugg

SEQ ID NO: 23433 - RNA, 18 nt, artificial
  Chemically synthesized
cacucguugauguccucc

SEQ ID NO: 23434 - RNA, 18 nt, artificial
  Chemically synthesized
uucuggcaggcauuuggc

SEQ ID NO: 23435 - RNA, 18 nt, artificial
  Chemically synthesized
uugcuuguuuucucagaa

SEQ ID NO: 23436 - RNA, 18 nt, artificial
  Chemically synthesized
acguugaucucacagugc

SEQ ID NO: 23437 - RNA, 18 nt, artificial
  Chemically synthesized
acccagcgagcacucauc

SEQ ID NO: 23438 - RNA, 18 nt, artificial
  Chemically synthesized
ucucggguacaugcuccg

SEQ ID NO: 23439 - RNA, 18 nt, artificial
  Chemically synthesized
uagcuguccacgcagucc

SEQ ID NO: 23440 - RNA, 18 nt, artificial
  Chemically synthesized
ccucagagcaguucaccc

SEQ ID NO: 23441 - RNA, 18 nt, artificial
  Chemically synthesized
cacucgcaguagaaggag

SEQ ID NO: 23442 - RNA, 18 nt, artificial
  Chemically synthesized
acgcaucuggucaugccc

SEQ ID NO: 23443 - RNA, 18 nt, artificial
  Chemically synthesized
gucucgcagugguggccc

SEQ ID NO: 23444 - RNA, 18 nt, artificial
  Chemically synthesized
acgcgugguuguugcacu

SEQ ID NO: 23445 - RNA, 18 nt, artificial
  Chemically synthesized
agucaggcguguuguucu

SEQ ID NO: 23446 - RNA, 18 nt, artificial
  Chemically synthesized
cacucguagccaucgauc

SEQ ID NO: 23447 - RNA, 18 nt, artificial
  Chemically synthesized
ugagucgcacucauugac

SEQ ID NO: 23448 - RNA, 18 nt, artificial
  Chemically synthesized
gggacaggaccaaaggac

SEQ ID NO: 23449 - RNA, 18 nt, artificial
  Chemically synthesized
aggugcacacguagccac

SEQ ID NO: 23450 - RNA, 18 nt, artificial
  Chemically synthesized
aagacaccuugugcgucg

SEQ ID NO: 23451 - RNA, 18 nt, artificial
  Chemically synthesized
gcacuuguacuccgucag

SEQ ID NO: 23452 - RNA, 18 nt, artificial
  Chemically synthesized
acugcagagacugcgugc

SEQ ID NO: 23453 - RNA, 18 nt, artificial
  Chemically synthesized
cgcuucacacuucccgcc

SEQ ID NO: 23454 - RNA, 18 nt, artificial
  Chemically synthesized
ugcgcaccagguuguacu

SEQ ID NO: 23455 - RNA, 18 nt, artificial
  Chemically synthesized
gucucguagcugcccucc

SEQ ID NO: 23456 - RNA, 18 nt, artificial
  Chemically synthesized
uggcggucucguagcugc

SEQ ID NO: 23457 - RNA, 18 nt, artificial
  Chemically synthesized
gaucugggacugcaugcu

SEQ ID NO: 23458 - RNA, 18 nt, artificial
  Chemically synthesized
cuugguauugcaaaaauc

SEQ ID NO: 23459 - RNA, 18 nt, artificial
  Chemically synthesized
cggcucuggcaagucucc

SEQ ID NO: 23460 - RNA, 18 nt, artificial
  Chemically synthesized
guccugggacuucuuccu

SEQ ID NO: 23461 - RNA, 18 nt, artificial
  Chemically synthesized
uggugugcagcacgcggc

SEQ ID NO: 23462 - RNA, 18 nt, artificial
  Chemically synthesized
acauaauacugaaccuga

SEQ ID NO: 23463 - RNA, 18 nt, artificial
  Chemically synthesized
augcagaugcacuggaac

SEQ ID NO: 23464 - RNA, 18 nt, artificial
  Chemically synthesized
ugccauaggcuauacuug

SEQ ID NO: 23465 - RNA, 18 nt, artificial
  Chemically synthesized
gcgucauucucacacgug

SEQ ID NO: 23466 - RNA, 18 nt, artificial
  Chemically synthesized
augcggccacgucggugg

SEQ ID NO: 23467 - RNA, 18 nt, artificial
  Chemically synthesized
gucccacuccacccaggg

SEQ ID NO: 23468 - RNA, 18 nt, artificial
  Chemically synthesized
cuuguuuucucagaauag

SEQ ID NO: 23469 - RNA, 18 nt, artificial
  Chemically synthesized
ucacaggcacacucguag

SEQ ID NO: 23470 - RNA, 18 nt, artificial
  Chemically synthesized
cacagucgcacuuguacc

SEQ ID NO: 23471 - RNA, 18 nt, artificial
  Chemically synthesized
uagcucaucaucugggac

SEQ ID NO: 23472 - RNA, 18 nt, artificial
  Chemically synthesized
ccugguagaugaagucgg

SEQ ID NO: 23473 - RNA, 18 nt, artificial
  Chemically synthesized
cuugcggaccuucuugcc

SEQ ID NO: 23474 - RNA, 18 nt, artificial
  Chemically synthesized
aggccaggccuuugcugc

SEQ ID NO: 23475 - RNA, 18 nt, artificial
  Chemically synthesized
agaaucuuuucauccuac

SEQ ID NO: 23476 - RNA, 18 nt, artificial
  Chemically synthesized
cauugaugacggacucgc

SEQ ID NO: 23477 - RNA, 18 nt, artificial
  Chemically synthesized
cauuguuguugaugucac

SEQ ID NO: 23478 - RNA, 18 nt, artificial
  Chemically synthesized
uaaguuuuguggcugcac

SEQ ID NO: 23479 - RNA, 18 nt, artificial
  Chemically synthesized
aagcaggagcucucugug

SEQ ID NO: 23480 - RNA, 18 nt, artificial
  Chemically synthesized
uccauaugauccgugaug

SEQ ID NO: 23481 - RNA, 18 nt, artificial
  Chemically synthesized
ucugacgucccucacugg

SEQ ID NO: 23482 - RNA, 18 nt, artificial
  Chemically synthesized
augggugcacucuuggca

SEQ ID NO: 23483 - RNA, 18 nt, artificial
  Chemically synthesized
uggaagucauugacgcgc

SEQ ID NO: 23484 - RNA, 18 nt, artificial
  Chemically synthesized
ugcugggucugcaccagg

SEQ ID NO: 23485 - RNA, 18 nt, artificial
  Chemically synthesized
gcacgucgcaguaaaggc

SEQ ID NO: 23486 - RNA, 18 nt, artificial
  Chemically synthesized
uggcgucgugccaucaug

SEQ ID NO: 23487 - RNA, 18 nt, artificial
  Chemically synthesized
cauaguccucggauugcc

SEQ ID NO: 23488 - RNA, 18 nt, artificial
  Chemically synthesized
gaacagaagcacaaaggc

SEQ ID NO: 23489 - RNA, 18 nt, artificial
  Chemically synthesized
cuggagggaccaagaacu

SEQ ID NO: 23490 - RNA, 18 nt, artificial
  Chemically synthesized
aucugggacugcaugcug

SEQ ID NO: 23491 - RNA, 18 nt, artificial
  Chemically synthesized
caugcucccuguguagcc

SEQ ID NO: 23492 - RNA, 18 nt, artificial
  Chemically synthesized
augucggucucgcaguug

SEQ ID NO: 23493 - RNA, 18 nt, artificial
  Chemically synthesized
gagcgcacacagacgccc

SEQ ID NO: 23494 - RNA, 18 nt, artificial
  Chemically synthesized
cuggcagcaaggcuacug

SEQ ID NO: 23495 - RNA, 18 nt, artificial
  Chemically synthesized
aaacacauggcaacaucu

SEQ ID NO: 23496 - RNA, 18 nt, artificial
  Chemically synthesized
ccgcuucuucuugcuggc

SEQ ID NO: 23497 - RNA, 18 nt, artificial
  Chemically synthesized
cugaagcguucuucaggg

SEQ ID NO: 23498 - RNA, 18 nt, artificial
  Chemically synthesized
ucucguagcugcccuccc

SEQ ID NO: 23499 - RNA, 18 nt, artificial
  Chemically synthesized
uugcagucguccacguug

SEQ ID NO: 23500 - RNA, 18 nt, artificial
  Chemically synthesized
aaggugcggcuguggugg

SEQ ID NO: 23501 - RNA, 18 nt, artificial
  Chemically synthesized
guguugaugcacuugccc

SEQ ID NO: 23502 - RNA, 18 nt, artificial
  Chemically synthesized
uugcgggacagcagcacc

SEQ ID NO: 23503 - RNA, 18 nt, artificial
  Chemically synthesized
gaagcacugcgaggaggc

SEQ ID NO: 23504 - RNA, 18 nt, artificial
  Chemically synthesized
ucaggaacugggcugcgg

SEQ ID NO: 23505 - RNA, 18 nt, artificial
  Chemically synthesized
cacucuuggcauacacac

SEQ ID NO: 23506 - RNA, 18 nt, artificial
  Chemically synthesized
cacuggccuuccgcacgc

SEQ ID NO: 23507 - RNA, 18 nt, artificial
  Chemically synthesized
caguuggucccacuccac

SEQ ID NO: 23508 - RNA, 18 nt, artificial
  Chemically synthesized
ucguugauguuggucugg

SEQ ID NO: 23509 - RNA, 18 nt, artificial
  Chemically synthesized
cacacuccgagaacacau

SEQ ID NO: 23510 - RNA, 18 nt, artificial
  Chemically synthesized
ucagcgugagcaggucgc

SEQ ID NO: 23511 - RNA, 18 nt, artificial
  Chemically synthesized
aagucggagaugacggcc

SEQ ID NO: 23512 - RNA, 18 nt, artificial
  Chemically synthesized
uugcacuggccuuccgca

SEQ ID NO: 23513 - RNA, 18 nt, artificial
  Chemically synthesized
cauccaggucuguggcuc

SEQ ID NO: 23514 - RNA, 18 nt, artificial
  Chemically synthesized
agcccaggacggugcugg

SEQ ID NO: 23515 - RNA, 18 nt, artificial
  Chemically synthesized
cguguugaugcacuugcc

SEQ ID NO: 23516 - RNA, 18 nt, artificial
  Chemically synthesized
ugaccuguccacucuggc

SEQ ID NO: 23517 - RNA, 18 nt, artificial
  Chemically synthesized
cugcuggcacacucgucu

SEQ ID NO: 23518 - RNA, 18 nt, artificial
  Chemically synthesized
auacacgugcccugguuc

SEQ ID NO: 23519 - RNA, 18 nt, artificial
  Chemically synthesized
cgucugccuggcucggcu

SEQ ID NO: 23520 - RNA, 18 nt, artificial
  Chemically synthesized
guucuggccggugaagcc

SEQ ID NO: 23521 - RNA, 18 nt, artificial
  Chemically synthesized
ugcaguccucaccagucc

SEQ ID NO: 23522 - RNA, 18 nt, artificial
  Chemically synthesized
ucgguacaguacugaccu

SEQ ID NO: 23523 - RNA, 18 nt, artificial
  Chemically synthesized
acggacggagacugcugg

SEQ ID NO: 23524 - RNA, 18 nt, artificial
  Chemically synthesized
cucauucugguugucguc

SEQ ID NO: 23525 - RNA, 18 nt, artificial
  Chemically synthesized
acgcacacucguugaugu

SEQ ID NO: 23526 - RNA, 18 nt, artificial
  Chemically synthesized
accuuggcggucucguag

SEQ ID NO: 23527 - RNA, 18 nt, artificial
  Chemically synthesized
guuguacucguccagcag

SEQ ID NO: 23528 - RNA, 18 nt, artificial
  Chemically synthesized
acucgaaggagcccagcg

SEQ ID NO: 23529 - RNA, 18 nt, artificial
  Chemically synthesized
agagcuggccaugcugcc

SEQ ID NO: 23530 - RNA, 18 nt, artificial
  Chemically synthesized
ugcccugaggagugcagg

SEQ ID NO: 23531 - RNA, 18 nt, artificial
  Chemically synthesized
ggucuguggcucgguucc

SEQ ID NO: 23532 - RNA, 18 nt, artificial
  Chemically synthesized
gacacaggagaagcucuc

SEQ ID NO: 23533 - RNA, 18 nt, artificial
  Chemically synthesized
gcugagccaagucugacg

SEQ ID NO: 23534 - RNA, 18 nt, artificial
  Chemically synthesized
cucacaggucugcccuug

SEQ ID NO: 23535 - RNA, 18 nt, artificial
  Chemically synthesized
aacccauaugcuuucacu

SEQ ID NO: 23536 - RNA, 18 nt, artificial
  Chemically synthesized
acgcggcugagcucccgc

SEQ ID NO: 23537 - RNA, 18 nt, artificial
  Chemically synthesized
uugugacacggguugggc

SEQ ID NO: 23538 - RNA, 18 nt, artificial
  Chemically synthesized
ugcacuggccuuccgcac

SEQ ID NO: 23539 - RNA, 18 nt, artificial
  Chemically synthesized
uccacaucguacuggcac

SEQ ID NO: 23540 - RNA, 18 nt, artificial
  Chemically synthesized
ccucagacacuuugaagc

SEQ ID NO: 23541 - RNA, 18 nt, artificial
  Chemically synthesized
uguugcacucauugaccu

SEQ ID NO: 23542 - RNA, 18 nt, artificial
  Chemically synthesized
aguggcugcacgucugcc

SEQ ID NO: 23543 - RNA, 18 nt, artificial
  Chemically synthesized
gggcgucaggaacugggc

SEQ ID NO: 23544 - RNA, 18 nt, artificial
  Chemically synthesized
ugugggcucacagguccc

SEQ ID NO: 23545 - RNA, 18 nt, artificial
  Chemically synthesized
aggcugcagaccuuguug

SEQ ID NO: 23546 - RNA, 18 nt, artificial
  Chemically synthesized
uugcagccauugaugacg

SEQ ID NO: 23547 - RNA, 18 nt, artificial
  Chemically synthesized
aaucaacaucuugggacg

SEQ ID NO: 23548 - RNA, 18 nt, artificial
  Chemically synthesized
agaaggccguguugaugc

SEQ ID NO: 23549 - RNA, 18 nt, artificial
  Chemically synthesized
cggccucgaucuuguagg

SEQ ID NO: 23550 - RNA, 18 nt, artificial
  Chemically synthesized
guucuggcagggcgaggg

SEQ ID NO: 23551 - RNA, 18 nt, artificial
  Chemically synthesized
ucuguggcucgguuccgg

SEQ ID NO: 23552 - RNA, 18 nt, artificial
  Chemically synthesized
gguugugcaggcuggcgc

SEQ ID NO: 23553 - RNA, 18 nt, artificial
  Chemically synthesized
uugagggagcagucaccg

SEQ ID NO: 23554 - RNA, 18 nt, artificial
  Chemically synthesized
uugcuuccacaggccagg

SEQ ID NO: 23555 - RNA, 18 nt, artificial
  Chemically synthesized
ccuguaggagccgcagcc

SEQ ID NO: 23556 - RNA, 18 nt, artificial
  Chemically synthesized
aagaacagaagcacaaag

SEQ ID NO: 23557 - RNA, 18 nt, artificial
  Chemically synthesized
accaggugaggcugggug

SEQ ID NO: 23558 - RNA, 18 nt, artificial
  Chemically synthesized
ucauucucacacguggcg

SEQ ID NO: 23559 - RNA, 18 nt, artificial
  Chemically synthesized
uagccgcccaccuggucc

SEQ ID NO: 23560 - RNA, 18 nt, artificial
  Chemically synthesized
ucagcggcauccaggugc

SEQ ID NO: 23561 - RNA, 18 nt, artificial
  Chemically synthesized
gggcuucuggccacacuc

SEQ ID NO: 23562 - RNA, 18 nt, artificial
  Chemically synthesized
acagacucauucauuaag

SEQ ID NO: 23563 - RNA, 18 nt, artificial
  Chemically synthesized
uuccgugcacacacaggu

SEQ ID NO: 23564 - RNA, 18 nt, artificial
  Chemically synthesized
gcacuuguagguguuggg

SEQ ID NO: 23565 - RNA, 18 nt, artificial
  Chemically synthesized
cguccacaucguacuggc

SEQ ID NO: 23566 - RNA, 18 nt, artificial
  Chemically synthesized
ugcugaguccacugccgg

SEQ ID NO: 23567 - RNA, 18 nt, artificial
  Chemically synthesized
guccucacaguagcugcc

SEQ ID NO: 23568 - RNA, 18 nt, artificial
  Chemically synthesized
ucaggcguguuguucuca

SEQ ID NO: 23569 - RNA, 18 nt, artificial
  Chemically synthesized
gguugucaaucuccaggu

SEQ ID NO: 23570 - RNA, 18 nt, artificial
  Chemically synthesized
agaugcccagugaagccc

SEQ ID NO: 23571 - RNA, 18 nt, artificial
  Chemically synthesized
gcgugagcaggucgcagg

SEQ ID NO: 23572 - RNA, 18 nt, artificial
  Chemically synthesized
ucaauacacgugcccugg

SEQ ID NO: 23573 - RNA, 18 nt, artificial
  Chemically synthesized
aguccgugcaguuggccc

SEQ ID NO: 23574 - RNA, 18 nt, artificial
  Chemically synthesized
ucacaccagugcacaagg

SEQ ID NO: 23575 - RNA, 18 nt, artificial
  Chemically synthesized
aguccucaccaguccagc

SEQ ID NO: 23576 - RNA, 18 nt, artificial
  Chemically synthesized
cucuggcaagucuccuac

SEQ ID NO: 23577 - RNA, 18 nt, artificial
  Chemically synthesized
uccgcacaguccagcccg

SEQ ID NO: 23578 - RNA, 18 nt, artificial
  Chemically synthesized
caaggguuggauucacac

SEQ ID NO: 23579 - RNA, 18 nt, artificial
  Chemically synthesized
cugggacuucuuccuccg

SEQ ID NO: 23580 - RNA, 18 nt, artificial
  Chemically synthesized
ucgaucuuguccagacag

SEQ ID NO: 23581 - RNA, 18 nt, artificial
  Chemically synthesized
uucuugcaguuguuuccu

SEQ ID NO: 23582 - RNA, 18 nt, artificial
  Chemically synthesized
accugcugggucugcacc

SEQ ID NO: 23583 - RNA, 18 nt, artificial
  Chemically synthesized
uguccaccucgcagugcg

SEQ ID NO: 23584 - RNA, 18 nt, artificial
  Chemically synthesized
cugcuggcacacucgucu

SEQ ID NO: 23585 - RNA, 18 nt, artificial
  Chemically synthesized
uguuacacaugcucccug

SEQ ID NO: 23586 - RNA, 18 nt, artificial
  Chemically synthesized
ugggcuugcggaccuucu

SEQ ID NO: 23587 - RNA, 18 nt, artificial
  Chemically synthesized
cacgucugacagguagcc

SEQ ID NO: 23588 - RNA, 18 nt, artificial
  Chemically synthesized
cgagcuggaccacugguc

SEQ ID NO: 23589 - RNA, 18 nt, artificial
  Chemically synthesized
uucuccaacaucauuucu

SEQ ID NO: 23590 - RNA, 18 nt, artificial
  Chemically synthesized
uucagacauggguuggac

SEQ ID NO: 23591 - RNA, 18 nt, artificial
  Chemically synthesized
auaggcuauacuugguau

SEQ ID NO: 23592 - RNA, 18 nt, artificial
  Chemically synthesized
acuucccgccauucaggc

SEQ ID NO: 23593 - RNA, 18 nt, artificial
  Chemically synthesized
aggcaggcacacucgugg

SEQ ID NO: 23594 - RNA, 18 nt, artificial
  Chemically synthesized
accuucuugcccugcacg

SEQ ID NO: 23595 - RNA, 18 nt, artificial
  Chemically synthesized
aaagcccgggcuucuggc

SEQ ID NO: 23596 - RNA, 18 nt, artificial
  Chemically synthesized
cacuggaacucauugauc

SEQ ID NO: 23597 - RNA, 18 nt, artificial
  Chemically synthesized
uacgagcgucauucucac

SEQ ID NO: 23598 - RNA, 18 nt, artificial
  Chemically synthesized
cauacacacuccgagaac

SEQ ID NO: 23599 - RNA, 18 nt, artificial
  Chemically synthesized
cuuguacccggcaacguc

SEQ ID NO: 23600 - RNA, 18 nt, artificial
  Chemically synthesized
acaccuugucgcugcgca

SEQ ID NO: 23601 - RNA, 18 nt, artificial
  Chemically synthesized
cacucguugacauccugc

SEQ ID NO: 23602 - RNA, 18 nt, artificial
  Chemically synthesized
acgucgucaauacacgug

SEQ ID NO: 23603 - RNA, 18 nt, artificial
  Chemically synthesized
agugcacacccugagugc

SEQ ID NO: 23604 - RNA, 18 nt, artificial
  Chemically synthesized
aagcuguaguccaggaug

SEQ ID NO: 23605 - RNA, 18 nt, artificial
  Chemically synthesized
agguuguacucguccagc

SEQ ID NO: 23606 - RNA, 18 nt, artificial
  Chemically synthesized
agugcagggcggacuugc

SEQ ID NO: 23607 - RNA, 18 nt, artificial
  Chemically synthesized
ugcacacccucguagccg

SEQ ID NO: 23608 - RNA, 18 nt, artificial
  Chemically synthesized
cucgcugcaguccucacc

SEQ ID NO: 23609 - RNA, 18 nt, artificial
  Chemically synthesized
agguguaaguguuggguc

SEQ ID NO: 23610 - RNA, 18 nt, artificial
  Chemically synthesized
gcuugcggaccuucuugc

SEQ ID NO: 23611 - RNA, 18 nt, artificial
  Chemically synthesized
uagcccugcagacacugg

SEQ ID NO: 23612 - RNA, 18 nt, artificial
  Chemically synthesized
aguugaugccguccacgc

SEQ ID NO: 23613 - RNA, 18 nt, artificial
  Chemically synthesized
guccguccaggcacuugg

SEQ ID NO: 23614 - RNA, 18 nt, artificial
  Chemically synthesized
uguuggucuggcaguugg

SEQ ID NO: 23615 - RNA, 18 nt, artificial
  Chemically synthesized
cuccgcgcuguugcagcc

SEQ ID NO: 23616 - RNA, 18 nt, artificial
  Chemically synthesized
aguuggguccuguggucc

SEQ ID NO: 23617 - RNA, 18 nt, artificial
  Chemically synthesized
guacaugaagugcagcug

SEQ ID NO: 23618 - RNA, 18 nt, artificial
  Chemically synthesized
ucaucugggacagggcgc

SEQ ID NO: 23619 - RNA, 18 nt, artificial
  Chemically synthesized
aacuugcuuguuuucuca

SEQ ID NO: 23620 - RNA, 18 nt, artificial
  Chemically synthesized
guugaagcaggagcucuc

SEQ ID NO: 23621 - RNA, 18 nt, artificial
  Chemically synthesized
cacucaucgauguccacc

SEQ ID NO: 23622 - RNA, 18 nt, artificial
  Chemically synthesized
aggcaagugccacagucc

SEQ ID NO: 23623 - RNA, 18 nt, artificial
  Chemically synthesized
aguggugcguguugcccg

SEQ ID NO: 23624 - RNA, 18 nt, artificial
  Chemically synthesized
cauucuugcagggcuugc

SEQ ID NO: 23625 - RNA, 18 nt, artificial
  Chemically synthesized
aauuaauccgcgugcgga

SEQ ID NO: 23626 - RNA, 18 nt, artificial
  Chemically synthesized
guguuguucucacagugg

SEQ ID NO: 23627 - RNA, 18 nt, artificial
  Chemically synthesized
cuguugcccgucuccagg

SEQ ID NO: 23628 - RNA, 18 nt, artificial
  Chemically synthesized
gaccuucuugcccugcac

SEQ ID NO: 23629 - RNA, 18 nt, artificial
  Chemically synthesized
ucucaaaggccagccggc

SEQ ID NO: 23630 - RNA, 18 nt, artificial
  Chemically synthesized
acucauucugguugucgu

SEQ ID NO: 23631 - RNA, 18 nt, artificial
  Chemically synthesized
uugcccgcaugcucgcag

SEQ ID NO: 23632 - RNA, 18 nt, artificial
  Chemically synthesized
acacacgcaguuguagcc

SEQ ID NO: 23633 - RNA, 18 nt, artificial
  Chemically synthesized
agcacgcggcugagcucc

SEQ ID NO: 23634 - RNA, 18 nt, artificial
  Chemically synthesized
uguuggguccguccaggc

SEQ ID NO: 23635 - RNA, 18 nt, artificial
  Chemically synthesized
cugcuggauguuugcugg

SEQ ID NO: 23636 - RNA, 18 nt, artificial
  Chemically synthesized
caccagugcacaagguuc

SEQ ID NO: 23637 - RNA, 18 nt, artificial
  Chemically synthesized
ucguccacaucguacugg

SEQ ID NO: 23638 - RNA, 18 nt, artificial
  Chemically synthesized
cggucugucugguugugc

SEQ ID NO: 23639 - RNA, 18 nt, artificial
  Chemically synthesized
ccgguugucaaucuccag

SEQ ID NO: 23640 - RNA, 18 nt, artificial
  Chemically synthesized
agacaugcgcaggucagc

SEQ ID NO: 23641 - RNA, 18 nt, artificial
  Chemically synthesized
gacgcacacucguugaug

SEQ ID NO: 23642 - RNA, 18 nt, artificial
  Chemically synthesized
guuccucauguagaucac

SEQ ID NO: 23643 - RNA, 18 nt, artificial
  Chemically synthesized
acucguccaccagguccu

SEQ ID NO: 23644 - RNA, 18 nt, artificial
  Chemically synthesized
gagggagcagucaccgcc

SEQ ID NO: 23645 - RNA, 18 nt, artificial
  Chemically synthesized
ccgccacguucaggugcc

SEQ ID NO: 23646 - RNA, 18 nt, artificial
  Chemically synthesized
cuguugcgcagcugcucc

SEQ ID NO: 23647 - RNA, 18 nt, artificial
  Chemically synthesized
cucacagcgcucacccac

SEQ ID NO: 23648 - RNA, 18 nt, artificial
  Chemically synthesized
cgucugaagcguucuuca

SEQ ID NO: 23649 - RNA, 18 nt, artificial
  Chemically synthesized
ugccgucugugcaggagc

SEQ ID NO: 23650 - RNA, 18 nt, artificial
  Chemically synthesized
ucaacaccuugucgcugc

SEQ ID NO: 23651 - RNA, 18 nt, artificial
  Chemically synthesized
acacaucucauguuugac

SEQ ID NO: 23652 - RNA, 18 nt, artificial
  Chemically synthesized
agagguaggcguugucgc

SEQ ID NO: 23653 - RNA, 18 nt, artificial
  Chemically synthesized
cugggacuucuuccuccg

SEQ ID NO: 23654 - RNA, 18 nt, artificial
  Chemically synthesized
uccucacagaaagugccc

SEQ ID NO: 23655 - RNA, 18 nt, artificial
  Chemically synthesized
ucugccagcauuugccgc

SEQ ID NO: 23656 - RNA, 18 nt, artificial
  Chemically synthesized
gcuuuuuggacuaugcuc

SEQ ID NO: 23657 - RNA, 18 nt, artificial
  Chemically synthesized
ugggccagucucaaaggc

SEQ ID NO: 23658 - RNA, 18 nt, artificial
  Chemically synthesized
ugaagugguccuugcagu

SEQ ID NO: 23659 - RNA, 18 nt, artificial
  Chemically synthesized
ucgaccucacaggucugc

SEQ ID NO: 23660 - RNA, 18 nt, artificial
  Chemically synthesized
agaccacguuggugugca

SEQ ID NO: 23661 - RNA, 18 nt, artificial
  Chemically synthesized
ccggcugaguugcacugg

SEQ ID NO: 23662 - RNA, 18 nt, artificial
  Chemically synthesized
cacucguugaugucgacc

SEQ ID NO: 23663 - RNA, 18 nt, artificial
  Chemically synthesized
uggcugcugagcucacgc

SEQ ID NO: 23664 - RNA, 18 nt, artificial
  Chemically synthesized
uccuugcaguacuggucg

SEQ ID NO: 23665 - RNA, 18 nt, artificial
  Chemically synthesized
uugugcaggcuggcgccc

SEQ ID NO: 23666 - RNA, 18 nt, artificial
  Chemically synthesized
cacacguagccacugguc

SEQ ID NO: 23667 - RNA, 18 nt, artificial
  Chemically synthesized
acaggcacacucguagcc

SEQ ID NO: 23668 - RNA, 18 nt, artificial
  Chemically synthesized
gccgcuucuucuugcugg

SEQ ID NO: 23669 - RNA, 18 nt, artificial
  Chemically synthesized
cagccaggaucaguggcg

SEQ ID NO: 23670 - RNA, 18 nt, artificial
  Chemically synthesized
aguuccucauguagauca

SEQ ID NO: 23671 - RNA, 18 nt, artificial
  Chemically synthesized
uccacugccgguggucug

SEQ ID NO: 23672 - RNA, 18 nt, artificial
  Chemically synthesized
cauuguucacggcggcgg

SEQ ID NO: 23673 - RNA, 18 nt, artificial
  Chemically synthesized
auugguucggcaccaugc

SEQ ID NO: 23674 - RNA, 18 nt, artificial
  Chemically synthesized
augccuccgugugugacc

SEQ ID NO: 23675 - RNA, 18 nt, artificial
  Chemically synthesized
agcacugcagagacugcg

SEQ ID NO: 23676 - RNA, 18 nt, artificial
  Chemically synthesized
ccacuggucaugucuuug

SEQ ID NO: 23677 - RNA, 18 nt, artificial
  Chemically synthesized
uggccuugccauugacag

SEQ ID NO: 23678 - RNA, 18 nt, artificial
  Chemically synthesized
gugcagggcggacuugcc

SEQ ID NO: 23679 - RNA, 18 nt, artificial
  Chemically synthesized
gcaccaccaccaccagcg

SEQ ID NO: 23680 - RNA, 18 nt, artificial
  Chemically synthesized
uugacacacacgcaguug

SEQ ID NO: 23681 - RNA, 18 nt, artificial
  Chemically synthesized
ucuggucguccaggucag

SEQ ID NO: 23682 - RNA, 18 nt, artificial
  Chemically synthesized
acagucaucaauguucuc

SEQ ID NO: 23683 - RNA, 18 nt, artificial
  Chemically synthesized
cacguugaucucacagug

SEQ ID NO: 23684 - RNA, 18 nt, artificial
  Chemically synthesized
cucguuguggcaggugcc

SEQ ID NO: 23685 - RNA, 18 nt, artificial
  Chemically synthesized
agcgguacuggguguggg

SEQ ID NO: 23686 - RNA, 18 nt, artificial
  Chemically synthesized
aggucuguggcucgguuc

SEQ ID NO: 23687 - RNA, 18 nt, artificial
  Chemically synthesized
gaucucacagugcacacc

SEQ ID NO: 23688 - RNA, 18 nt, artificial
  Chemically synthesized
agcccagcguguugaugc

SEQ ID NO: 23689 - RNA, 18 nt, artificial
  Chemically synthesized
cgguuggcaaaguggucc

SEQ ID NO: 23690 - RNA, 18 nt, artificial
  Chemically synthesized
uuugacaugcaugaugcc

SEQ ID NO: 23691 - RNA, 18 nt, artificial
  Chemically synthesized
uugggaccgcugaagccc

SEQ ID NO: 23692 - RNA, 18 nt, artificial
  Chemically synthesized
uggagcccaggacggugc

SEQ ID NO: 23693 - RNA, 18 nt, artificial
  Chemically synthesized
agccauugaugacggacu

SEQ ID NO: 23694 - RNA, 18 nt, artificial
  Chemically synthesized
gcaugacacacaacagac

SEQ ID NO: 23695 - RNA, 18 nt, artificial
  Chemically synthesized
acucuggaagcacugcga

SEQ ID NO: 23696 - RNA, 18 nt, artificial
  Chemically synthesized
caucgaucuuguccagac

SEQ ID NO: 23697 - RNA, 18 nt, artificial
  Chemically synthesized
ugcuggccgggaacuggc

SEQ ID NO: 23698 - RNA, 18 nt, artificial
  Chemically synthesized
cauucaggcaggucucac

SEQ ID NO: 23699 - RNA, 18 nt, artificial
  Chemically synthesized
guugcugaugcaugcguc

SEQ ID NO: 23700 - RNA, 18 nt, artificial
  Chemically synthesized
uggcucucagaacuugcu

SEQ ID NO: 23701 - RNA, 18 nt, artificial
  Chemically synthesized
acagacauuuuuucugcc

SEQ ID NO: 23702 - RNA, 18 nt, artificial
  Chemically synthesized
uucuggccacacucguug

SEQ ID NO: 23703 - RNA, 18 nt, artificial
  Chemically synthesized
ugcaggcugcagaccuug

SEQ ID NO: 23704 - RNA, 18 nt, artificial
  Chemically synthesized
cuggcacucgaaggagcc

SEQ ID NO: 23705 - RNA, 18 nt, artificial
  Chemically synthesized
uugaugccgucugugcag

SEQ ID NO: 23706 - RNA, 18 nt, artificial
  Chemically synthesized
ugacggacucgcagcggc

SEQ ID NO: 23707 - RNA, 18 nt, artificial
  Chemically synthesized
cugcgugcaguucuucca

SEQ ID NO: 23708 - RNA, 18 nt, artificial
  Chemically synthesized
uuugccucuggaugcagc

SEQ ID NO: 23709 - RNA, 18 nt, artificial
  Chemically synthesized
uugacgucggcgugugag

SEQ ID NO: 23710 - RNA, 18 nt, artificial
  Chemically synthesized
cacaucucauguuugaca

SEQ ID NO: 23711 - RNA, 18 nt, artificial
  Chemically synthesized
cacucauugacaucgugc

SEQ ID NO: 23712 - RNA, 18 nt, artificial
  Chemically synthesized
cuguugcccgucuccagg

SEQ ID NO: 23713 - RNA, 18 nt, artificial
  Chemically synthesized
ggcguguuguucucacag

SEQ ID NO: 23714 - RNA, 18 nt, artificial
  Chemically synthesized
cuugcagaugaacccgcg

SEQ ID NO: 23715 - RNA, 18 nt, artificial
  Chemically synthesized
agcacaacugcggcaucc

SEQ ID NO: 23716 - RNA, 18 nt, artificial
  Chemically synthesized
caccucgcagugcguccc

SEQ ID NO: 23717 - RNA, 18 nt, artificial
  Chemically synthesized
guucuugcagggcgagga

SEQ ID NO: 23718 - RNA, 18 nt, artificial
  Chemically synthesized
ucauugaaguugagggag

SEQ ID NO: 23719 - RNA, 18 nt, artificial
  Chemically synthesized
agcccuggucgcagugcc

SEQ ID NO: 23720 - RNA, 18 nt, artificial
  Chemically synthesized
cugcuggauguuugcugg

SEQ ID NO: 23721 - RNA, 18 nt, artificial
  Chemically synthesized
auucacacucauuguugu

SEQ ID NO: 23722 - RNA, 18 nt, artificial
  Chemically synthesized
acgccucugcgguccacc

SEQ ID NO: 23723 - RNA, 18 nt, artificial
  Chemically synthesized
uagucugccacgccucug

SEQ ID NO: 23724 - RNA, 18 nt, artificial
  Chemically synthesized
acguguagcuguccacgc

SEQ ID NO: 23725 - RNA, 18 nt, artificial
  Chemically synthesized
ucuccaacaucauuucuu

SEQ ID NO: 23726 - RNA, 18 nt, artificial
  Chemically synthesized
cagaugcccagugaagcc

SEQ ID NO: 23727 - RNA, 18 nt, artificial
  Chemically synthesized
gucuguggcucgguuccg

SEQ ID NO: 23728 - RNA, 18 nt, artificial
  Chemically synthesized
uguugaugcacuugcccg

SEQ ID NO: 23729 - RNA, 18 nt, artificial
  Chemically synthesized
agagcgcacacagacgcc

SEQ ID NO: 23730 - RNA, 18 nt, artificial
  Chemically synthesized
acuccgagaacacauuuu

SEQ ID NO: 23731 - RNA, 18 nt, artificial
  Chemically synthesized
gugaagccauugaugccg

SEQ ID NO: 23732 - RNA, 18 nt, artificial
  Chemically synthesized
uugcacugcaggcugcag

SEQ ID NO: 23733 - RNA, 18 nt, artificial
  Chemically synthesized
uuggagcccucguuacag

SEQ ID NO: 23734 - RNA, 18 nt, artificial
  Chemically synthesized
agcugagccaagucugac

SEQ ID NO: 23735 - RNA, 18 nt, artificial
  Chemically synthesized
caacgucaacaccuuguc

SEQ ID NO: 23736 - RNA, 18 nt, artificial
  Chemically synthesized
cacucguccaccaggucc

SEQ ID NO: 23737 - RNA, 18 nt, artificial
  Chemically synthesized
aucagcuggcacucgucc

SEQ ID NO: 23738 - RNA, 18 nt, artificial
  Chemically synthesized
cuguugcgcagcugcucc

SEQ ID NO: 23739 - RNA, 18 nt, artificial
  Chemically synthesized
cugcagaccuuguugccc

SEQ ID NO: 23740 - RNA, 18 nt, artificial
  Chemically synthesized
uagguguucacgccgucc

SEQ ID NO: 23741 - RNA, 18 nt, artificial
  Chemically synthesized
cacucgcagcgguacugg

SEQ ID NO: 23742 - RNA, 18 nt, artificial
  Chemically synthesized
agcucucugugcagucag

SEQ ID NO: 23743 - RNA, 18 nt, artificial
  Chemically synthesized
uacugaaccugaaacaaa

SEQ ID NO: 23744 - RNA, 18 nt, artificial
  Chemically synthesized
uugcccaggucaucuacg

SEQ ID NO: 23745 - RNA, 18 nt, artificial
  Chemically synthesized
ggagaagcucucauaguc

SEQ ID NO: 23746 - RNA, 18 nt, artificial
  Chemically synthesized
gcaggaaguggaaggagc

SEQ ID NO: 23747 - RNA, 18 nt, artificial
  Chemically synthesized
acaguuggucccacucca

SEQ ID NO: 23748 - RNA, 18 nt, artificial
  Chemically synthesized
aguggaucccgcugaagc

SEQ ID NO: 23749 - RNA, 18 nt, artificial
  Chemically synthesized
aacgcacucguugauguc

SEQ ID NO: 23750 - RNA, 18 nt, artificial
  Chemically synthesized
gucucaaaggccagccgg

SEQ ID NO: 23751 - RNA, 18 nt, artificial
  Chemically synthesized
aggcguguuguucucaca

SEQ ID NO: 23752 - RNA, 18 nt, artificial
  Chemically synthesized
gaugucacaguugguccc

SEQ ID NO: 23753 - RNA, 18 nt, artificial
  Chemically synthesized
aggcacucgucgaucucc

SEQ ID NO: 23754 - RNA, 18 nt, artificial
  Chemically synthesized
uacuggcacagaugccca

SEQ ID NO: 23755 - RNA, 18 nt, artificial
  Chemically synthesized
caggucugcccuugccag

SEQ ID NO: 23756 - RNA, 18 nt, artificial
  Chemically synthesized
cuccgcacaguccagccc

SEQ ID NO: 23757 - RNA, 18 nt, artificial
  Chemically synthesized
cugccgguugucaaucuc

SEQ ID NO: 23758 - RNA, 18 nt, artificial
  Chemically synthesized
uuucaagaacgggcaggg

SEQ ID NO: 23759 - RNA, 18 nt, artificial
  Chemically synthesized
aguugagggagcagucac

SEQ ID NO: 23760 - RNA, 18 nt, artificial
  Chemically synthesized
uguugcgcagcugcuccg

SEQ ID NO: 23761 - RNA, 18 nt, artificial
  Chemically synthesized
uaccaugggugcacucuu

SEQ ID NO: 23762 - RNA, 18 nt, artificial
  Chemically synthesized
auugaugacggacucgca

SEQ ID NO: 23763 - RNA, 18 nt, artificial
  Chemically synthesized
uucaaacugguggacccg

SEQ ID NO: 23764 - RNA, 18 nt, artificial
  Chemically synthesized
aucgucgauauuuuccuc

SEQ ID NO: 23765 - RNA, 18 nt, artificial
  Chemically synthesized
aguugaugagguccucca

SEQ ID NO: 23766 - RNA, 18 nt, artificial
  Chemically synthesized
uugaagcaggagcucucu

SEQ ID NO: 23767 - RNA, 18 nt, artificial
  Chemically synthesized
acaugcgcaggucagcgg

SEQ ID NO: 23768 - RNA, 18 nt, artificial
  Chemically synthesized
gagcaucuucuucggaac

SEQ ID NO: 23769 - RNA, 18 nt, artificial
  Chemically synthesized
uccacagagcgcacacag

SEQ ID NO: 23770 - RNA, 18 nt, artificial
  Chemically synthesized
aucuuguccagacaggug

SEQ ID NO: 23771 - RNA, 18 nt, artificial
  Chemically synthesized
uccguuugccucuggaug

SEQ ID NO: 23772 - RNA, 18 nt, artificial
  Chemically synthesized
cuggcucggcucuccacu

SEQ ID NO: 23773 - RNA, 18 nt, artificial
  Chemically synthesized
auggagccgcggacgucc

SEQ ID NO: 23774 - RNA, 18 nt, artificial
  Chemically synthesized
agcccuccaugcuggcac

SEQ ID NO: 23775 - RNA, 18 nt, artificial
  Chemically synthesized
cgucauucucacacgugg

SEQ ID NO: 23776 - RNA, 18 nt, artificial
  Chemically synthesized
ucaugauugguaccaugg

SEQ ID NO: 23777 - RNA, 18 nt, artificial
  Chemically synthesized
ugggagggcuggagacgc

SEQ ID NO: 23778 - RNA, 18 nt, artificial
  Chemically synthesized
gcgugcggaaggugagcc

SEQ ID NO: 23779 - RNA, 18 nt, artificial
  Chemically synthesized
uguugaugucacaguugg

SEQ ID NO: 23780 - RNA, 18 nt, artificial
  Chemically synthesized
agccguugacacacacgc

SEQ ID NO: 23781 - RNA, 18 nt, artificial
  Chemically synthesized
ugcuugcgcagcuccucc

SEQ ID NO: 23782 - RNA, 18 nt, artificial
  Chemically synthesized
cuccgugccuugaggucc

SEQ ID NO: 23783 - RNA, 18 nt, artificial
  Chemically synthesized
acuccagggaguccacgg

SEQ ID NO: 23784 - RNA, 18 nt, artificial
  Chemically synthesized
aguugcgcccacuguagc

SEQ ID NO: 23785 - RNA, 18 nt, artificial
  Chemically synthesized
cacucaucgauguugaug

SEQ ID NO: 23786 - RNA, 18 nt, artificial
  Chemically synthesized
cucauugaucuuguccag

SEQ ID NO: 23787 - RNA, 18 nt, artificial
  Chemically synthesized
gguguaaguguugggucc

SEQ ID NO: 23788 - RNA, 18 nt, artificial
  Chemically synthesized
cacacucguugauguccu

SEQ ID NO: 23789 - RNA, 18 nt, artificial
  Chemically synthesized
ugcagucggcgucaaccu

SEQ ID NO: 23790 - RNA, 18 nt, artificial
  Chemically synthesized
aaggguuggauucacacu

SEQ ID NO: 23791 - RNA, 18 nt, artificial
  Chemically synthesized
acacuuugaagcccucag

SEQ ID NO: 23792 - RNA, 18 nt, artificial
  Chemically synthesized
gacgcagcgguaggagcc

SEQ ID NO: 23793 - RNA, 18 nt, artificial
  Chemically synthesized
cugccaccagggagcagc

SEQ ID NO: 23794 - RNA, 18 nt, artificial
  Chemically synthesized
aaaaggcuccucuggucg

SEQ ID NO: 23795 - RNA, 18 nt, artificial
  Chemically synthesized
agacacuggcacucgaag

SEQ ID NO: 23796 - RNA, 18 nt, artificial
  Chemically synthesized
gugccuugagguccuugg

SEQ ID NO: 23797 - RNA, 18 nt, artificial
  Chemically synthesized
ccacacucguugacaucc

SEQ ID NO: 23798 - RNA, 18 nt, artificial
  Chemically synthesized
gcaggugcacacguagcc

SEQ ID NO: 23799 - RNA, 18 nt, artificial
  Chemically synthesized
ggcucuccacucaggaag

SEQ ID NO: 23800 - RNA, 18 nt, artificial
  Chemically synthesized
ucagacacuuugaagccc

SEQ ID NO: 23801 - RNA, 18 nt, artificial
  Chemically synthesized
gcaguuguagguguucac

SEQ ID NO: 23802 - RNA, 18 nt, artificial
  Chemically synthesized
ggcagaauagugugcacc

SEQ ID NO: 23803 - RNA, 18 nt, artificial
  Chemically synthesized
ucgucgaucuccucagag

SEQ ID NO: 23804 - RNA, 18 nt, artificial
  Chemically synthesized
aagccauugaugccgucc

SEQ ID NO: 23805 - RNA, 18 nt, artificial
  Chemically synthesized
guauugcaaaaaucugcu

SEQ ID NO: 23806 - RNA, 18 nt, artificial
  Chemically synthesized
uuccagcacugcagagac

SEQ ID NO: 23807 - RNA, 18 nt, artificial
  Chemically synthesized
uguccagcaggcagcccu

SEQ ID NO: 23808 - RNA, 18 nt, artificial
  Chemically synthesized
auccucgguacaguacug

SEQ ID NO: 23809 - RNA, 18 nt, artificial
  Chemically synthesized
cacucauuguuguugaug

SEQ ID NO: 23810 - RNA, 18 nt, artificial
  Chemically synthesized
uucgagacgcacucguug

SEQ ID NO: 23811 - RNA, 18 nt, artificial
  Chemically synthesized
auguuguccuggauguug

SEQ ID NO: 23812 - RNA, 18 nt, artificial
  Chemically synthesized
agaaaaggguaggaugcc

SEQ ID NO: 23813 - RNA, 18 nt, artificial
  Chemically synthesized
ucacagcgcucacccacg

SEQ ID NO: 23814 - RNA, 18 nt, artificial
  Chemically synthesized
ccaagaacuuguauaacc

SEQ ID NO: 23815 - RNA, 18 nt, artificial
  Chemically synthesized
agccggcugaguugcacu

SEQ ID NO: 23816 - RNA, 18 nt, artificial
  Chemically synthesized
uacaugaagugcagcugc

SEQ ID NO: 23817 - RNA, 18 nt, artificial
  Chemically synthesized
agccucucggguacaugc

SEQ ID NO: 23818 - RNA, 18 nt, artificial
  Chemically synthesized
cagcaaggcuacugugca

SEQ ID NO: 23819 - RNA, 18 nt, artificial
  Chemically synthesized
auuguucacggcggcggc

SEQ ID NO: 23820 - RNA, 18 nt, artificial
  Chemically synthesized
ugaaguacuuccagcacu

SEQ ID NO: 23821 - RNA, 18 nt, artificial
  Chemically synthesized
acuuggcaccauucuugc

SEQ ID NO: 23822 - RNA, 18 nt, artificial
  Chemically synthesized
cagucaggcguguuguuc

SEQ ID NO: 23823 - RNA, 18 nt, artificial
  Chemically synthesized
cugcagaccuuguugccc

SEQ ID NO: 23824 - RNA, 18 nt, artificial
  Chemically synthesized
cucagacacuuugaagcc

SEQ ID NO: 23825 - RNA, 18 nt, artificial
  Chemically synthesized
cucguugaugucgaccuc

SEQ ID NO: 23826 - RNA, 18 nt, artificial
  Chemically synthesized
agccgcggacguccaugg

SEQ ID NO: 23827 - RNA, 18 nt, artificial
  Chemically synthesized
uucaggcaggucucaccg

SEQ ID NO: 23828 - RNA, 18 nt, artificial
  Chemically synthesized
ucauccagguugaucucg

SEQ ID NO: 23829 - RNA, 18 nt, artificial
  Chemically synthesized
aguggcagauguaggagg

SEQ ID NO: 23830 - RNA, 18 nt, artificial
  Chemically synthesized
auaguccucggauugccu

SEQ ID NO: 23831 - RNA, 18 nt, artificial
  Chemically synthesized
aggugaugcugguggagc

SEQ ID NO: 23832 - RNA, 18 nt, artificial
  Chemically synthesized
augcaaauuaauccgcgu

SEQ ID NO: 23833 - RNA, 18 nt, artificial
  Chemically synthesized
ucauugacaucgugcugg

SEQ ID NO: 23834 - RNA, 18 nt, artificial
  Chemically synthesized
agacaccuugugcgucgg

SEQ ID NO: 23835 - RNA, 18 nt, artificial
  Chemically synthesized
uaggagccgaccucguug

SEQ ID NO: 23836 - RNA, 18 nt, artificial
  Chemically synthesized
acuggucaugucuuugca

SEQ ID NO: 23837 - RNA, 18 nt, artificial
  Chemically synthesized
ugcccaggugggugucgg

SEQ ID NO: 23838 - RNA, 18 nt, artificial
  Chemically synthesized
guccugacaggugccgcc

SEQ ID NO: 23839 - RNA, 18 nt, artificial
  Chemically synthesized
cagcugcaggcauagucu

SEQ ID NO: 23840 - RNA, 18 nt, artificial
  Chemically synthesized
ccacguacaugaagugca

SEQ ID NO: 23841 - RNA, 18 nt, artificial
  Chemically synthesized
gauguggcacaagagccc

SEQ ID NO: 23842 - RNA, 18 nt, artificial
  Chemically synthesized
cucgugggugacgucgcc

SEQ ID NO: 23843 - RNA, 18 nt, artificial
  Chemically synthesized
uugcagaugaacccgcgg

SEQ ID NO: 23844 - RNA, 18 nt, artificial
  Chemically synthesized
cuccacggucucacucug

SEQ ID NO: 23845 - RNA, 18 nt, artificial
  Chemically synthesized
aaauuaauccgcgugcgg

SEQ ID NO: 23846 - RNA, 18 nt, artificial
  Chemically synthesized
gcuuugccuccguuugcc

SEQ ID NO: 23847 - RNA, 18 nt, artificial
  Chemically synthesized
cuggcucggcucuccacu

SEQ ID NO: 23848 - RNA, 18 nt, artificial
  Chemically synthesized
gggcugugagucgcacuc

SEQ ID NO: 23849 - RNA, 18 nt, artificial
  Chemically synthesized
acaacugcggcauccaca

SEQ ID NO: 23850 - RNA, 18 nt, artificial
  Chemically synthesized
aucagagcgugaguagcg

SEQ ID NO: 23851 - RNA, 18 nt, artificial
  Chemically synthesized
ugauguuggucucgcagu

SEQ ID NO: 23852 - RNA, 18 nt, artificial
  Chemically synthesized
gcugggugagcacucguc

SEQ ID NO: 23853 - RNA, 18 nt, artificial
  Chemically synthesized
cauugaucuuguccaggc

SEQ ID NO: 23854 - RNA, 18 nt, artificial
  Chemically synthesized
uuggucuccagguccucg

SEQ ID NO: 23855 - RNA, 18 nt, artificial
  Chemically synthesized
ccuuggcggucucguagc

SEQ ID NO: 23856 - RNA, 18 nt, artificial
  Chemically synthesized
aggaccaaaggacgcagc

SEQ ID NO: 23857 - RNA, 18 nt, artificial
  Chemically synthesized
caugggugcacucuuggc

SEQ ID NO: 23858 - RNA, 18 nt, artificial
  Chemically synthesized
auguuggcaucugcgcug

SEQ ID NO: 23859 - RNA, 18 nt, artificial
  Chemically synthesized
agguggcgucguucuggc

SEQ ID NO: 23860 - RNA, 18 nt, artificial
  Chemically synthesized
uugacaugcaugaugccu

SEQ ID NO: 23861 - RNA, 18 nt, artificial
  Chemically synthesized
cuccacccagggucacag

SEQ ID NO: 23862 - RNA, 18 nt, artificial
  Chemically synthesized
agggaaccagagcuggcc

SEQ ID NO: 23863 - RNA, 18 nt, artificial
  Chemically synthesized
agaauagugugcaccgcc

SEQ ID NO: 23864 - RNA, 18 nt, artificial
  Chemically synthesized
aggcuguguugcuggagc

SEQ ID NO: 23865 - RNA, 18 nt, artificial
  Chemically synthesized
uugauguuggucuggcag

SEQ ID NO: 23866 - RNA, 18 nt, artificial
  Chemically synthesized
gucaucaauguucucgcu

SEQ ID NO: 23867 - RNA, 18 nt, artificial
  Chemically synthesized
gguccuccagcaugcccu

SEQ ID NO: 23868 - RNA, 18 nt, artificial
  Chemically synthesized
gagggaccaagaacuugu

SEQ ID NO: 23869 - RNA, 18 nt, artificial
  Chemically synthesized
cugccaccagggagcagc

SEQ ID NO: 23870 - RNA, 18 nt, artificial
  Chemically synthesized
cagugcacaagguucugg

SEQ ID NO: 23871 - RNA, 18 nt, artificial
  Chemically synthesized
ggucucacucugcacggc

SEQ ID NO: 23872 - RNA, 18 nt, artificial
  Chemically synthesized
cguugauguuggucuggc

SEQ ID NO: 23873 - RNA, 18 nt, artificial
  Chemically synthesized
acugcaugcuggugggag

SEQ ID NO: 23874 - RNA, 18 nt, artificial
  Chemically synthesized
uguugaugccgucugugc

SEQ ID NO: 23875 - RNA, 18 nt, artificial
  Chemically synthesized
agacacaggagaagcucu

SEQ ID NO: 23876 - RNA, 18 nt, artificial
  Chemically synthesized
ucgcauugaccauucaaa

SEQ ID NO: 23877 - RNA, 18 nt, artificial
  Chemically synthesized
gacggagacugcuggaac

SEQ ID NO: 23878 - RNA, 18 nt, artificial
  Chemically synthesized
uuugcugcugcuggaugu

SEQ ID NO: 23879 - RNA, 18 nt, artificial
  Chemically synthesized
aggucaggcagaaccacg

SEQ ID NO: 23880 - RNA, 18 nt, artificial
  Chemically synthesized
uugccauugacaggguug

SEQ ID NO: 23881 - RNA, 18 nt, artificial
  Chemically synthesized
uggaacucauugaucuug

SEQ ID NO: 23882 - RNA, 18 nt, artificial
  Chemically synthesized
acaucuaacccauaugcu

SEQ ID NO: 23883 - RNA, 18 nt, artificial
  Chemically synthesized
cgaucugggacugcaugc

SEQ ID NO: 23884 - RNA, 18 nt, artificial
  Chemically synthesized
acacagagcccuccaugc

SEQ ID NO: 23885 - RNA, 18 nt, artificial
  Chemically synthesized
auaaaaguuucuaccugg

SEQ ID NO: 23886 - RNA, 18 nt, artificial
  Chemically synthesized
gugacuccagggagucca

SEQ ID NO: 23887 - RNA, 18 nt, artificial
  Chemically synthesized
gcacacucguugaugucc

SEQ ID NO: 23888 - RNA, 18 nt, artificial
  Chemically synthesized
cagcggcacuuguacucc

SEQ ID NO: 23889 - RNA, 18 nt, artificial
  Chemically synthesized
ucauguuugacaugcaug

SEQ ID NO: 23890 - RNA, 18 nt, artificial
  Chemically synthesized
accagugcacaagguucu

SEQ ID NO: 23891 - RNA, 18 nt, artificial
  Chemically synthesized
uccagguugaucucgcag

SEQ ID NO: 23892 - RNA, 18 nt, artificial
  Chemically synthesized
guucuucaggagcacaac

SEQ ID NO: 23893 - RNA, 18 nt, artificial
  Chemically synthesized
agccgaccucguuguggc

SEQ ID NO: 23894 - RNA, 18 nt, artificial
  Chemically synthesized
ggaucaguggcgucgugc

SEQ ID NO: 23895 - RNA, 18 nt, artificial
  Chemically synthesized
ugcacgcaguucugggug

SEQ ID NO: 23896 - RNA, 18 nt, artificial
  Chemically synthesized
agagcgugaguagcgggc

SEQ ID NO: 23897 - RNA, 18 nt, artificial
  Chemically synthesized
augggcggcuaaggcucc

SEQ ID NO: 23898 - RNA, 18 nt, artificial
  Chemically synthesized
cacagucaucaauguucu

SEQ ID NO: 23899 - RNA, 18 nt, artificial
  Chemically synthesized
ucugggacagggcgcugg

SEQ ID NO: 23900 - RNA, 18 nt, artificial
  Chemically synthesized
gugcacacccugagugcc

SEQ ID NO: 23901 - RNA, 18 nt, artificial
  Chemically synthesized
uuguacccguugaggcug

SEQ ID NO: 23902 - RNA, 18 nt, artificial
  Chemically synthesized
uuggguccguccaggcac

SEQ ID NO: 23903 - RNA, 18 nt, artificial
  Chemically synthesized
augugccgccguugaggc

SEQ ID NO: 23904 - RNA, 18 nt, artificial
  Chemically synthesized
ucguucaacuucccuucu

SEQ ID NO: 23905 - RNA, 18 nt, artificial
  Chemically synthesized
uggcgacgccguccuugc

SEQ ID NO: 23906 - RNA, 18 nt, artificial
  Chemically synthesized
ugagcacucguccaccag

SEQ ID NO: 23907 - RNA, 18 nt, artificial
  Chemically synthesized
ucucacaguggaucccgc

SEQ ID NO: 23908 - RNA, 18 nt, artificial
  Chemically synthesized
aguugcacuuguacccgg

SEQ ID NO: 23909 - RNA, 18 nt, artificial
  Chemically synthesized
ugcaugcgucguugaggu

SEQ ID NO: 23910 - RNA, 18 nt, artificial
  Chemically synthesized
aucaucugggacagggcg

SEQ ID NO: 23911 - RNA, 18 nt, artificial
  Chemically synthesized
ucgucgauauuuuccuca

SEQ ID NO: 23912 - RNA, 18 nt, artificial
  Chemically synthesized
acagaugcccagugaagc

SEQ ID NO: 23913 - RNA, 18 nt, artificial
  Chemically synthesized
aggcugcccagguagccg

SEQ ID NO: 23914 - RNA, 18 nt, artificial
  Chemically synthesized
cacucguugauguugguc

SEQ ID NO: 23915 - RNA, 18 nt, artificial
  Chemically synthesized
cagguuguacucguccag

SEQ ID NO: 23916 - RNA, 18 nt, artificial
  Chemically synthesized
gaagggcaggcacuggcc

SEQ ID NO: 23917 - RNA, 18 nt, artificial
  Chemically synthesized
ugguagaugaagucggag

SEQ ID NO: 23918 - RNA, 18 nt, artificial
  Chemically synthesized
agucugccacgccucugc

SEQ ID NO: 23919 - RNA, 18 nt, artificial
  Chemically synthesized
accucacaggucugcccu

SEQ ID NO: 23920 - RNA, 18 nt, artificial
  Chemically synthesized
caugggcggcuaaggcuc

SEQ ID NO: 23921 - RNA, 18 nt, artificial
  Chemically synthesized
augucuuugcaggugccg

SEQ ID NO: 23922 - RNA, 18 nt, artificial
  Chemically synthesized
aagccaucaggcccgcgg

SEQ ID NO: 23923 - RNA, 18 nt, artificial
  Chemically synthesized
ugguuguugcacugcagg

SEQ ID NO: 23924 - RNA, 18 nt, artificial
  Chemically synthesized
ugcagaugcacuggaacu

SEQ ID NO: 23925 - RNA, 18 nt, artificial
  Chemically synthesized
agggcgaggagucacacc

SEQ ID NO: 23926 - RNA, 18 nt, artificial
  Chemically synthesized
acacucguagccaucgau

SEQ ID NO: 23927 - RNA, 18 nt, artificial
  Chemically synthesized
cacauuuucacaagcaug

SEQ ID NO: 23928 - RNA, 18 nt, artificial
  Chemically synthesized
augacggccggcgcgucc

SEQ ID NO: 23929 - RNA, 18 nt, artificial
  Chemically synthesized
gccuugccauugacaggg

SEQ ID NO: 23930 - RNA, 18 nt, artificial
  Chemically synthesized
caucgauguugauguuac

SEQ ID NO: 23931 - RNA, 18 nt, artificial
  Chemically synthesized
cuacguaggaaaacccug

SEQ ID NO: 23932 - RNA, 18 nt, artificial
  Chemically synthesized
acacugugcaggcugagg

SEQ ID NO: 23933 - RNA, 18 nt, artificial
  Chemically synthesized
acauuuuuucugccauag

SEQ ID NO: 23934 - RNA, 18 nt, artificial
  Chemically synthesized
acuggcugucacaguggc

SEQ ID NO: 23935 - RNA, 18 nt, artificial
  Chemically synthesized
uuguugcccgcguccucc

SEQ ID NO: 23936 - RNA, 18 nt, artificial
  Chemically synthesized
ggcucagaacgcacucgu

SEQ ID NO: 23937 - RNA, 18 nt, artificial
  Chemically synthesized
ggucucgcaguugcgccc

SEQ ID NO: 23938 - RNA, 18 nt, artificial
  Chemically synthesized
auguuacacaugcucccu

SEQ ID NO: 23939 - RNA, 18 nt, artificial
  Chemically synthesized
uccacauuguucacggcg

SEQ ID NO: 23940 - RNA, 18 nt, artificial
  Chemically synthesized
ucacacucauuguuguug

SEQ ID NO: 23941 - RNA, 18 nt, artificial
  Chemically synthesized
uugacgucgaucucgcau

SEQ ID NO: 23942 - RNA, 18 nt, artificial
  Chemically synthesized
uuguacucguccagcagc

SEQ ID NO: 23943 - RNA, 18 nt, artificial
  Chemically synthesized
uagaugaagucggagaug

SEQ ID NO: 23944 - RNA, 18 nt, artificial
  Chemically synthesized
cuguguugcuggagcauc

SEQ ID NO: 23945 - RNA, 18 nt, artificial
  Chemically synthesized
uucuugcuggccucagac

SEQ ID NO: 23946 - RNA, 18 nt, artificial
  Chemically synthesized
uauugcaaaaaucugcuc

SEQ ID NO: 23947 - RNA, 18 nt, artificial
  Chemically synthesized
cucgcagugcacacccuc

SEQ ID NO: 23948 - RNA, 18 nt, artificial
  Chemically synthesized
ugccaucaugcaugcggg

SEQ ID NO: 23949 - RNA, 18 nt, artificial
  Chemically synthesized
uggagacgcccucggacc

SEQ ID NO: 23950 - RNA, 18 nt, artificial
  Chemically synthesized
gauguugauguuacacau

SEQ ID NO: 23951 - RNA, 18 nt, artificial
  Chemically synthesized
ugcagaccuuguugcccg

SEQ ID NO: 23952 - RNA, 18 nt, artificial
  Chemically synthesized
acgcacucguugacgucg

SEQ ID NO: 23953 - RNA, 18 nt, artificial
  Chemically synthesized
ggcuauacuugguauugc

SEQ ID NO: 23954 - RNA, 18 nt, artificial
  Chemically synthesized
ggugagcacucguccacc

SEQ ID NO: 23955 - RNA, 18 nt, artificial
  Chemically synthesized
cguugaggcugucccggc

SEQ ID NO: 23956 - RNA, 18 nt, artificial
  Chemically synthesized
acauggcaacaucuaacc

SEQ ID NO: 23957 - RNA, 18 nt, artificial
  Chemically synthesized
uuggcggucucguagcug

SEQ ID NO: 23958 - RNA, 18 nt, artificial
  Chemically synthesized
aucccaggcaggugguug

SEQ ID NO: 23959 - RNA, 18 nt, artificial
  Chemically synthesized
aguccacacaucucaugu

SEQ ID NO: 23960 - RNA, 18 nt, artificial
  Chemically synthesized
aaggccuccggaaugcgg

SEQ ID NO: 23961 - RNA, 18 nt, artificial
  Chemically synthesized
gucacaccagugcacaag

SEQ ID NO: 23962 - RNA, 18 nt, artificial
  Chemically synthesized
guuguuuccuggacaauc

SEQ ID NO: 23963 - RNA, 18 nt, artificial
  Chemically synthesized
ggcaguugcacuuguacc

SEQ ID NO: 23964 - RNA, 18 nt, artificial
  Chemically synthesized
cccacagugaaauucagg

SEQ ID NO: 23965 - RNA, 18 nt, artificial
  Chemically synthesized
uggauguuggcaucugcg

SEQ ID NO: 23966 - RNA, 18 nt, artificial
  Chemically synthesized
cuugggaaaggaagccgg

SEQ ID NO: 23967 - RNA, 18 nt, artificial
  Chemically synthesized
uuccucauguagaucacu

SEQ ID NO: 23968 - RNA, 18 nt, artificial
  Chemically synthesized
gguacugggugugggucu

SEQ ID NO: 23969 - RNA, 18 nt, artificial
  Chemically synthesized
ugugacccaggcaagugc

SEQ ID NO: 23970 - RNA, 18 nt, artificial
  Chemically synthesized
aagguggcgacgccgucc

SEQ ID NO: 23971 - RNA, 18 nt, artificial
  Chemically synthesized
uguuguucugcauaucuu

SEQ ID NO: 23972 - RNA, 18 nt, artificial
  Chemically synthesized
guagaaggaggccacacg

SEQ ID NO: 23973 - RNA, 18 nt, artificial
  Chemically synthesized
gaugugggcucacagguc

SEQ ID NO: 23974 - RNA, 18 nt, artificial
  Chemically synthesized
acagcucaaugugcccgg

SEQ ID NO: 23975 - RNA, 18 nt, artificial
  Chemically synthesized
uugacaucgugcuggcag

SEQ ID NO: 23976 - RNA, 18 nt, artificial
  Chemically synthesized
ugaccauucaaacuggug

SEQ ID NO: 23977 - RNA, 18 nt, artificial
  Chemically synthesized
gcacuggaacucauugau

SEQ ID NO: 23978 - RNA, 18 nt, artificial
  Chemically synthesized
gagcgucauucucacacg

SEQ ID NO: 23979 - RNA, 18 nt, artificial
  Chemically synthesized
gguacaugcuccgcacag

SEQ ID NO: 23980 - RNA, 18 nt, artificial
  Chemically synthesized
uccugggacuucuuccuc

SEQ ID NO: 23981 - RNA, 18 nt, artificial
  Chemically synthesized
acuuguuuccuauuucag

SEQ ID NO: 23982 - RNA, 18 nt, artificial
  Chemically synthesized
agcuuuuuggacuaugcu

SEQ ID NO: 23983 - RNA, 18 nt, artificial
  Chemically synthesized
uucaggugcccgaugccc

SEQ ID NO: 23984 - RNA, 18 nt, artificial
  Chemically synthesized
ucugcccuugccagcccg

SEQ ID NO: 23985 - RNA, 18 nt, artificial
  Chemically synthesized
cacaggcaacgguagaag

SEQ ID NO: 23986 - RNA, 18 nt, artificial
  Chemically synthesized
aucagcaccaccaccacc

SEQ ID NO: 23987 - RNA, 18 nt, artificial
  Chemically synthesized
uugaugagguccuccagc

SEQ ID NO: 23988 - RNA, 18 nt, artificial
  Chemically synthesized
acaggcaacgguagaagg

SEQ ID NO: 23989 - RNA, 18 nt, artificial
  Chemically synthesized
uaacccauaugcuuucac

SEQ ID NO: 23990 - RNA, 18 nt, artificial
  Chemically synthesized
ucucauaguccucggauu

SEQ ID NO: 23991 - RNA, 18 nt, artificial
  Chemically synthesized
ucugcagccgggacagcc

SEQ ID NO: 23992 - RNA, 18 nt, artificial
  Chemically synthesized
ucguugacauccugccgg

SEQ ID NO: 23993 - RNA, 18 nt, artificial
  Chemically synthesized
gucugcccuugccagccc

SEQ ID NO: 23994 - RNA, 18 nt, artificial
  Chemically synthesized
augccuacauuucaagaa

SEQ ID NO: 23995 - RNA, 18 nt, artificial
  Chemically synthesized
cgugcaguucuuccaggg

SEQ ID NO: 23996 - RNA, 18 nt, artificial
  Chemically synthesized
aggguuguauugguucgg

SEQ ID NO: 23997 - RNA, 18 nt, artificial
  Chemically synthesized
augcgggcauccaggucu

SEQ ID NO: 23998 - RNA, 18 nt, artificial
  Chemically synthesized
agccaucgaucuugucca

SEQ ID NO: 23999 - RNA, 18 nt, artificial
  Chemically synthesized
uucuucaggagcacaacu

SEQ ID NO: 24000 - RNA, 18 nt, artificial
  Chemically synthesized
ggcucucggaugugggcu

SEQ ID NO: 24001 - RNA, 18 nt, artificial
  Chemically synthesized
ggcugaguugcacuggcu

SEQ ID NO: 24002 - RNA, 18 nt, artificial
  Chemically synthesized
uggcagcaaggcuacugu

SEQ ID NO: 24003 - RNA, 18 nt, artificial
  Chemically synthesized
uguaaguuuuguggcugc

SEQ ID NO: 24004 - RNA, 18 nt, artificial
  Chemically synthesized
gcugcacgcaguucuggg

SEQ ID NO: 24005 - RNA, 18 nt, artificial
  Chemically synthesized
ugcccuccacggccaggc

SEQ ID NO: 24006 - RNA, 18 nt, artificial
  Chemically synthesized
uccucagagcaguucacc

SEQ ID NO: 24007 - RNA, 18 nt, artificial
  Chemically synthesized
ggugggccagucucaaag

SEQ ID NO: 24008 - RNA, 18 nt, artificial
  Chemically synthesized
uccggcggcaucagcacc

SEQ ID NO: 24009 - RNA, 18 nt, artificial
  Chemically synthesized
guccucaccaguccagcc

SEQ ID NO: 24010 - RNA, 18 nt, artificial
  Chemically synthesized
cagugcacacccugagug

SEQ ID NO: 24011 - RNA, 18 nt, artificial
  Chemically synthesized
cacucguugacgucgauc

SEQ ID NO: 24012 - RNA, 18 nt, artificial
  Chemically synthesized
gcucggcucuccacucag

SEQ ID NO: 24013 - RNA, 18 nt, artificial
  Chemically synthesized
uugaccucagacaggcag

SEQ ID NO: 24014 - RNA, 18 nt, artificial
  Chemically synthesized
ucauugaccucagacagg

SEQ ID NO: 24015 - RNA, 18 nt, artificial
  Chemically synthesized
gucugccuggcucggcuc

SEQ ID NO: 24016 - RNA, 18 nt, artificial
  Chemically synthesized
augcuccgcacaguccag

SEQ ID NO: 24017 - RNA, 18 nt, artificial
  Chemically synthesized
ugacgucccucacuggca

SEQ ID NO: 24018 - RNA, 18 nt, artificial
  Chemically synthesized
guaccaugggugcacucu

SEQ ID NO: 24019 - RNA, 18 nt, artificial
  Chemically synthesized
cacucauugaccucagac

SEQ ID NO: 24020 - RNA, 18 nt, artificial
  Chemically synthesized
uucugggugccacgggcg

SEQ ID NO: 24021 - RNA, 18 nt, artificial
  Chemically synthesized
cucggaccagucggagac

SEQ ID NO: 24022 - RNA, 18 nt, artificial
  Chemically synthesized
gguccucacaguagcugc

SEQ ID NO: 24023 - RNA, 18 nt, artificial
  Chemically synthesized
augaagucggagaugacg

SEQ ID NO: 24024 - RNA, 18 nt, artificial
  Chemically synthesized
agcaucuucuucggaacc

SEQ ID NO: 24025 - RNA, 18 nt, artificial
  Chemically synthesized
ucuguguugaccucgcag

SEQ ID NO: 24026 - RNA, 18 nt, artificial
  Chemically synthesized
ccggugugaccagcacgg

SEQ ID NO: 24027 - RNA, 18 nt, artificial
  Chemically synthesized
cuguguugcuggagcauc

SEQ ID NO: 24028 - RNA, 18 nt, artificial
  Chemically synthesized
aguucugggugccacggg

SEQ ID NO: 24029 - RNA, 18 nt, artificial
  Chemically synthesized
uugcgcagcugcuccggc

SEQ ID NO: 24030 - RNA, 18 nt, artificial
  Chemically synthesized
gagcuuuuuggacuaugc

SEQ ID NO: 24031 - RNA, 18 nt, artificial
  Chemically synthesized
acacaacagacucauuca

SEQ ID NO: 24032 - RNA, 18 nt, artificial
  Chemically synthesized
uccucaccaguccagccg

SEQ ID NO: 24033 - RNA, 18 nt, artificial
  Chemically synthesized
cggguucgagacgcacuc

SEQ ID NO: 24034 - RNA, 18 nt, artificial
  Chemically synthesized
agucucaaaggccagccg

SEQ ID NO: 24035 - RNA, 18 nt, artificial
  Chemically synthesized
gucaggcguguuguucuc

SEQ ID NO: 24036 - RNA, 18 nt, artificial
  Chemically synthesized
ugcacacacagguguaag

SEQ ID NO: 24037 - RNA, 18 nt, artificial
  Chemically synthesized
aggcacucguugacaucc

SEQ ID NO: 24038 - RNA, 18 nt, artificial
  Chemically synthesized
gcaacgucgucaauacac

SEQ ID NO: 24039 - RNA, 18 nt, artificial
  Chemically synthesized
aguugcacuggcugucac

SEQ ID NO: 24040 - RNA, 18 nt, artificial
  Chemically synthesized
uucucgcugcaguccuca

SEQ ID NO: 24041 - RNA, 18 nt, artificial
  Chemically synthesized
cacgcaguucugggugcc

SEQ ID NO: 24042 - RNA, 18 nt, artificial
  Chemically synthesized
aucuccucagagcaguuc

SEQ ID NO: 24043 - RNA, 18 nt, artificial
  Chemically synthesized
auggcaacaucuaaccca

SEQ ID NO: 24044 - RNA, 18 nt, artificial
  Chemically synthesized
cacagagcgcacacagac

SEQ ID NO: 24045 - RNA, 18 nt, artificial
  Chemically synthesized
ggguugcacuggccuucc

SEQ ID NO: 24046 - RNA, 18 nt, artificial
  Chemically synthesized
acuugcaggaguagccgc

SEQ ID NO: 24047 - RNA, 18 nt, artificial
  Chemically synthesized
uggauguuugcuggcugc

SEQ ID NO: 24048 - RNA, 18 nt, artificial
  Chemically synthesized
guccacgcaggugccacc

SEQ ID NO: 24049 - RNA, 18 nt, artificial
  Chemically synthesized
ugucugguugugcaggcu

SEQ ID NO: 24050 - RNA, 18 nt, artificial
  Chemically synthesized
ugcgggacagcagcaccc

SEQ ID NO: 24051 - RNA, 18 nt, artificial
  Chemically synthesized
gcacuggcugucacagug

SEQ ID NO: 24052 - RNA, 18 nt, artificial
  Chemically synthesized
uugcagcccuggucgcag

SEQ ID NO: 24053 - RNA, 18 nt, artificial
  Chemically synthesized
ugcacacccugagugccc

SEQ ID NO: 24054 - RNA, 18 nt, artificial
  Chemically synthesized
ucgaugucggucucgcag

SEQ ID NO: 24055 - RNA, 18 nt, artificial
  Chemically synthesized
uugacgcgcugcacgcag

SEQ ID NO: 24056 - RNA, 18 nt, artificial
  Chemically synthesized
agcacucguccaccaggu

SEQ ID NO: 24057 - RNA, 18 nt, artificial
  Chemically synthesized
ggauguugaggcugccca

SEQ ID NO: 24058 - RNA, 18 nt, artificial
  Chemically synthesized
ggcuugggaaaggaagcc

SEQ ID NO: 24059 - RNA, 18 nt, artificial
  Chemically synthesized
uuccggaucaggaucugg

SEQ ID NO: 24060 - RNA, 18 nt, artificial
  Chemically synthesized
aagucauugacgcgcugc

SEQ ID NO: 24061 - RNA, 18 nt, artificial
  Chemically synthesized
acacuccgagaacacauu

SEQ ID NO: 24062 - RNA, 18 nt, artificial
  Chemically synthesized
augcuggugggagggcug

SEQ ID NO: 24063 - RNA, 18 nt, artificial
  Chemically synthesized
gugugaccagcacggcac

SEQ ID NO: 24064 - RNA, 18 nt, artificial
  Chemically synthesized
uucuugcccugcacgccg

SEQ ID NO: 24065 - RNA, 18 nt, artificial
  Chemically synthesized
ucagagcgugaguagcgg

SEQ ID NO: 24066 - RNA, 18 nt, artificial
  Chemically synthesized
uguuguccacaggcgagg

SEQ ID NO: 24067 - RNA, 18 nt, artificial
  Chemically synthesized
uuugccuccguuugccuc

SEQ ID NO: 24068 - RNA, 18 nt, artificial
  Chemically synthesized
aagguucuggcaguuggg

SEQ ID NO: 24069 - RNA, 18 nt, artificial
  Chemically synthesized
uugaugccguccucgcag

SEQ ID NO: 24070 - RNA, 18 nt, artificial
  Chemically synthesized
uugucgcugcgcagccac

SEQ ID NO: 24071 - RNA, 18 nt, artificial
  Chemically synthesized
cucgguuccggaucagga

SEQ ID NO: 24072 - RNA, 18 nt, artificial
  Chemically synthesized
aguucuggccggugaagc

SEQ ID NO: 24073 - RNA, 18 nt, artificial
  Chemically synthesized
ucguacuggcacagaugc

SEQ ID NO: 24074 - RNA, 18 nt, artificial
  Chemically synthesized
ggucucguagcugcccuc

SEQ ID NO: 24075 - RNA, 18 nt, artificial
  Chemically synthesized
ucgcaguggaagucauug

SEQ ID NO: 24076 - RNA, 18 nt, artificial
  Chemically synthesized
ugcaggcugaggugcugg

SEQ ID NO: 24077 - RNA, 18 nt, artificial
  Chemically synthesized
cuucuccaacaucauuuc

SEQ ID NO: 24078 - RNA, 18 nt, artificial
  Chemically synthesized
uggucuggcaguugggac

SEQ ID NO: 24079 - RNA, 18 nt, artificial
  Chemically synthesized
guuggucucgcaguggug

SEQ ID NO: 24080 - RNA, 18 nt, artificial
  Chemically synthesized
guccacacagagcccucc

SEQ ID NO: 24081 - RNA, 18 nt, artificial
  Chemically synthesized
ggacuucuuccuccgugc

SEQ ID NO: 24082 - RNA, 18 nt, artificial
  Chemically synthesized
uguucacgccguccacac

SEQ ID NO: 24083 - RNA, 18 nt, artificial
  Chemically synthesized
uuguagccaccgugggug

SEQ ID NO: 24084 - RNA, 18 nt, artificial
  Chemically synthesized
ucgcagugcacacccucg

SEQ ID NO: 24085 - RNA, 18 nt, artificial
  Chemically synthesized
gcccugguagaugaaguc

SEQ ID NO: 24086 - RNA, 18 nt, artificial
  Chemically synthesized
gaacucauugaucuuguc

SEQ ID NO: 24087 - RNA, 18 nt, artificial
  Chemically synthesized
gcccguugaauuuggcgg

SEQ ID NO: 24088 - RNA, 18 nt, artificial
  Chemically synthesized
guaggaaaacccuggcuc

SEQ ID NO: 24089 - RNA, 18 nt, artificial
  Chemically synthesized
ggcuugcggaccuucuug

SEQ ID NO: 24090 - RNA, 18 nt, artificial
  Chemically synthesized
gacgcaucuggucaugcc

SEQ ID NO: 24091 - RNA, 18 nt, artificial
  Chemically synthesized
ggaagaucaucugcuggc

SEQ ID NO: 24092 - RNA, 18 nt, artificial
  Chemically synthesized
caccucacacguggcacc

SEQ ID NO: 24093 - RNA, 18 nt, artificial
  Chemically synthesized
uuguugaugucacaguug

SEQ ID NO: 24094 - RNA, 18 nt, artificial
  Chemically synthesized
uuguuuccuggacaaucg

SEQ ID NO: 24095 - RNA, 18 nt, artificial
  Chemically synthesized
ccuucuugcccugcacgc

SEQ ID NO: 24096 - RNA, 18 nt, artificial
  Chemically synthesized
ggaccaaaggacgcagcc

SEQ ID NO: 24097 - RNA, 18 nt, artificial
  Chemically synthesized
ucacugaaguacuuccag

SEQ ID NO: 24098 - RNA, 18 nt, artificial
  Chemically synthesized
augcaugcgcuccugugc

SEQ ID NO: 24099 - RNA, 18 nt, artificial
  Chemically synthesized
caggcagggcugugaguc

SEQ ID NO: 24100 - RNA, 18 nt, artificial
  Chemically synthesized
auuguuguugaugucaca

SEQ ID NO: 24101 - RNA, 18 nt, artificial
  Chemically synthesized
ucgcaguugcgcccacug

SEQ ID NO: 24102 - RNA, 18 nt, artificial
  Chemically synthesized
uugccuuugcagccauug

SEQ ID NO: 24103 - RNA, 18 nt, artificial
  Chemically synthesized
ugcagggcacguagggcc

SEQ ID NO: 24104 - RNA, 18 nt, artificial
  Chemically synthesized
uugacaggguuggugucg

SEQ ID NO: 24105 - RNA, 18 nt, artificial
  Chemically synthesized
ccagcagcaccuuggcgg

SEQ ID NO: 24106 - RNA, 18 nt, artificial
  Chemically synthesized
ggagaugcaugugccgcc

SEQ ID NO: 24107 - RNA, 18 nt, artificial
  Chemically synthesized
cuggucaugucuuugcag

SEQ ID NO: 24108 - RNA, 18 nt, artificial
  Chemically synthesized
gacaugcgcaggucagcg

SEQ ID NO: 24109 - RNA, 18 nt, artificial
  Chemically synthesized
guaaaggccgguccagcc

SEQ ID NO: 24110 - RNA, 18 nt, artificial
  Chemically synthesized
uagccgcccagguagucc

SEQ ID NO: 24111 - RNA, 18 nt, artificial
  Chemically synthesized
gcuccacggucucacucu

SEQ ID NO: 24112 - RNA, 18 nt, artificial
  Chemically synthesized
ccgagcugagccaagucu

SEQ ID NO: 24113 - RNA, 18 nt, artificial
  Chemically synthesized
cuccgugugugacccagg

SEQ ID NO: 24114 - RNA, 18 nt, artificial
  Chemically synthesized
agcacuuguagguguugg

SEQ ID NO: 24115 - RNA, 18 nt, artificial
  Chemically synthesized
aacgucaacaccuugucg

SEQ ID NO: 24116 - RNA, 18 nt, artificial
  Chemically synthesized
caucuucuucggaaccug

SEQ ID NO: 24117 - RNA, 18 nt, artificial
  Chemically synthesized
ugcgugcaguucuuccag

SEQ ID NO: 24118 - RNA, 18 nt, artificial
  Chemically synthesized
acagguguaaguguuggg

SEQ ID NO: 24119 - RNA, 18 nt, artificial
  Chemically synthesized
cuuccucgcuguugcccg

SEQ ID NO: 24120 - RNA, 18 nt, artificial
  Chemically synthesized
auccagguugaucucgca

SEQ ID NO: 24121 - RNA, 18 nt, artificial
  Chemically synthesized
cccucacagcgcucaccc

SEQ ID NO: 24122 - RNA, 18 nt, artificial
  Chemically synthesized
uacccuuccgugcacaca

SEQ ID NO: 24123 - RNA, 18 nt, artificial
  Chemically synthesized
agguucugcugcugcauc

SEQ ID NO: 24124 - RNA, 18 nt, artificial
  Chemically synthesized
acggagacugcuggaacg

SEQ ID NO: 24125 - RNA, 18 nt, artificial
  Chemically synthesized
accagucggagacguugg

SEQ ID NO: 24126 - RNA, 18 nt, artificial
  Chemically synthesized
ggugguucuggagggacc

SEQ ID NO: 24127 - RNA, 18 nt, artificial
  Chemically synthesized
uugcaagaaaccaucuaa

SEQ ID NO: 24128 - RNA, 18 nt, artificial
  Chemically synthesized
uguucugcauaucuuugu

SEQ ID NO: 24129 - RNA, 18 nt, artificial
  Chemically synthesized
gugcggcugugguggugg

SEQ ID NO: 24130 - RNA, 18 nt, artificial
  Chemically synthesized
accuuguugcccgcgucc

SEQ ID NO: 24131 - RNA, 18 nt, artificial
  Chemically synthesized
ucugcacggccucgaucu

SEQ ID NO: 24132 - RNA, 18 nt, artificial
  Chemically synthesized
ugugaguugaugaggucc

SEQ ID NO: 24133 - RNA, 18 nt, artificial
  Chemically synthesized
agggcagcaggcaguugc

SEQ ID NO: 24134 - RNA, 18 nt, artificial
  Chemically synthesized
ugcacaagguucuggcag

SEQ ID NO: 24135 - RNA, 18 nt, artificial
  Chemically synthesized
acucgggcagcucgcacg

SEQ ID NO: 24136 - RNA, 18 nt, artificial
  Chemically synthesized
acguuggugugcagcacg

SEQ ID NO: 24137 - RNA, 18 nt, artificial
  Chemically synthesized
guacaguacugaccuguc

SEQ ID NO: 24138 - RNA, 18 nt, artificial
  Chemically synthesized
ucgcacuggaacucauug

SEQ ID NO: 24139 - RNA, 18 nt, artificial
  Chemically synthesized
caggcaacgguagaaggg

SEQ ID NO: 24140 - RNA, 18 nt, artificial
  Chemically synthesized
ucgugggugacgucgccc

SEQ ID NO: 24141 - RNA, 18 nt, artificial
  Chemically synthesized
ucggguacaugcuccgca

SEQ ID NO: 24142 - RNA, 18 nt, artificial
  Chemically synthesized
acacguagccacugguca

SEQ ID NO: 24143 - RNA, 18 nt, artificial
  Chemically synthesized
gcucucagaacuugcuug

SEQ ID NO: 24144 - RNA, 18 nt, artificial
  Chemically synthesized
auccaggucuguggcucg

SEQ ID NO: 24145 - RNA, 18 nt, artificial
  Chemically synthesized
ucacaggucugcccuugc

SEQ ID NO: 24146 - RNA, 18 nt, artificial
  Chemically synthesized
cucggcucuccacucagg

SEQ ID NO: 24147 - RNA, 18 nt, artificial
  Chemically synthesized
cacucguccacauccucg

SEQ ID NO: 24148 - RNA, 18 nt, artificial
  Chemically synthesized
cauugaccucagacaggc

SEQ ID NO: 24149 - RNA, 18 nt, artificial
  Chemically synthesized
uccugugcgaugucgcgc

SEQ ID NO: 24150 - RNA, 18 nt, artificial
  Chemically synthesized
ugagcucacgccaaggug

SEQ ID NO: 24151 - RNA, 18 nt, artificial
  Chemically synthesized
gugcaugggcggcuaagg

SEQ ID NO: 24152 - RNA, 18 nt, artificial
  Chemically synthesized
ucggaugugggcucacag

SEQ ID NO: 24153 - RNA, 18 nt, artificial
  Chemically synthesized
agaggcaggugaaggugg

SEQ ID NO: 24154 - RNA, 18 nt, artificial
  Chemically synthesized
cucacaggacacgcuggg

SEQ ID NO: 24155 - RNA, 18 nt, artificial
  Chemically synthesized
aaucugcuccucccaaac

SEQ ID NO: 24156 - RNA, 18 nt, artificial
  Chemically synthesized
cugccuguguagcccgcc

SEQ ID NO: 24157 - RNA, 18 nt, artificial
  Chemically synthesized
ugguugugcaggcuggcg

SEQ ID NO: 24158 - RNA, 18 nt, artificial
  Chemically synthesized
cacaggucugcccuugcc

SEQ ID NO: 24159 - RNA, 18 nt, artificial
  Chemically synthesized
auacacacuccgagaaca

SEQ ID NO: 24160 - RNA, 18 nt, artificial
  Chemically synthesized
guggaaggagcuguugcg

SEQ ID NO: 24161 - RNA, 18 nt, artificial
  Chemically synthesized
ccucagacacuuugaagc

SEQ ID NO: 24162 - RNA, 18 nt, artificial
  Chemically synthesized
caggugaagccauugaug

SEQ ID NO: 24163 - RNA, 18 nt, artificial
  Chemically synthesized
caccagguuguacucguc

SEQ ID NO: 24164 - RNA, 18 nt, artificial
  Chemically synthesized
cacucgcauugaccauuc

SEQ ID NO: 24165 - RNA, 18 nt, artificial
  Chemically synthesized
ucguugacgucgaucucg

SEQ ID NO: 24166 - RNA, 18 nt, artificial
  Chemically synthesized
uugaucuuguccaggcag

SEQ ID NO: 24167 - RNA, 18 nt, artificial
  Chemically synthesized
gaacgcacucguugaugu

SEQ ID NO: 24168 - RNA, 18 nt, artificial
  Chemically synthesized
uguuggaggccacggcgc

SEQ ID NO: 24169 - RNA, 18 nt, artificial
  Chemically synthesized
uaaaaguuucuaccuggg

SEQ ID NO: 24170 - RNA, 18 nt, artificial
  Chemically synthesized
acuuugaagcccucaggg

SEQ ID NO: 24171 - RNA, 18 nt, artificial
  Chemically synthesized
aggcugcccugaggagug

SEQ ID NO: 24172 - RNA, 18 nt, artificial
  Chemically synthesized
agucgcacucauugacau

SEQ ID NO: 24173 - RNA, 18 nt, artificial
  Chemically synthesized
uugaugccguccacgcag

SEQ ID NO: 24174 - RNA, 18 nt, artificial
  Chemically synthesized
gguauugcaaaaaucugc

SEQ ID NO: 24175 - RNA, 18 nt, artificial
  Chemically synthesized
guugauguuggucucgca

SEQ ID NO: 24176 - RNA, 18 nt, artificial
  Chemically synthesized
guagaugaagucggagau

SEQ ID NO: 24177 - RNA, 18 nt, artificial
  Chemically synthesized
gccauaggcuauacuugg

SEQ ID NO: 24178 - RNA, 18 nt, artificial
  Chemically synthesized
accucgcagugcacaccc

SEQ ID NO: 24179 - RNA, 18 nt, artificial
  Chemically synthesized
agacugcgugcaguucuu

SEQ ID NO: 24180 - RNA, 18 nt, artificial
  Chemically synthesized
acaaucgucgauauuuuc

SEQ ID NO: 24181 - RNA, 18 nt, artificial
  Chemically synthesized
acgucugacagguagcca

SEQ ID NO: 24182 - RNA, 18 nt, artificial
  Chemically synthesized
uuuuaaaaaggcuccucu

SEQ ID NO: 24183 - RNA, 18 nt, artificial
  Chemically synthesized
ggugaagccauugaugcc

SEQ ID NO: 24184 - RNA, 18 nt, artificial
  Chemically synthesized
gugucuccucccuguugu

SEQ ID NO: 24185 - RNA, 18 nt, artificial
  Chemically synthesized
gucgugccaucaugcaug

SEQ ID NO: 24186 - RNA, 18 nt, artificial
  Chemically synthesized
uauugguucggcaccaug

SEQ ID NO: 24187 - RNA, 18 nt, artificial
  Chemically synthesized
uugcaggagccguagugg

SEQ ID NO: 24188 - RNA, 18 nt, artificial
  Chemically synthesized
cacugcaggcugcagacc

SEQ ID NO: 24189 - RNA, 18 nt, artificial
  Chemically synthesized
aagcccucagggaaccag

SEQ ID NO: 24190 - RNA, 18 nt, artificial
  Chemically synthesized
agugcacacccucguagc

SEQ ID NO: 24191 - RNA, 18 nt, artificial
  Chemically synthesized
caagucugacgucccuca

SEQ ID NO: 24192 - RNA, 18 nt, artificial
  Chemically synthesized
cuuguacuccgucagcgu

SEQ ID NO: 24193 - RNA, 18 nt, artificial
  Chemically synthesized
guugcacuggcugucaca

SEQ ID NO: 24194 - RNA, 18 nt, artificial
  Chemically synthesized
ucacaguuggucccacuc

SEQ ID NO: 24195 - RNA, 18 nt, artificial
  Chemically synthesized
gggauugcagucguccac

SEQ ID NO: 24196 - RNA, 18 nt, artificial
  Chemically synthesized
auguugauguuacacaug

SEQ ID NO: 24197 - RNA, 18 nt, artificial
  Chemically synthesized
gugcuggcaguagcugcc

SEQ ID NO: 24198 - RNA, 18 nt, artificial
  Chemically synthesized
acaucucauguuugacau

SEQ ID NO: 24199 - RNA, 18 nt, artificial
  Chemically synthesized
acacucguugacauccug

SEQ ID NO: 24200 - RNA, 18 nt, artificial
  Chemically synthesized
augucgaccucacagguc

SEQ ID NO: 24201 - RNA, 18 nt, artificial
  Chemically synthesized
cgcauugaccauucaaac

SEQ ID NO: 24202 - RNA, 18 nt, artificial
  Chemically synthesized
uaggaaaacccuggcucu

SEQ ID NO: 24203 - RNA, 18 nt, artificial
  Chemically synthesized
uguucuggcaggaugcgc

SEQ ID NO: 24204 - RNA, 18 nt, artificial
  Chemically synthesized
gcuguugcagcccugguc

SEQ ID NO: 24205 - RNA, 18 nt, artificial
  Chemically synthesized
ugggugugggucugccag

SEQ ID NO: 24206 - RNA, 18 nt, artificial
  Chemically synthesized
guugugcaggcuggcgcc

SEQ ID NO: 24207 - RNA, 18 nt, artificial
  Chemically synthesized
aaaggcaguguuucugug

SEQ ID NO: 24208 - RNA, 18 nt, artificial
  Chemically synthesized
ggcacuugcagaugaacc

SEQ ID NO: 24209 - RNA, 18 nt, artificial
  Chemically synthesized
uucugccauaggcuauac

SEQ ID NO: 24210 - RNA, 18 nt, artificial
  Chemically synthesized
ucugugcagucaggcgug

SEQ ID NO: 24211 - RNA, 18 nt, artificial
  Chemically synthesized
uucugguugucguccaug

SEQ ID NO: 24212 - RNA, 18 nt, artificial
  Chemically synthesized
caugcuccgcacagucca

SEQ ID NO: 24213 - RNA, 18 nt, artificial
  Chemically synthesized
gcaagucuccuacaaaac

SEQ ID NO: 24214 - RNA, 18 nt, artificial
  Chemically synthesized
aucguacuggcacagaug

SEQ ID NO: 24215 - RNA, 18 nt, artificial
  Chemically synthesized
cucacuggcaugacacac

SEQ ID NO: 24216 - RNA, 18 nt, artificial
  Chemically synthesized
uuguggcaggugccuccg

SEQ ID NO: 24217 - RNA, 18 nt, artificial
  Chemically synthesized
aacgcacucguugauguc

SEQ ID NO: 24218 - RNA, 18 nt, artificial
  Chemically synthesized
aggucagcggcauccagg

SEQ ID NO: 24219 - RNA, 18 nt, artificial
  Chemically synthesized
cagucauccagguugauc

SEQ ID NO: 24220 - RNA, 18 nt, artificial
  Chemically synthesized
aucucgggcuuggccgcc

SEQ ID NO: 24221 - RNA, 18 nt, artificial
  Chemically synthesized
gcguguugaugcacuugc

SEQ ID NO: 24222 - RNA, 18 nt, artificial
  Chemically synthesized
gaccaaaggacgcagccc

SEQ ID NO: 24223 - RNA, 18 nt, artificial
  Chemically synthesized
aggucugcccuugccagc

SEQ ID NO: 24224 - RNA, 18 nt, artificial
  Chemically synthesized
guacugggugugggucug

SEQ ID NO: 24225 - RNA, 18 nt, artificial
  Chemically synthesized
gugguuguugcacugcag

SEQ ID NO: 24226 - RNA, 18 nt, artificial
  Chemically synthesized
acucuggcgggcagcggc

SEQ ID NO: 24227 - RNA, 18 nt, artificial
  Chemically synthesized
cggucucguagcugcccu

SEQ ID NO: 24228 - RNA, 18 nt, artificial
  Chemically synthesized
guugaucucgcaguuggg

SEQ ID NO: 24229 - RNA, 18 nt, artificial
  Chemically synthesized
cacaguccacacaucuca

SEQ ID NO: 24230 - RNA, 18 nt, artificial
  Chemically synthesized
ucgucuguguugaccucg

SEQ ID NO: 24231 - RNA, 18 nt, artificial
  Chemically synthesized
gauguugaggcugcccag

SEQ ID NO: 24232 - RNA, 18 nt, artificial
  Chemically synthesized
auguuggucuggcaguug

SEQ ID NO: 24233 - RNA, 18 nt, artificial
  Chemically synthesized
ugucacaguuggucccac

SEQ ID NO: 24234 - RNA, 18 nt, artificial
  Chemically synthesized
gcugcagaccuuguugcc

SEQ ID NO: 24235 - RNA, 18 nt, artificial
  Chemically synthesized
cauuuuuucugccauagg

SEQ ID NO: 24236 - RNA, 18 nt, artificial
  Chemically synthesized
gucgucaauacacgugcc

SEQ ID NO: 24237 - RNA, 18 nt, artificial
  Chemically synthesized
uccacguugaucucacag

SEQ ID NO: 24238 - RNA, 18 nt, artificial
  Chemically synthesized
cguacaugaagugcagcu

SEQ ID NO: 24239 - RNA, 18 nt, artificial
  Chemically synthesized
agucggagaugacggccg

SEQ ID NO: 24240 - RNA, 18 nt, artificial
  Chemically synthesized
gacacagccgcaugcagc

SEQ ID NO: 24241 - RNA, 18 nt, artificial
  Chemically synthesized
agaaaccaucuaaaacac

SEQ ID NO: 24242 - RNA, 18 nt, artificial
  Chemically synthesized
acaacagacucauucauu

SEQ ID NO: 24243 - RNA, 18 nt, artificial
  Chemically synthesized
cuucaggagcacaacugc

SEQ ID NO: 24244 - RNA, 18 nt, artificial
  Chemically synthesized
uugcugaugcaugcgucg

SEQ ID NO: 24245 - RNA, 18 nt, artificial
  Chemically synthesized
cacacacagguguaagug

SEQ ID NO: 24246 - RNA, 18 nt, artificial
  Chemically synthesized
agagacugcgugcaguuc

SEQ ID NO: 24247 - RNA, 18 nt, artificial
  Chemically synthesized
ccaagucugacgucccuc

SEQ ID NO: 24248 - RNA, 18 nt, artificial
  Chemically synthesized
gagacgcacucguugacg

SEQ ID NO: 24249 - RNA, 18 nt, artificial
  Chemically synthesized
cguuguuaaagcacuugg

SEQ ID NO: 24250 - RNA, 18 nt, artificial
  Chemically synthesized
cugccuguguagcccgcc

SEQ ID NO: 24251 - RNA, 18 nt, artificial
  Chemically synthesized
uuggucccacuccaccca

SEQ ID NO: 24252 - RNA, 18 nt, artificial
  Chemically synthesized
guguuuuaaaaaggcucc

SEQ ID NO: 24253 - RNA, 18 nt, artificial
  Chemically synthesized
uaggagccgcagccgucc

SEQ ID NO: 24254 - RNA, 18 nt, artificial
  Chemically synthesized
cgguugucaaucuccagg

SEQ ID NO: 24255 - RNA, 18 nt, artificial
  Chemically synthesized
ucacgccaaggugcggcu

SEQ ID NO: 24256 - RNA, 18 nt, artificial
  Chemically synthesized
acacuucccgccauucag

SEQ ID NO: 24257 - RNA, 18 nt, artificial
  Chemically synthesized
ccgucacugaaguacuuc

SEQ ID NO: 24258 - RNA, 18 nt, artificial
  Chemically synthesized
acuggcacucgaaggagc

SEQ ID NO: 24259 - RNA, 18 nt, artificial
  Chemically synthesized
ggaacuucuuggucucca

SEQ ID NO: 24260 - RNA, 18 nt, artificial
  Chemically synthesized
uacugaccuguccacucu

SEQ ID NO: 24261 - RNA, 18 nt, artificial
  Chemically synthesized
acucuuggcauacacacu

SEQ ID NO: 24262 - RNA, 18 nt, artificial
  Chemically synthesized
acgugcccugguucagac

SEQ ID NO: 24263 - RNA, 18 nt, artificial
  Chemically synthesized
agcccucccggcaggugc

SEQ ID NO: 24264 - RNA, 18 nt, artificial
  Chemically synthesized
uugacacaaggguuggau

SEQ ID NO: 24265 - RNA, 18 nt, artificial
  Chemically synthesized
gcucuccacucaggaagc

SEQ ID NO: 24266 - RNA, 18 nt, artificial
  Chemically synthesized
gugcggucugucugguug

SEQ ID NO: 24267 - RNA, 18 nt, artificial
  Chemically synthesized
guuggguccugugguccc

SEQ ID NO: 24268 - RNA, 18 nt, artificial
  Chemically synthesized
cuguuguucugcauaucu

SEQ ID NO: 24269 - RNA, 18 nt, artificial
  Chemically synthesized
agggcuggcuggagcacu

SEQ ID NO: 24270 - RNA, 18 nt, artificial
  Chemically synthesized
ucauugacgcgcugcacg

SEQ ID NO: 24271 - RNA, 18 nt, artificial
  Chemically synthesized
aguugggaccgcugaagc

SEQ ID NO: 24272 - RNA, 18 nt, artificial
  Chemically synthesized
aagcuccggcccaggugg

SEQ ID NO: 24273 - RNA, 18 nt, artificial
  Chemically synthesized
cgucgaugucggucucgc

SEQ ID NO: 24274 - RNA, 18 nt, artificial
  Chemically synthesized
ccguguacccuuccgugc

SEQ ID NO: 24275 - RNA, 18 nt, artificial
  Chemically synthesized
gcggcugcaggcuuugcu

SEQ ID NO: 24276 - RNA, 18 nt, artificial
  Chemically synthesized
aguacugaccuguccacu

SEQ ID NO: 24277 - RNA, 18 nt, artificial
  Chemically synthesized
ucugccauaggcuauacu

SEQ ID NO: 24278 - RNA, 18 nt, artificial
  Chemically synthesized
ggacaggaccaaaggacg

SEQ ID NO: 24279 - RNA, 18 nt, artificial
  Chemically synthesized
cugucuggucguccaggu

SEQ ID NO: 24280 - RNA, 18 nt, artificial
  Chemically synthesized
gacuaugcucguucaacu

SEQ ID NO: 24281 - RNA, 18 nt, artificial
  Chemically synthesized
acacucgugggugacguc

SEQ ID NO: 24282 - RNA, 18 nt, artificial
  Chemically synthesized
acguggcgcccucgaagc

SEQ ID NO: 24283 - RNA, 18 nt, artificial
  Chemically synthesized
gacugcgugcaguucuuc

SEQ ID NO: 24284 - RNA, 18 nt, artificial
  Chemically synthesized
auguugaggcugcccagc

SEQ ID NO: 24285 - RNA, 18 nt, artificial
  Chemically synthesized
aggcauuuggcaucagcu

SEQ ID NO: 24286 - RNA, 18 nt, artificial
  Chemically synthesized
ugcagacacuggcacucg

SEQ ID NO: 24287 - RNA, 18 nt, artificial
  Chemically synthesized
ccuugucgcugcgcagcc

SEQ ID NO: 24288 - RNA, 18 nt, artificial
  Chemically synthesized
ucuuggcauacacacucc

SEQ ID NO: 24289 - RNA, 18 nt, artificial
  Chemically synthesized
gacgcacucguugacguc

SEQ ID NO: 24290 - RNA, 18 nt, artificial
  Chemically synthesized
cagcaggcagcccuugcc

SEQ ID NO: 24291 - RNA, 18 nt, artificial
  Chemically synthesized
acaggucugcccuugcca

SEQ ID NO: 24292 - RNA, 18 nt, artificial
  Chemically synthesized
uggcuggagcacucguug

SEQ ID NO: 24293 - RNA, 18 nt, artificial
  Chemically synthesized
uggcaugacacacaacag

SEQ ID NO: 24294 - RNA, 18 nt, artificial
  Chemically synthesized
caucuacggcguugacgu

SEQ ID NO: 24295 - RNA, 18 nt, artificial
  Chemically synthesized
ucgugaugcaugcgcucc

SEQ ID NO: 24296 - RNA, 18 nt, artificial
  Chemically synthesized
uguguugcuggagcaucu

SEQ ID NO: 24297 - RNA, 18 nt, artificial
  Chemically synthesized
uuccgugcacacacaggu

SEQ ID NO: 24298 - RNA, 18 nt, artificial
  Chemically synthesized
cagguggcgucguucugg

SEQ ID NO: 24299 - RNA, 18 nt, artificial
  Chemically synthesized
uuggcaucugcgcuggcc

SEQ ID NO: 24300 - RNA, 18 nt, artificial
  Chemically synthesized
cggcuccacggucucacu

SEQ ID NO: 24301 - RNA, 18 nt, artificial
  Chemically synthesized
guuguggcaggugccucc

SEQ ID NO: 24302 - RNA, 18 nt, artificial
  Chemically synthesized
ccaccaccagcgugccgg

SEQ ID NO: 24303 - RNA, 18 nt, artificial
  Chemically synthesized
cacuuggcaccauucuug

SEQ ID NO: 24304 - RNA, 18 nt, artificial
  Chemically synthesized
gaucaguggcgucgugcc

SEQ ID NO: 24305 - RNA, 18 nt, artificial
  Chemically synthesized
gcuguugcccgucuccag

SEQ ID NO: 24306 - RNA, 18 nt, artificial
  Chemically synthesized
caaggcuacugugcagcg

SEQ ID NO: 24307 - RNA, 18 nt, artificial
  Chemically synthesized
ccgcguccacacagagcc

SEQ ID NO: 24308 - RNA, 18 nt, artificial
  Chemically synthesized
ugaugacggacucgcagc

SEQ ID NO: 24309 - RNA, 18 nt, artificial
  Chemically synthesized
caccuugugcgucggcag

SEQ ID NO: 24310 - RNA, 18 nt, artificial
  Chemically synthesized
uuguauugguucggcacc

SEQ ID NO: 24311 - RNA, 18 nt, artificial
  Chemically synthesized
uggucuccagguccucgu

SEQ ID NO: 24312 - RNA, 18 nt, artificial
  Chemically synthesized
ucuuugcaggugccgccg

SEQ ID NO: 24313 - RNA, 18 nt, artificial
  Chemically synthesized
uggccgucacugaaguac

SEQ ID NO: 24314 - RNA, 18 nt, artificial
  Chemically synthesized
agcaggagcucucugugc

SEQ ID NO: 24315 - RNA, 18 nt, artificial
  Chemically synthesized
ucauuguuguugauguca

SEQ ID NO: 24316 - RNA, 18 nt, artificial
  Chemically synthesized
gaagcucucauaguccuc

SEQ ID NO: 24317 - RNA, 18 nt, artificial
  Chemically synthesized
aucaauguucucgcugca

SEQ ID NO: 24318 - RNA, 18 nt, artificial
  Chemically synthesized
auggguuggacgcacacu

SEQ ID NO: 24319 - RNA, 18 nt, artificial
  Chemically synthesized
uacccggcaacgucguca

SEQ ID NO: 24320 - RNA, 18 nt, artificial
  Chemically synthesized
agcggcacuuguacuccg

SEQ ID NO: 24321 - RNA, 18 nt, artificial
  Chemically synthesized
agaagcacaaaggcggcc

SEQ ID NO: 24322 - RNA, 18 nt, artificial
  Chemically synthesized
uccgcgcuguugcagccc

SEQ ID NO: 24323 - RNA, 18 nt, artificial
  Chemically synthesized
caucagagcgugaguagc

SEQ ID NO: 24324 - RNA, 18 nt, artificial
  Chemically synthesized
augauugguaccaugggu

SEQ ID NO: 24325 - RNA, 18 nt, artificial
  Chemically synthesized
gaucuuguccagacaggu

SEQ ID NO: 24326 - RNA, 18 nt, artificial
  Chemically synthesized
gucucaccgggcugggag

SEQ ID NO: 24327 - RNA, 18 nt, artificial
  Chemically synthesized
acacucgcaguagaagga

SEQ ID NO: 24328 - RNA, 18 nt, artificial
  Chemically synthesized
ucccuucuccaacaucau

SEQ ID NO: 24329 - RNA, 18 nt, artificial
  Chemically synthesized
uucagacauggguuggac

SEQ ID NO: 24330 - RNA, 18 nt, artificial
  Chemically synthesized
cugcuggagcccaggacg

SEQ ID NO: 24331 - RNA, 18 nt, artificial
  Chemically synthesized
acguugaucucacagugc

SEQ ID NO: 24332 - RNA, 18 nt, artificial
  Chemically synthesized
acccagcgagcacucauc

SEQ ID NO: 24333 - RNA, 18 nt, artificial
  Chemically synthesized
ucguugaugucgaccuca

SEQ ID NO: 24334 - RNA, 18 nt, artificial
  Chemically synthesized
guggaucccgcugaagcc

SEQ ID NO: 24335 - RNA, 18 nt, artificial
  Chemically synthesized
gucuccuacaaaacacgg

SEQ ID NO: 24336 - RNA, 18 nt, artificial
  Chemically synthesized
cguucuugcaguuguuuc

SEQ ID NO: 24337 - RNA, 18 nt, artificial
  Chemically synthesized
ugaccagcacggcacucg

SEQ ID NO: 24338 - RNA, 18 nt, artificial
  Chemically synthesized
uggcugcacgucugccug

SEQ ID NO: 24339 - RNA, 18 nt, artificial
  Chemically synthesized
acguagccacuggucaug

SEQ ID NO: 24340 - RNA, 18 nt, artificial
  Chemically synthesized
acacucgucuguguugac

SEQ ID NO: 24341 - RNA, 18 nt, artificial
  Chemically synthesized
ccugggacuucuuccucc

SEQ ID NO: 24342 - RNA, 18 nt, artificial
  Chemically synthesized
guccaggcacuuggcacc

SEQ ID NO: 24343 - RNA, 18 nt, artificial
  Chemically synthesized
uugaggcagcgcaggcug

SEQ ID NO: 24344 - RNA, 18 nt, artificial
  Chemically synthesized
gugggaccagcgaggaug

SEQ ID NO: 24345 - RNA, 18 nt, artificial
  Chemically synthesized
uuggcauacacacuccga

SEQ ID NO: 24346 - RNA, 18 nt, artificial
  Chemically synthesized
aggugcacacguagccac

SEQ ID NO: 24347 - RNA, 18 nt, artificial
  Chemically synthesized
cccacuccacccaggguc

SEQ ID NO: 24348 - RNA, 18 nt, artificial
  Chemically synthesized
agcgagcacucauccacg

SEQ ID NO: 24349 - RNA, 18 nt, artificial
  Chemically synthesized
acgcacucguugaugucg

SEQ ID NO: 24350 - RNA, 18 nt, artificial
  Chemically synthesized
cuuguacccguugaggcu

SEQ ID NO: 24351 - RNA, 18 nt, artificial
  Chemically synthesized
acugcagagacugcgugc

SEQ ID NO: 24352 - RNA, 18 nt, artificial
  Chemically synthesized
cucuggaagcacugcgag

SEQ ID NO: 24353 - RNA, 18 nt, artificial
  Chemically synthesized
uacugggugugggucugc

SEQ ID NO: 24354 - RNA, 18 nt, artificial
  Chemically synthesized
acugccgguugucaaucu

SEQ ID NO: 24355 - RNA, 18 nt, artificial
  Chemically synthesized
ucucugugcagucaggcg

SEQ ID NO: 24356 - RNA, 18 nt, artificial
  Chemically synthesized
ucaucgauguccaccucg

SEQ ID NO: 24357 - RNA, 18 nt, artificial
  Chemically synthesized
agaccugugcggccaugg

SEQ ID NO: 24358 - RNA, 18 nt, artificial
  Chemically synthesized
gucgcacucauugacauc

SEQ ID NO: 24359 - RNA, 18 nt, artificial
  Chemically synthesized
auccacauuguucacggc

SEQ ID NO: 24360 - RNA, 18 nt, artificial
  Chemically synthesized
gcgucaggaacugggcug

SEQ ID NO: 24361 - RNA, 18 nt, artificial
  Chemically synthesized
uuuuuggacuaugcucgu

SEQ ID NO: 24362 - RNA, 18 nt, artificial
  Chemically synthesized
cgucugacagguagccau

SEQ ID NO: 24363 - RNA, 18 nt, artificial
  Chemically synthesized
acuccgucagcgugagca

SEQ ID NO: 24364 - RNA, 18 nt, artificial
  Chemically synthesized
cucguugacgucgaucuc

SEQ ID NO: 24365 - RNA, 18 nt, artificial
  Chemically synthesized
cauuuggcaucagcuggc

SEQ ID NO: 24366 - RNA, 18 nt, artificial
  Chemically synthesized
gucuccagguccucgucc

SEQ ID NO: 24367 - RNA, 18 nt, artificial
  Chemically synthesized
uguugcuggagcaucuuc

SEQ ID NO: 24368 - RNA, 18 nt, artificial
  Chemically synthesized
gugggagaggcacucguc

SEQ ID NO: 24369 - RNA, 18 nt, artificial
  Chemically synthesized
agugguccagcagcaccu

SEQ ID NO: 24370 - RNA, 18 nt, artificial
  Chemically synthesized
augcagaugcacuggaac

SEQ ID NO: 24371 - RNA, 18 nt, artificial
  Chemically synthesized
acaguacugaccugucca

SEQ ID NO: 24372 - RNA, 18 nt, artificial
  Chemically synthesized
ugagguccuccagcaugc

SEQ ID NO: 24373 - RNA, 18 nt, artificial
  Chemically synthesized
cuguuguucugcauaucu

SEQ ID NO: 24374 - RNA, 18 nt, artificial
  Chemically synthesized
uacaaaacacgggagccc

SEQ ID NO: 24375 - RNA, 18 nt, artificial
  Chemically synthesized
ugggagaggcacucgucg

SEQ ID NO: 24376 - RNA, 18 nt, artificial
  Chemically synthesized
aggcuggcgcccugguag

SEQ ID NO: 24377 - RNA, 18 nt, artificial
  Chemically synthesized
caccuugucgcugcgcag

SEQ ID NO: 24378 - RNA, 18 nt, artificial
  Chemically synthesized
augccgcucugcagccgg

SEQ ID NO: 24379 - RNA, 18 nt, artificial
  Chemically synthesized
cagacucauucauuaaga

SEQ ID NO: 24380 - RNA, 18 nt, artificial
  Chemically synthesized
gagcacucauccacgucc

SEQ ID NO: 24381 - RNA, 18 nt, artificial
  Chemically synthesized
agaggcacucgucgaucu

SEQ ID NO: 24382 - RNA, 18 nt, artificial
  Chemically synthesized
gguccagcucccuccgcc

SEQ ID NO: 24383 - RNA, 18 nt, artificial
  Chemically synthesized
uguuguggcaggucccgc

SEQ ID NO: 24384 - RNA, 18 nt, artificial
  Chemically synthesized
uacuccgucagcgugagc

SEQ ID NO: 24385 - RNA, 18 nt, artificial
  Chemically synthesized
gcuauacuugguauugca

SEQ ID NO: 24386 - RNA, 18 nt, artificial
  Chemically synthesized
aaggcuccucuggucggc

SEQ ID NO: 24387 - RNA, 18 nt, artificial
  Chemically synthesized
uguccacgcaguccgugc

SEQ ID NO: 24388 - RNA, 18 nt, artificial
  Chemically synthesized
gucccacucgcacuccgc

SEQ ID NO: 24389 - RNA, 18 nt, artificial
  Chemically synthesized
aagcaggagcucucugug

SEQ ID NO: 24390 - RNA, 18 nt, artificial
  Chemically synthesized
ugagccagcuuugccucc

SEQ ID NO: 24391 - RNA, 18 nt, artificial
  Chemically synthesized
ucccacucgcacuccgcg

SEQ ID NO: 24392 - RNA, 18 nt, artificial
  Chemically synthesized
acagccacucgcauugac

SEQ ID NO: 24393 - RNA, 18 nt, artificial
  Chemically synthesized
ggcuccacggucucacuc

SEQ ID NO: 24394 - RNA, 18 nt, artificial
  Chemically synthesized
gcaccuuggcggucucgu

SEQ ID NO: 24395 - RNA, 18 nt, artificial
  Chemically synthesized
caggugcaaggcggucuc

SEQ ID NO: 24396 - RNA, 18 nt, artificial
  Chemically synthesized
uugcacucauugaccuca

SEQ ID NO: 24397 - RNA, 18 nt, artificial
  Chemically synthesized
cacuugcagaugaacccg

SEQ ID NO: 24398 - RNA, 18 nt, artificial
  Chemically synthesized
ugcacacguagccacugg

SEQ ID NO: 24399 - RNA, 18 nt, artificial
  Chemically synthesized
cggcugaguugcacuggc

SEQ ID NO: 24400 - RNA, 18 nt, artificial
  Chemically synthesized
agaacgcacucguugaug

SEQ ID NO: 24401 - RNA, 18 nt, artificial
  Chemically synthesized
ucggucucgcaguugcgc

SEQ ID NO: 24402 - RNA, 18 nt, artificial
  Chemically synthesized
gcaccagguuguacucgu

SEQ ID NO: 24403 - RNA, 18 nt, artificial
  Chemically synthesized
cuggcugucacaguggcc

SEQ ID NO: 24404 - RNA, 18 nt, artificial
  Chemically synthesized
aucugggacugcaugcug

SEQ ID NO: 24405 - RNA, 18 nt, artificial
  Chemically synthesized
uagcugcccgugaagccg

SEQ ID NO: 24406 - RNA, 18 nt, artificial
  Chemically synthesized
augucggucucgcaguug

SEQ ID NO: 24407 - RNA, 18 nt, artificial
  Chemically synthesized
cgcacuccgcgcuguugc

SEQ ID NO: 24408 - RNA, 18 nt, artificial
  Chemically synthesized
guaaguguuggguccguc

SEQ ID NO: 24409 - RNA, 18 nt, artificial
  Chemically synthesized
cagagcgcacacagacgc

SEQ ID NO: 24410 - RNA, 18 nt, artificial
  Chemically synthesized
ggucugucugguugugca

SEQ ID NO: 24411 - RNA, 18 nt, artificial
  Chemically synthesized
ucgcaguagaaggaggcc

SEQ ID NO: 24412 - RNA, 18 nt, artificial
  Chemically synthesized
guagcugcccgugaagcc

SEQ ID NO: 24413 - RNA, 18 nt, artificial
  Chemically synthesized
agcuggccaugcugccgc

SEQ ID NO: 24414 - RNA, 18 nt, artificial
  Chemically synthesized
gcacucgcacuggaacuc

SEQ ID NO: 24415 - RNA, 18 nt, artificial
  Chemically synthesized
agcaugcccuccacggcc

SEQ ID NO: 24416 - RNA, 18 nt, artificial
  Chemically synthesized
cggcucacaggcacacuc

SEQ ID NO: 24417 - RNA, 18 nt, artificial
  Chemically synthesized
gcacagucaucaauguuc

SEQ ID NO: 24418 - RNA, 18 nt, artificial
  Chemically synthesized
cuccgugcagcugcgggc

SEQ ID NO: 24419 - RNA, 18 nt, artificial
  Chemically synthesized
uugaggcugcccagguag

SEQ ID NO: 24420 - RNA, 18 nt, artificial
  Chemically synthesized
gcgcucccaggaaugcgg

SEQ ID NO: 24421 - RNA, 18 nt, artificial
  Chemically synthesized
auccgcgugcggaaggug

SEQ ID NO: 24422 - RNA, 18 nt, artificial
  Chemically synthesized
cagcgagcacucauccac

SEQ ID NO: 24423 - RNA, 18 nt, artificial
  Chemically synthesized
cgcaguucugggugccac

SEQ ID NO: 24424 - RNA, 18 nt, artificial
  Chemically synthesized
ggucuggcaguugggacc

SEQ ID NO: 24425 - RNA, 18 nt, artificial
  Chemically synthesized
cugcuggagcccaggacg

SEQ ID NO: 24426 - RNA, 18 nt, artificial
  Chemically synthesized
cuggcacagucauccagg

SEQ ID NO: 24427 - RNA, 18 nt, artificial
  Chemically synthesized
aagucggagaugacggcc

SEQ ID NO: 24428 - RNA, 18 nt, artificial
  Chemically synthesized
uccuccucacagaaagug

SEQ ID NO: 24429 - RNA, 18 nt, artificial
  Chemically synthesized
caggcaggugguugaggg

SEQ ID NO: 24430 - RNA, 18 nt, artificial
  Chemically synthesized
aggaacugggcugcgguc

SEQ ID NO: 24431 - RNA, 18 nt, artificial
  Chemically synthesized
uguggugguggugguggc

SEQ ID NO: 24432 - RNA, 18 nt, artificial
  Chemically synthesized
ucguagccaucgaucuug

SEQ ID NO: 24433 - RNA, 18 nt, artificial
  Chemically synthesized
uugggacgcaucugguca

SEQ ID NO: 24434 - RNA, 18 nt, artificial
  Chemically synthesized
cagugaaauucagggccc

SEQ ID NO: 24435 - RNA, 18 nt, artificial
  Chemically synthesized
uggcaggcaggcacacuc

SEQ ID NO: 24436 - RNA, 18 nt, artificial
  Chemically synthesized
uuggugugcagcacgcgg

SEQ ID NO: 24437 - RNA, 18 nt, artificial
  Chemically synthesized
uggccuuccgcacgcugg

SEQ ID NO: 24438 - RNA, 18 nt, artificial
  Chemically synthesized
guucugcugcugcaucug

SEQ ID NO: 24439 - RNA, 18 nt, artificial
  Chemically synthesized
gaugcagcuucuccuaac

SEQ ID NO: 24440 - RNA, 18 nt, artificial
  Chemically synthesized
acggacggagacugcugg

SEQ ID NO: 24441 - RNA, 18 nt, artificial
  Chemically synthesized
aggcaggcauuguccagg

SEQ ID NO: 24442 - RNA, 18 nt, artificial
  Chemically synthesized
uggcugucacaguggccg

SEQ ID NO: 24443 - RNA, 18 nt, artificial
  Chemically synthesized
cacgucgcaguaaaggcc

SEQ ID NO: 24444 - RNA, 18 nt, artificial
  Chemically synthesized
acgcacacucguugaugu

SEQ ID NO: 24445 - RNA, 18 nt, artificial
  Chemically synthesized
caucgugcuggcaguagc

SEQ ID NO: 24446 - RNA, 18 nt, artificial
  Chemically synthesized
cacgcaguuguagccacc

SEQ ID NO: 24447 - RNA, 18 nt, artificial
  Chemically synthesized
aguaaaggccgguccagc

SEQ ID NO: 24448 - RNA, 18 nt, artificial
  Chemically synthesized
aggccacggcgcaggugc

SEQ ID NO: 24449 - RNA, 18 nt, artificial
  Chemically synthesized
uggagcacucguugaugu

SEQ ID NO: 24450 - RNA, 18 nt, artificial
  Chemically synthesized
cgccguggguguucuggc

SEQ ID NO: 24451 - RNA, 18 nt, artificial
  Chemically synthesized
acucgaaggagcccagcg

SEQ ID NO: 24452 - RNA, 18 nt, artificial
  Chemically synthesized
uugcuggagcaucuucuu

SEQ ID NO: 24453 - RNA, 18 nt, artificial
  Chemically synthesized
gucugucugguugugcag

SEQ ID NO: 24454 - RNA, 18 nt, artificial
  Chemically synthesized
gcaguucugggugccacg

SEQ ID NO: 24455 - RNA, 18 nt, artificial
  Chemically synthesized
gugcacacccucguagcc

SEQ ID NO: 24456 - RNA, 18 nt, artificial
  Chemically synthesized
ugugagucgcacucauug

SEQ ID NO: 24457 - RNA, 18 nt, artificial
  Chemically synthesized
agggcugugagucgcacu

SEQ ID NO: 24458 - RNA, 18 nt, artificial
  Chemically synthesized
caacaucuaacccauaug

SEQ ID NO: 24459 - RNA, 18 nt, artificial
  Chemically synthesized
cugccuggcucggcucuc

SEQ ID NO: 24460 - RNA, 18 nt, artificial
  Chemically synthesized
ugcgguccaccacguggc

SEQ ID NO: 24461 - RNA, 18 nt, artificial
  Chemically synthesized
gggcucagaacgcacucg

SEQ ID NO: 24462 - RNA, 18 nt, artificial
  Chemically synthesized
aaggacgcagcccacggc

SEQ ID NO: 24463 - RNA, 18 nt, artificial
  Chemically synthesized
caaauuaauccgcgugcg

SEQ ID NO: 24464 - RNA, 18 nt, artificial
  Chemically synthesized
acgcggcugagcucccgc

SEQ ID NO: 24465 - RNA, 18 nt, artificial
  Chemically synthesized
agccacucgcauugacca

SEQ ID NO: 24466 - RNA, 18 nt, artificial
  Chemically synthesized
ggcacucgucgaucuccu

SEQ ID NO: 24467 - RNA, 18 nt, artificial
  Chemically synthesized
ucgcacuccgcgcuguug

SEQ ID NO: 24468 - RNA, 18 nt, artificial
  Chemically synthesized
uugauguccuccucacag

SEQ ID NO: 24469 - RNA, 18 nt, artificial
  Chemically synthesized
agguugaucucgcaguug

SEQ ID NO: 24470 - RNA, 18 nt, artificial
  Chemically synthesized
guugggcgagcagagcgg

SEQ ID NO: 24471 - RNA, 18 nt, artificial
  Chemically synthesized
uugaucucacagugcaca

SEQ ID NO: 24472 - RNA, 18 nt, artificial
  Chemically synthesized
acaggagaagcucucaua

SEQ ID NO: 24473 - RNA, 18 nt, artificial
  Chemically synthesized
ucugaagcguucuucagg

SEQ ID NO: 24474 - RNA, 18 nt, artificial
  Chemically synthesized
cacucauucugguugucg

SEQ ID NO: 24475 - RNA, 18 nt, artificial
  Chemically synthesized
cugccauaggcuauacuu

SEQ ID NO: 24476 - RNA, 18 nt, artificial
  Chemically synthesized
uugcacagcucaaugugc

SEQ ID NO: 24477 - RNA, 18 nt, artificial
  Chemically synthesized
uucuugcagggcgaggag

SEQ ID NO: 24478 - RNA, 18 nt, artificial
  Chemically synthesized
accaaaggacgcagccca

SEQ ID NO: 24479 - RNA, 18 nt, artificial
  Chemically synthesized
gcuccgcacaguccagcc

SEQ ID NO: 24480 - RNA, 18 nt, artificial
  Chemically synthesized
gcugcuggauguuugcug

SEQ ID NO: 24481 - RNA, 18 nt, artificial
  Chemically synthesized
aggcugcagaccuuguug

SEQ ID NO: 24482 - RNA, 18 nt, artificial
  Chemically synthesized
uggcugcagguucugcug

SEQ ID NO: 24483 - RNA, 18 nt, artificial
  Chemically synthesized
auucaugauugguaccau

SEQ ID NO: 24484 - RNA, 18 nt, artificial
  Chemically synthesized
ucagaacgcacucguuga

SEQ ID NO: 24485 - RNA, 18 nt, artificial
  Chemically synthesized
ccguguugaugccgucug

SEQ ID NO: 24486 - RNA, 18 nt, artificial
  Chemically synthesized
acugugcaggcugaggug

SEQ ID NO: 24487 - RNA, 18 nt, artificial
  Chemically synthesized
ugucuggucguccagguc

SEQ ID NO: 24488 - RNA, 18 nt, artificial
  Chemically synthesized
accauucaaacuggugga

SEQ ID NO: 24489 - RNA, 18 nt, artificial
  Chemically synthesized
ugggugagcacucgucca

SEQ ID NO: 24490 - RNA, 18 nt, artificial
  Chemically synthesized
ucgguuccggaucaggau

SEQ ID NO: 24491 - RNA, 18 nt, artificial
  Chemically synthesized
gcguguuguucucacagu

SEQ ID NO: 24492 - RNA, 18 nt, artificial
  Chemically synthesized
gacuugcccaggucaucu

SEQ ID NO: 24493 - RNA, 18 nt, artificial
  Chemically synthesized
aaaggcuccucuggucgg

SEQ ID NO: 24494 - RNA, 18 nt, artificial
  Chemically synthesized
auuuucacaagcaugcuu

SEQ ID NO: 24495 - RNA, 18 nt, artificial
  Chemically synthesized
agcuuugccuccguuugc

SEQ ID NO: 24496 - RNA, 18 nt, artificial
  Chemically synthesized
guuguggcaggucccgcc

SEQ ID NO: 24497 - RNA, 18 nt, artificial
  Chemically synthesized
aguacuuccagcacugca

SEQ ID NO: 24498 - RNA, 18 nt, artificial
  Chemically synthesized
gggauggcaccacgcggc

SEQ ID NO: 24499 - RNA, 18 nt, artificial
  Chemically synthesized
uaauccgcgugcggaagg

SEQ ID NO: 24500 - RNA, 18 nt, artificial
  Chemically synthesized
accaggugaggcugggug

SEQ ID NO: 24501 - RNA, 18 nt, artificial
  Chemically synthesized
augccggagcuguccagc

SEQ ID NO: 24502 - RNA, 18 nt, artificial
  Chemically synthesized
uguuguugaugucacagu

SEQ ID NO: 24503 - RNA, 18 nt, artificial
  Chemically synthesized
ugcaugggcggcuaaggc

SEQ ID NO: 24504 - RNA, 18 nt, artificial
  Chemically synthesized
cucgcagcgguacugggu

SEQ ID NO: 24505 - RNA, 18 nt, artificial
  Chemically synthesized
gaguugaugagguccucc

SEQ ID NO: 24506 - RNA, 18 nt, artificial
  Chemically synthesized
auacugaaccugaaacaa

SEQ ID NO: 24507 - RNA, 18 nt, artificial
  Chemically synthesized
gggacugcaugcuggugg

SEQ ID NO: 24508 - RNA, 18 nt, artificial
  Chemically synthesized
uguguugaccucgcagug

SEQ ID NO: 24509 - RNA, 18 nt, artificial
  Chemically synthesized
ucauugaucuuguccagg

SEQ ID NO: 24510 - RNA, 18 nt, artificial
  Chemically synthesized
ugugcaggcugaggugcu

SEQ ID NO: 24511 - RNA, 18 nt, artificial
  Chemically synthesized
cacuggcugucacagugg

SEQ ID NO: 24512 - RNA, 18 nt, artificial
  Chemically synthesized
agacauuuuuucugccau

SEQ ID NO: 24513 - RNA, 18 nt, artificial
  Chemically synthesized
caguuguagguguucacg

SEQ ID NO: 24514 - RNA, 18 nt, artificial
  Chemically synthesized
gccggagaugcaugugcc

SEQ ID NO: 24515 - RNA, 18 nt, artificial
  Chemically synthesized
aguccgugcaguuggccc

SEQ ID NO: 24516 - RNA, 18 nt, artificial
  Chemically synthesized
gcauaucuuuguuagccc

SEQ ID NO: 24517 - RNA, 18 nt, artificial
  Chemically synthesized
ccgucgcugaaguggucc

SEQ ID NO: 24518 - RNA, 18 nt, artificial
  Chemically synthesized
aguccucaccaguccagc

SEQ ID NO: 24519 - RNA, 18 nt, artificial
  Chemically synthesized
caccuuggcggucucgua

SEQ ID NO: 24520 - RNA, 18 nt, artificial
  Chemically synthesized
cauaggcuauacuuggua

SEQ ID NO: 24521 - RNA, 18 nt, artificial
  Chemically synthesized
ucugcgcuggccuccagc

SEQ ID NO: 24522 - RNA, 18 nt, artificial
  Chemically synthesized
aaacccuggcucucagaa

SEQ ID NO: 24523 - RNA, 18 nt, artificial
  Chemically synthesized
cucguccacaucguacug

SEQ ID NO: 24524 - RNA, 18 nt, artificial
  Chemically synthesized
ugcacgucugccuggcuc

SEQ ID NO: 24525 - RNA, 18 nt, artificial
  Chemically synthesized
cuggcacagucauccagg

SEQ ID NO: 24526 - RNA, 18 nt, artificial
  Chemically synthesized
gucaauacacgugcccug

SEQ ID NO: 24527 - RNA, 18 nt, artificial
  Chemically synthesized
caguuccucauguagauc

SEQ ID NO: 24528 - RNA, 18 nt, artificial
  Chemically synthesized
accugcugggucugcacc

SEQ ID NO: 24529 - RNA, 18 nt, artificial
  Chemically synthesized
gugccaucaugcaugcgg

SEQ ID NO: 24530 - RNA, 18 nt, artificial
  Chemically synthesized
ucgcacgccuccucgauc

SEQ ID NO: 24531 - RNA, 18 nt, artificial
  Chemically synthesized
cgcgcugcacgcaguucu

SEQ ID NO: 24532 - RNA, 18 nt, artificial
  Chemically synthesized
uggcacucguccacaucc

SEQ ID NO: 24533 - RNA, 18 nt, artificial
  Chemically synthesized
ugcagagacugcgugcag

SEQ ID NO: 24534 - RNA, 18 nt, artificial
  Chemically synthesized
ucuugggacgcaucuggu

SEQ ID NO: 24535 - RNA, 18 nt, artificial
  Chemically synthesized
gcuccugugcgaugucgc

SEQ ID NO: 24536 - RNA, 18 nt, artificial
  Chemically synthesized
gcgucaaccucacccugg

SEQ ID NO: 24537 - RNA, 18 nt, artificial
  Chemically synthesized
ucuaaaacacauggcaac

SEQ ID NO: 24538 - RNA, 18 nt, artificial
  Chemically synthesized
cagggcuugccuuugcag

SEQ ID NO: 24539 - RNA, 18 nt, artificial
  Chemically synthesized
uuguccagacaggugccc

SEQ ID NO: 24540 - RNA, 18 nt, artificial
  Chemically synthesized
ucccggcguucuugcagg

SEQ ID NO: 24541 - RNA, 18 nt, artificial
  Chemically synthesized
uugcaggaguagccgccc

SEQ ID NO: 24542 - RNA, 18 nt, artificial
  Chemically synthesized
cucgcuguugcccgucuc

SEQ ID NO: 24543 - RNA, 18 nt, artificial
  Chemically synthesized
auaggcuauacuugguau

SEQ ID NO: 24544 - RNA, 18 nt, artificial
  Chemically synthesized
acuucccgccauucaggc

SEQ ID NO: 24545 - RNA, 18 nt, artificial
  Chemically synthesized
caguggugcguguugccc

SEQ ID NO: 24546 - RNA, 18 nt, artificial
  Chemically synthesized
aggcaggcacacucgugg

SEQ ID NO: 24547 - RNA, 18 nt, artificial
  Chemically synthesized
accuucuugcccugcacg

SEQ ID NO: 24548 - RNA, 18 nt, artificial
  Chemically synthesized
aucuggaagacaccuugu

SEQ ID NO: 24549 - RNA, 18 nt, artificial
  Chemically synthesized
gucacugaaguacuucca

SEQ ID NO: 24550 - RNA, 18 nt, artificial
  Chemically synthesized
ugcagggcggacuugccc

SEQ ID NO: 24551 - RNA, 18 nt, artificial
  Chemically synthesized
ucgauguccaccucgcag

SEQ ID NO: 24552 - RNA, 18 nt, artificial
  Chemically synthesized
ggacauugacguccaugc

SEQ ID NO: 24553 - RNA, 18 nt, artificial
  Chemically synthesized
guuuuguggcugcaccug

SEQ ID NO: 24554 - RNA, 18 nt, artificial
  Chemically synthesized
augccaugcugcagggag

SEQ ID NO: 24555 - RNA, 18 nt, artificial
  Chemically synthesized
cucucagaacuugcuugu

SEQ ID NO: 24556 - RNA, 18 nt, artificial
  Chemically synthesized
cacucgugggugacgucg

SEQ ID NO: 24557 - RNA, 18 nt, artificial
  Chemically synthesized
ugguugucguccaugagg

SEQ ID NO: 24558 - RNA, 18 nt, artificial
  Chemically synthesized
uacccguugaggcugucc

SEQ ID NO: 24559 - RNA, 18 nt, artificial
  Chemically synthesized
uugcagggcuugccuuug

SEQ ID NO: 24560 - RNA, 18 nt, artificial
  Chemically synthesized
agggcuggagacgcccuc

SEQ ID NO: 24561 - RNA, 18 nt, artificial
  Chemically synthesized
ucugucuggucguccagg

SEQ ID NO: 24562 - RNA, 18 nt, artificial
  Chemically synthesized
agugcacacccugagugc

SEQ ID NO: 24563 - RNA, 18 nt, artificial
  Chemically synthesized
aacugggcugcggucacg

SEQ ID NO: 24564 - RNA, 18 nt, artificial
  Chemically synthesized
agugcagggcggacuugc

SEQ ID NO: 24565 - RNA, 18 nt, artificial
  Chemically synthesized
uuguagguguucacgccg

SEQ ID NO: 24566 - RNA, 18 nt, artificial
  Chemically synthesized
cucccggcaggugcacac

SEQ ID NO: 24567 - RNA, 18 nt, artificial
  Chemically synthesized
acgucgguggcacucugg

SEQ ID NO: 24568 - RNA, 18 nt, artificial
  Chemically synthesized
cuggauguuugcuggcug

SEQ ID NO: 24569 - RNA, 18 nt, artificial
  Chemically synthesized
ucaucaucugggacaggg

SEQ ID NO: 24570 - RNA, 18 nt, artificial
  Chemically synthesized
aguugaugccguccacgc

SEQ ID NO: 24571 - RNA, 18 nt, artificial
  Chemically synthesized
uaggcguugucgcggucc

SEQ ID NO: 24572 - RNA, 18 nt, artificial
  Chemically synthesized
uuccagcacugcagagac

SEQ ID NO: 24573 - RNA, 18 nt, artificial
  Chemically synthesized
ugccuugagguccuuggc

SEQ ID NO: 24574 - RNA, 18 nt, artificial
  Chemically synthesized
ggcucuggcaagucuccu

SEQ ID NO: 24575 - RNA, 18 nt, artificial
  Chemically synthesized
uucgagacgcacucguug

SEQ ID NO: 24576 - RNA, 18 nt, artificial
  Chemically synthesized
ucguugauguuggucucg

SEQ ID NO: 24577 - RNA, 18 nt, artificial
  Chemically synthesized
gcaaauuaauccgcgugc

SEQ ID NO: 24578 - RNA, 18 nt, artificial
  Chemically synthesized
guugaucucacagugcac

SEQ ID NO: 24579 - RNA, 18 nt, artificial
  Chemically synthesized
aggcaagugccacagucc

SEQ ID NO: 24580 - RNA, 18 nt, artificial
  Chemically synthesized
aguggugcguguugcccg

SEQ ID NO: 24581 - RNA, 18 nt, artificial
  Chemically synthesized
ucugucugguugugcagg

SEQ ID NO: 24582 - RNA, 18 nt, artificial
  Chemically synthesized
gcaguagaaggaggccac

SEQ ID NO: 24583 - RNA, 18 nt, artificial
  Chemically synthesized
gucugccagcauuugccg

SEQ ID NO: 24584 - RNA, 18 nt, artificial
  Chemically synthesized
cugagccaagucugacgu

SEQ ID NO: 24585 - RNA, 18 nt, artificial
  Chemically synthesized
cuccguggcggcaaagcc

SEQ ID NO: 24586 - RNA, 18 nt, artificial
  Chemically synthesized
cccaggucaucuacggcg

SEQ ID NO: 24587 - RNA, 18 nt, artificial
  Chemically synthesized
agccgcccagguaguccg

SEQ ID NO: 24588 - RNA, 18 nt, artificial
  Chemically synthesized
cgucgaagaggcagccgg

SEQ ID NO: 24589 - RNA, 18 nt, artificial
  Chemically synthesized
uguaggaggccucgaagg

SEQ ID NO: 24590 - RNA, 18 nt, artificial
  Chemically synthesized
agcacgcggcugagcucc

SEQ ID NO: 24591 - RNA, 18 nt, artificial
  Chemically synthesized
uggcgucguucuggcacg

SEQ ID NO: 24592 - RNA, 18 nt, artificial
  Chemically synthesized
ucucgcccgugcggucug

SEQ ID NO: 24593 - RNA, 18 nt, artificial
  Chemically synthesized
uuggacaggcacucguug

SEQ ID NO: 24594 - RNA, 18 nt, artificial
  Chemically synthesized
auugaaguugagggagca

SEQ ID NO: 24595 - RNA, 18 nt, artificial
  Chemically synthesized
aaguacuuccagcacugc

SEQ ID NO: 24596 - RNA, 18 nt, artificial
  Chemically synthesized
gcagcaaggcuacugugc

SEQ ID NO: 24597 - RNA, 18 nt, artificial
  Chemically synthesized
ucucacucugcacggccu

SEQ ID NO: 24598 - RNA, 18 nt, artificial
  Chemically synthesized
cuggcacagucaucaaug

SEQ ID NO: 24599 - RNA, 18 nt, artificial
  Chemically synthesized
cugaguccacugccggug

SEQ ID NO: 24600 - RNA, 18 nt, artificial
  Chemically synthesized
agagcccguugaauuugg

SEQ ID NO: 24601 - RNA, 18 nt, artificial
  Chemically synthesized
uuucccugaccagccggg

SEQ ID NO: 24602 - RNA, 18 nt, artificial
  Chemically synthesized
uggaaggagcuguugcgc

SEQ ID NO: 24603 - RNA, 18 nt, artificial
  Chemically synthesized
caugcgucguugaggugg

SEQ ID NO: 24604 - RNA, 18 nt, artificial
  Chemically synthesized
gguguucuggcaggaugc

SEQ ID NO: 24605 - RNA, 18 nt, artificial
  Chemically synthesized
cauagucugccacgccuc

SEQ ID NO: 24606 - RNA, 18 nt, artificial
  Chemically synthesized
guggcugcaccugcuggg

SEQ ID NO: 24607 - RNA, 18 nt, artificial
  Chemically synthesized
cucacgccaaggugcggc

SEQ ID NO: 24608 - RNA, 18 nt, artificial
  Chemically synthesized
ucguagcugcccucccgg

SEQ ID NO: 24609 - RNA, 18 nt, artificial
  Chemically synthesized
ucacgcuugaagaccacg

SEQ ID NO: 24610 - RNA, 18 nt, artificial
  Chemically synthesized
ucagaacuugcuuguuuu

SEQ ID NO: 24611 - RNA, 18 nt, artificial
  Chemically synthesized
cuggcacacucgucugug

SEQ ID NO: 24612 - RNA, 18 nt, artificial
  Chemically synthesized
uugaucucgcaguugggu

SEQ ID NO: 24613 - RNA, 18 nt, artificial
  Chemically synthesized
ucaucuacggcguugacg

SEQ ID NO: 24614 - RNA, 18 nt, artificial
  Chemically synthesized
ugccguuguuaaagcacu

SEQ ID NO: 24615 - RNA, 18 nt, artificial
  Chemically synthesized
aguagaaggaggccacac

SEQ ID NO: 24616 - RNA, 18 nt, artificial
  Chemically synthesized
accuguguagggcagcag

SEQ ID NO: 24617 - RNA, 18 nt, artificial
  Chemically synthesized
uccacucaggaagcuccg

SEQ ID NO: 24618 - RNA, 18 nt, artificial
  Chemically synthesized
cgucaggaacugggcugc

SEQ ID NO: 24619 - RNA, 18 nt, artificial
  Chemically synthesized
cguccacguugaucucac

SEQ ID NO: 24620 - RNA, 18 nt, artificial
  Chemically synthesized
agaugaacccgcgggcgg

SEQ ID NO: 24621 - RNA, 18 nt, artificial
  Chemically synthesized
ggugucgcaguuggagcc

SEQ ID NO: 24622 - RNA, 18 nt, artificial
  Chemically synthesized
aacgucaacaccuugucg

SEQ ID NO: 24623 - RNA, 18 nt, artificial
  Chemically synthesized
gcacucgucgaucuccuc

SEQ ID NO: 24624 - RNA, 18 nt, artificial
  Chemically synthesized
gcacagucauccagguug

SEQ ID NO: 24625 - RNA, 18 nt, artificial
  Chemically synthesized
uugggaaaggaagccggg

SEQ ID NO: 24626 - RNA, 18 nt, artificial
  Chemically synthesized
auuucccugaccagccgg

SEQ ID NO: 24627 - RNA, 18 nt, artificial
  Chemically synthesized
caugaagugcagcugcgc

SEQ ID NO: 24628 - RNA, 18 nt, artificial
  Chemically synthesized
cucauguagaucacuuuu

SEQ ID NO: 24629 - RNA, 18 nt, artificial
  Chemically synthesized
ugcacucauugaccucag

SEQ ID NO: 24630 - RNA, 18 nt, artificial
  Chemically synthesized
gaagaucaucugcuggcc

SEQ ID NO: 24631 - RNA, 18 nt, artificial
  Chemically synthesized
ucgugccaucaugcaugc

SEQ ID NO: 24632 - RNA, 18 nt, artificial
  Chemically synthesized
auuucaagaacgggcagg

SEQ ID NO: 24633 - RNA, 18 nt, artificial
  Chemically synthesized
cacaggccaggccuuugc

SEQ ID NO: 24634 - RNA, 18 nt, artificial
  Chemically synthesized
ccgccacguacaugaagu

SEQ ID NO: 24635 - RNA, 18 nt, artificial
  Chemically synthesized
acaggcacacucguagcc

SEQ ID NO: 24636 - RNA, 18 nt, artificial
  Chemically synthesized
guugaugcacuugcccgc

SEQ ID NO: 24637 - RNA, 18 nt, artificial
  Chemically synthesized
cccucacuggcaugacac

SEQ ID NO: 24638 - RNA, 18 nt, artificial
  Chemically synthesized
ucgauauuuuccucacag

SEQ ID NO: 24639 - RNA, 18 nt, artificial
  Chemically synthesized
cucgcugccaccagggag

SEQ ID NO: 24640 - RNA, 18 nt, artificial
  Chemically synthesized
ugguagcucaucaucugg

SEQ ID NO: 24641 - RNA, 18 nt, artificial
  Chemically synthesized
cacugccgguugucaauc

SEQ ID NO: 24642 - RNA, 18 nt, artificial
  Chemically synthesized
caccguugaagcaggagc

SEQ ID NO: 24643 - RNA, 18 nt, artificial
  Chemically synthesized
aguagcugccuguguagc

SEQ ID NO: 24644 - RNA, 18 nt, artificial
  Chemically synthesized
ugcccaggucaucuacgg

SEQ ID NO: 24645 - RNA, 18 nt, artificial
  Chemically synthesized
ugacaugcaugaugccua

SEQ ID NO: 24646 - RNA, 18 nt, artificial
  Chemically synthesized
acagucaucaauguucuc

SEQ ID NO: 24647 - RNA, 18 nt, artificial
  Chemically synthesized
ucggcucuccacucagga

SEQ ID NO: 24648 - RNA, 18 nt, artificial
  Chemically synthesized
ccgcugaagcccucccgg

SEQ ID NO: 24649 - RNA, 18 nt, artificial
  Chemically synthesized
agugguccuugcaguacu

SEQ ID NO: 24650 - RNA, 18 nt, artificial
  Chemically synthesized
cugcaucuguaaguuuug

SEQ ID NO: 24651 - RNA, 18 nt, artificial
  Chemically synthesized
uacucguccagcagccuc

SEQ ID NO: 24652 - RNA, 18 nt, artificial
  Chemically synthesized
acaccuugugcgucggca

SEQ ID NO: 24653 - RNA, 18 nt, artificial
  Chemically synthesized
ugcacacacugccgguug

SEQ ID NO: 24654 - RNA, 18 nt, artificial
  Chemically synthesized
cuccaugcuggcacaggc

SEQ ID NO: 24655 - RNA, 18 nt, artificial
  Chemically synthesized
uugccucuggaugcagcu

SEQ ID NO: 24656 - RNA, 18 nt, artificial
  Chemically synthesized
gugaggcaggcauugucc

SEQ ID NO: 24657 - RNA, 18 nt, artificial
  Chemically synthesized
acucgcacuggaacucau

SEQ ID NO: 24658 - RNA, 18 nt, artificial
  Chemically synthesized
ccaccaccaccagcgugc

SEQ ID NO: 24659 - RNA, 18 nt, artificial
  Chemically synthesized
aagugccacaguccacac

SEQ ID NO: 24660 - RNA, 18 nt, artificial
  Chemically synthesized
agccauugaugacggacu

SEQ ID NO: 24661 - RNA, 18 nt, artificial
  Chemically synthesized
agacaggugcccgagucg

SEQ ID NO: 24662 - RNA, 18 nt, artificial
  Chemically synthesized
gcaucagcaccaccacca

SEQ ID NO: 24663 - RNA, 18 nt, artificial
  Chemically synthesized
cagccgggacagccacuc

SEQ ID NO: 24664 - RNA, 18 nt, artificial
  Chemically synthesized
acucuggaagcacugcga

SEQ ID NO: 24665 - RNA, 18 nt, artificial
  Chemically synthesized
caauguucucgcugcagu

SEQ ID NO: 24666 - RNA, 18 nt, artificial
  Chemically synthesized
cuggauguuugcuggcug

SEQ ID NO: 24667 - RNA, 18 nt, artificial
  Chemically synthesized
aggagugcaggcggcacg

SEQ ID NO: 24668 - RNA, 18 nt, artificial
  Chemically synthesized
cacacucguugacauccu

SEQ ID NO: 24669 - RNA, 18 nt, artificial
  Chemically synthesized
gaacugggcugcggucac

SEQ ID NO: 24670 - RNA, 18 nt, artificial
  Chemically synthesized
agucggagacguuggaau

SEQ ID NO: 24671 - RNA, 18 nt, artificial
  Chemically synthesized
cacaguccagcccguccc

SEQ ID NO: 24672 - RNA, 18 nt, artificial
  Chemically synthesized
uuggccgccacguucagg

SEQ ID NO: 24673 - RNA, 18 nt, artificial
  Chemically synthesized
ugguccuugcaguacugg

SEQ ID NO: 24674 - RNA, 18 nt, artificial
  Chemically synthesized
acgucgaucucgcaucgg

SEQ ID NO: 24675 - RNA, 18 nt, artificial
  Chemically synthesized
ucagggaaccagagcugg

SEQ ID NO: 24676 - RNA, 18 nt, artificial
  Chemically synthesized
cucuuccucgcuguugcc

SEQ ID NO: 24677 - RNA, 18 nt, artificial
  Chemically synthesized
ggacacucgcaguagaag

SEQ ID NO: 24678 - RNA, 18 nt, artificial
  Chemically synthesized
cuguguagggcagcaggc

SEQ ID NO: 24679 - RNA, 18 nt, artificial
  Chemically synthesized
cgcuucacacuucccgcc

SEQ ID NO: 24680 - RNA, 18 nt, artificial
  Chemically synthesized
caguugcgcccacuguag

SEQ ID NO: 24681 - RNA, 18 nt, artificial
  Chemically synthesized
gguuccggaucaggaucu

SEQ ID NO: 24682 - RNA, 18 nt, artificial
  Chemically synthesized
ucacaguggccgucacug

SEQ ID NO: 24683 - RNA, 18 nt, artificial
  Chemically synthesized
gaggcacucgucgaucuc

SEQ ID NO: 24684 - RNA, 18 nt, artificial
  Chemically synthesized
gucauggcagguggcgcc

SEQ ID NO: 24685 - RNA, 18 nt, artificial
  Chemically synthesized
cugagccaagucugacgu

SEQ ID NO: 24686 - RNA, 18 nt, artificial
  Chemically synthesized
gguuguacucguccagca

SEQ ID NO: 24687 - RNA, 18 nt, artificial
  Chemically synthesized
cggcucuggcaagucucc

SEQ ID NO: 24688 - RNA, 18 nt, artificial
  Chemically synthesized
cuggcuggagcacucguu

SEQ ID NO: 24689 - RNA, 18 nt, artificial
  Chemically synthesized
uuugcagccauugaugac

SEQ ID NO: 24690 - RNA, 18 nt, artificial
  Chemically synthesized
uuguacccggcaacgucg

SEQ ID NO: 24691 - RNA, 18 nt, artificial
  Chemically synthesized
uguugcccgucuccaggc

SEQ ID NO: 24692 - RNA, 18 nt, artificial
  Chemically synthesized
agcacaacugcggcaucc

SEQ ID NO: 24693 - RNA, 18 nt, artificial
  Chemically synthesized
caggugccgccaugcagg

SEQ ID NO: 24694 - RNA, 18 nt, artificial
  Chemically synthesized
agcccuggucgcagugcc

SEQ ID NO: 24695 - RNA, 18 nt, artificial
  Chemically synthesized
cacugcagagacugcgug

SEQ ID NO: 24696 - RNA, 18 nt, artificial
  Chemically synthesized
gggauguugaggcugccc

SEQ ID NO: 24697 - RNA, 18 nt, artificial
  Chemically synthesized
ggugcaccuguaggagcc

SEQ ID NO: 24698 - RNA, 18 nt, artificial
  Chemically synthesized
ugcugggcuugcggaccu

SEQ ID NO: 24699 - RNA, 18 nt, artificial
  Chemically synthesized
cccaguggcugcacgucu

SEQ ID NO: 24700 - RNA, 18 nt, artificial
  Chemically synthesized
guucaggugcccgaugcc

SEQ ID NO: 24701 - RNA, 18 nt, artificial
  Chemically synthesized
ucugcauaucuuuguuag

SEQ ID NO: 24702 - RNA, 18 nt, artificial
  Chemically synthesized
cuggcacagucaucaaug

SEQ ID NO: 24703 - RNA, 18 nt, artificial
  Chemically synthesized
cuuguuuucucagaauag

SEQ ID NO: 24704 - RNA, 18 nt, artificial
  Chemically synthesized
acuccgagaacacauuuu

SEQ ID NO: 24705 - RNA, 18 nt, artificial
  Chemically synthesized
ucaaacugguggacccgc

SEQ ID NO: 24706 - RNA, 18 nt, artificial
  Chemically synthesized
aucagcuggcacucgucc

SEQ ID NO: 24707 - RNA, 18 nt, artificial
  Chemically synthesized
caugcuggugggagggcu

SEQ ID NO: 24708 - RNA, 18 nt, artificial
  Chemically synthesized
uacaguuccucauguaga

SEQ ID NO: 24709 - RNA, 18 nt, artificial
  Chemically synthesized
agcucucugugcagucag

SEQ ID NO: 24710 - RNA, 18 nt, artificial
  Chemically synthesized
agcaaggcuacugugcag

SEQ ID NO: 24711 - RNA, 18 nt, artificial
  Chemically synthesized
gucugaagcguucuucag

SEQ ID NO: 24712 - RNA, 18 nt, artificial
  Chemically synthesized
ggccuuugcugcugggcu

SEQ ID NO: 24713 - RNA, 18 nt, artificial
  Chemically synthesized
uguuguucucacagugga

SEQ ID NO: 24714 - RNA, 18 nt, artificial
  Chemically synthesized
agucugacgucccucacu

SEQ ID NO: 24715 - RNA, 18 nt, artificial
  Chemically synthesized
cuggcacacucgucugug

SEQ ID NO: 24716 - RNA, 18 nt, artificial
  Chemically synthesized
caugcgcaggucagcggc

SEQ ID NO: 24717 - RNA, 18 nt, artificial
  Chemically synthesized
ggagcucucugugcaguc

SEQ ID NO: 24718 - RNA, 18 nt, artificial
  Chemically synthesized
agaggguuguauugguuc

SEQ ID NO: 24719 - RNA, 18 nt, artificial
  Chemically synthesized
gauguuugcuggcugcag

SEQ ID NO: 24720 - RNA, 18 nt, artificial
  Chemically synthesized
cuuggcauacacacuccg

SEQ ID NO: 24721 - RNA, 18 nt, artificial
  Chemically synthesized
gcaguggaagucauugac

SEQ ID NO: 24722 - RNA, 18 nt, artificial
  Chemically synthesized
ugccguccucgcaggugc

SEQ ID NO: 24723 - RNA, 18 nt, artificial
  Chemically synthesized
gcaggugcagcuguagcc

SEQ ID NO: 24724 - RNA, 18 nt, artificial
  Chemically synthesized
gguucuggagggaccaag

SEQ ID NO: 24725 - RNA, 18 nt, artificial
  Chemically synthesized
ugagcaggucgcaggugc

SEQ ID NO: 24726 - RNA, 18 nt, artificial
  Chemically synthesized
cauccucgguacaguacu

SEQ ID NO: 24727 - RNA, 18 nt, artificial
  Chemically synthesized
aguggaucccgcugaagc

SEQ ID NO: 24728 - RNA, 18 nt, artificial
  Chemically synthesized
augacggacucgcagcgg

SEQ ID NO: 24729 - RNA, 18 nt, artificial
  Chemically synthesized
gagcagucaccgccgucc

SEQ ID NO: 24730 - RNA, 18 nt, artificial
  Chemically synthesized
guugggaccgcugaagcc

SEQ ID NO: 24731 - RNA, 18 nt, artificial
  Chemically synthesized
ucugguugugcaggcugg

SEQ ID NO: 24732 - RNA, 18 nt, artificial
  Chemically synthesized
gucugacagguagccaug

SEQ ID NO: 24733 - RNA, 18 nt, artificial
  Chemically synthesized
gguguuggaggccacggc

SEQ ID NO: 24734 - RNA, 18 nt, artificial
  Chemically synthesized
uuggugucgcaguuggag

SEQ ID NO: 24735 - RNA, 18 nt, artificial
  Chemically synthesized
gcucucggaugugggcuc

SEQ ID NO: 24736 - RNA, 18 nt, artificial
  Chemically synthesized
gcgccgccaucucgggcu

SEQ ID NO: 24737 - RNA, 18 nt, artificial
  Chemically synthesized
ucgcagcgguacugggug

SEQ ID NO: 24738 - RNA, 18 nt, artificial
  Chemically synthesized
uugcccgucuccaggccg

SEQ ID NO: 24739 - RNA, 18 nt, artificial
  Chemically synthesized
caguucugggugccacgg

SEQ ID NO: 24740 - RNA, 18 nt, artificial
  Chemically synthesized
agaagcccagggcacagc

SEQ ID NO: 24741 - RNA, 18 nt, artificial
  Chemically synthesized
auugaugacggacucgca

SEQ ID NO: 24742 - RNA, 18 nt, artificial
  Chemically synthesized
uucuugcuggccucagac

SEQ ID NO: 24743 - RNA, 18 nt, artificial
  Chemically synthesized
cacuuguacuccgucagc

SEQ ID NO: 24744 - RNA, 18 nt, artificial
  Chemically synthesized
cugguugugcaggcuggc

SEQ ID NO: 24745 - RNA, 18 nt, artificial
  Chemically synthesized
guuggaggcgcacggguc

SEQ ID NO: 24746 - RNA, 18 nt, artificial
  Chemically synthesized
gaaucuuuucauccuacg

SEQ ID NO: 24747 - RNA, 18 nt, artificial
  Chemically synthesized
aguugaugagguccucca

SEQ ID NO: 24748 - RNA, 18 nt, artificial
  Chemically synthesized
ugcacugcaggcugcaga

SEQ ID NO: 24749 - RNA, 18 nt, artificial
  Chemically synthesized
ucugcaccaggugaggcu

SEQ ID NO: 24750 - RNA, 18 nt, artificial
  Chemically synthesized
uaggaggccucgaagggc

SEQ ID NO: 24751 - RNA, 18 nt, artificial
  Chemically synthesized
cucagaacgcacucguug

SEQ ID NO: 24752 - RNA, 18 nt, artificial
  Chemically synthesized
cuggcagcaaggcuacug

SEQ ID NO: 24753 - RNA, 18 nt, artificial
  Chemically synthesized
ggcgguccauaugauccg

SEQ ID NO: 24754 - RNA, 18 nt, artificial
  Chemically synthesized
acaugcgcaggucagcgg

SEQ ID NO: 24755 - RNA, 18 nt, artificial
  Chemically synthesized
ggugagccagcuuugccu

SEQ ID NO: 24756 - RNA, 18 nt, artificial
  Chemically synthesized
cccacagugaaauucagg

SEQ ID NO: 24757 - RNA, 18 nt, artificial
  Chemically synthesized
ucggcggcacgcuugaug

SEQ ID NO: 24758 - RNA, 18 nt, artificial
  Chemically synthesized
ugcaugcgcuccugugcg

SEQ ID NO: 24759 - RNA, 18 nt, artificial
  Chemically synthesized
agcuguccagcaggcagc

SEQ ID NO: 24760 - RNA, 18 nt, artificial
  Chemically synthesized
aucuuguccagacaggug

SEQ ID NO: 24761 - RNA, 18 nt, artificial
  Chemically synthesized
gccgcuucacacuucccg

SEQ ID NO: 24762 - RNA, 18 nt, artificial
  Chemically synthesized
gcuugaagaccacguugg

SEQ ID NO: 24763 - RNA, 18 nt, artificial
  Chemically synthesized
agcccuccaugcuggcac

SEQ ID NO: 24764 - RNA, 18 nt, artificial
  Chemically synthesized
aggcuccucuggucggcc

SEQ ID NO: 24765 - RNA, 18 nt, artificial
  Chemically synthesized
caguccacacaucucaug

SEQ ID NO: 24766 - RNA, 18 nt, artificial
  Chemically synthesized
cacucuuggcauacacac

SEQ ID NO: 24767 - RNA, 18 nt, artificial
  Chemically synthesized
cugcaucuguaaguuuug

SEQ ID NO: 24768 - RNA, 18 nt, artificial
  Chemically synthesized
uuccuccgugccuugagg

SEQ ID NO: 24769 - RNA, 18 nt, artificial
  Chemically synthesized
gggucacuggcacacucg

SEQ ID NO: 24770 - RNA, 18 nt, artificial
  Chemically synthesized
cacuggccuuccgcacgc

SEQ ID NO: 24771 - RNA, 18 nt, artificial
  Chemically synthesized
aaggugagccagcuuugc

SEQ ID NO: 24772 - RNA, 18 nt, artificial
  Chemically synthesized
aggcauagucugccacgc

SEQ ID NO: 24773 - RNA, 18 nt, artificial
  Chemically synthesized
cggcuguggugguggugg

SEQ ID NO: 24774 - RNA, 18 nt, artificial
  Chemically synthesized
ugcagguucugcugcugc

SEQ ID NO: 24775 - RNA, 18 nt, artificial
  Chemically synthesized
cgggaacuggcauucggg

SEQ ID NO: 24776 - RNA, 18 nt, artificial
  Chemically synthesized
uugacguccaugcagucg

SEQ ID NO: 24777 - RNA, 18 nt, artificial
  Chemically synthesized
gucugcaccaggugaggc

SEQ ID NO: 24778 - RNA, 18 nt, artificial
  Chemically synthesized
ucacagucgcacuuguac

SEQ ID NO: 24779 - RNA, 18 nt, artificial
  Chemically synthesized
gguacaguacugaccugu

SEQ ID NO: 24780 - RNA, 18 nt, artificial
  Chemically synthesized
ugugcgucacgcuugaag

SEQ ID NO: 24781 - RNA, 18 nt, artificial
  Chemically synthesized
agcacggcacucgcagug

SEQ ID NO: 24782 - RNA, 18 nt, artificial
  Chemically synthesized
aguugcgcccacuguagc

SEQ ID NO: 24783 - RNA, 18 nt, artificial
  Chemically synthesized
gaccuuguugcccgcguc

SEQ ID NO: 24784 - RNA, 18 nt, artificial
  Chemically synthesized
cguguugaugcacuugcc

SEQ ID NO: 24785 - RNA, 18 nt, artificial
  Chemically synthesized
guccaugcagucggcguc

SEQ ID NO: 24786 - RNA, 18 nt, artificial
  Chemically synthesized
gucucgcagugguggccc

SEQ ID NO: 24787 - RNA, 18 nt, artificial
  Chemically synthesized
aaggguuggauucacacu

SEQ ID NO: 24788 - RNA, 18 nt, artificial
  Chemically synthesized
cuugcaggagccguagug

SEQ ID NO: 24789 - RNA, 18 nt, artificial
  Chemically synthesized
guuguauugguucggcac

SEQ ID NO: 24790 - RNA, 18 nt, artificial
  Chemically synthesized
ucgcagggauuggacagg

SEQ ID NO: 24791 - RNA, 18 nt, artificial
  Chemically synthesized
uuguacuccgucagcgug

SEQ ID NO: 24792 - RNA, 18 nt, artificial
  Chemically synthesized
gcacuuguacuccgucag

SEQ ID NO: 24793 - RNA, 18 nt, artificial
  Chemically synthesized
cucgcacuggaacucauu

SEQ ID NO: 24794 - RNA, 18 nt, artificial
  Chemically synthesized
cuguguagggcagcaggc

SEQ ID NO: 24795 - RNA, 18 nt, artificial
  Chemically synthesized
ucacgggugggaccagcg

SEQ ID NO: 24796 - RNA, 18 nt, artificial
  Chemically synthesized
gucucguagcugcccucc

SEQ ID NO: 24797 - RNA, 18 nt, artificial
  Chemically synthesized
cguccaggcacuuggcac

SEQ ID NO: 24798 - RNA, 18 nt, artificial
  Chemically synthesized
uuggcaaagugguccagc

SEQ ID NO: 24799 - RNA, 18 nt, artificial
  Chemically synthesized
gaucugggacugcaugcu

SEQ ID NO: 24800 - RNA, 18 nt, artificial
  Chemically synthesized
ucguugagguggcacagc

SEQ ID NO: 24801 - RNA, 18 nt, artificial
  Chemically synthesized
uuuggcaucagcuggcac

SEQ ID NO: 24802 - RNA, 18 nt, artificial
  Chemically synthesized
cucguugacauccugccg

SEQ ID NO: 24803 - RNA, 18 nt, artificial
  Chemically synthesized
cgcacuugcaggaguagc

SEQ ID NO: 24804 - RNA, 18 nt, artificial
  Chemically synthesized
guccugggacuucuuccu

SEQ ID NO: 24805 - RNA, 18 nt, artificial
  Chemically synthesized
agccuggcaggcaggcac

SEQ ID NO: 24806 - RNA, 18 nt, artificial
  Chemically synthesized
cuggcuggagcacucguu

SEQ ID NO: 24807 - RNA, 18 nt, artificial
  Chemically synthesized
gcgugugaguugaugagg

SEQ ID NO: 24808 - RNA, 18 nt, artificial
  Chemically synthesized
gcggucucguagcugccc

SEQ ID NO: 24809 - RNA, 18 nt, artificial
  Chemically synthesized
aggccuccggaaugcggg

SEQ ID NO: 24810 - RNA, 18 nt, artificial
  Chemically synthesized
aagcccgggcuucuggcc

SEQ ID NO: 24811 - RNA, 18 nt, artificial
  Chemically synthesized
auccucgguacaguacug

SEQ ID NO: 24812 - RNA, 18 nt, artificial
  Chemically synthesized
ucgaagggcaggcacugg

SEQ ID NO: 24813 - RNA, 18 nt, artificial
  Chemically synthesized
ugacuccagggaguccac

SEQ ID NO: 24814 - RNA, 18 nt, artificial
  Chemically synthesized
auguuguccuggauguug

SEQ ID NO: 24815 - RNA, 18 nt, artificial
  Chemically synthesized
cucuggaugcagcuucuc

SEQ ID NO: 24816 - RNA, 18 nt, artificial
  Chemically synthesized
acaggugccgccaugcag

SEQ ID NO: 24817 - RNA, 18 nt, artificial
  Chemically synthesized
ugaugcugguggagcggc

SEQ ID NO: 24818 - RNA, 18 nt, artificial
  Chemically synthesized
gucaaucuccagguagac

SEQ ID NO: 24819 - RNA, 18 nt, artificial
  Chemically synthesized
accaugccgcucugcagc

SEQ ID NO: 24820 - RNA, 18 nt, artificial
  Chemically synthesized
gggcauccaggucugugg

SEQ ID NO: 24821 - RNA, 18 nt, artificial
  Chemically synthesized
gucccacuccacccaggg

SEQ ID NO: 24822 - RNA, 18 nt, artificial
  Chemically synthesized
agcaugccggagcugucc

SEQ ID NO: 24823 - RNA, 18 nt, artificial
  Chemically synthesized
caggagaagcucucauag

SEQ ID NO: 24824 - RNA, 18 nt, artificial
  Chemically synthesized
cagguacgagcgucauuc

SEQ ID NO: 24825 - RNA, 18 nt, artificial
  Chemically synthesized
agaccuuguugcccgcgu

SEQ ID NO: 24826 - RNA, 18 nt, artificial
  Chemically synthesized
cuucaggcagaagcagag

SEQ ID NO: 24827 - RNA, 18 nt, artificial
  Chemically synthesized
agccggcugaguugcacu

SEQ ID NO: 24828 - RNA, 18 nt, artificial
  Chemically synthesized
ucccgccgcuucuucuug

SEQ ID NO: 24829 - RNA, 18 nt, artificial
  Chemically synthesized
caucaucugggacagggc

SEQ ID NO: 24830 - RNA, 18 nt, artificial
  Chemically synthesized
cgucgaucucgcaucggg

SEQ ID NO: 24831 - RNA, 18 nt, artificial
  Chemically synthesized
acguggcaccuguguagg

SEQ ID NO: 24832 - RNA, 18 nt, artificial
  Chemically synthesized
uggcauccacagagcgca

SEQ ID NO: 24833 - RNA, 18 nt, artificial
  Chemically synthesized
ucugacagguagccaugg

SEQ ID NO: 24834 - RNA, 18 nt, artificial
  Chemically synthesized
cagguagacgauggagcc

SEQ ID NO: 24835 - RNA, 18 nt, artificial
  Chemically synthesized
acauugacguccaugcag

SEQ ID NO: 24836 - RNA, 18 nt, artificial
  Chemically synthesized
agccgcggacguccaugg

SEQ ID NO: 24837 - RNA, 18 nt, artificial
  Chemically synthesized
ugugcagcacgcggcuga

SEQ ID NO: 24838 - RNA, 18 nt, artificial
  Chemically synthesized
agcgucauucucacacgu

SEQ ID NO: 24839 - RNA, 18 nt, artificial
  Chemically synthesized
aguggcagauguaggagg

SEQ ID NO: 24840 - RNA, 18 nt, artificial
  Chemically synthesized
aggugaugcugguggagc

SEQ ID NO: 24841 - RNA, 18 nt, artificial
  Chemically synthesized
uugcuggcugcagguucu

SEQ ID NO: 24842 - RNA, 18 nt, artificial
  Chemically synthesized
augcaaauuaauccgcgu

SEQ ID NO: 24843 - RNA, 18 nt, artificial
  Chemically synthesized
guacaugcuccgcacagu

SEQ ID NO: 24844 - RNA, 18 nt, artificial
  Chemically synthesized
gcacgucgcaguaaaggc

SEQ ID NO: 24845 - RNA, 18 nt, artificial
  Chemically synthesized
gcgguaggagccgaccuc

SEQ ID NO: 24846 - RNA, 18 nt, artificial
  Chemically synthesized
acagcagaccugugcggc

SEQ ID NO: 24847 - RNA, 18 nt, artificial
  Chemically synthesized
gccucagacacuuugaag

SEQ ID NO: 24848 - RNA, 18 nt, artificial
  Chemically synthesized
uucugggugccacgggcg

SEQ ID NO: 24849 - RNA, 18 nt, artificial
  Chemically synthesized
ugcgcagccaccucacag

SEQ ID NO: 24850 - RNA, 18 nt, artificial
  Chemically synthesized
uguccagacaggugcccg

SEQ ID NO: 24851 - RNA, 18 nt, artificial
  Chemically synthesized
cagcgaggcgagcgcucc

SEQ ID NO: 24852 - RNA, 18 nt, artificial
  Chemically synthesized
ugcuggagcccaggacgg

SEQ ID NO: 24853 - RNA, 18 nt, artificial
  Chemically synthesized
cuggcaugacacacaaca

SEQ ID NO: 24854 - RNA, 18 nt, artificial
  Chemically synthesized
cucauugacaucgugcug

SEQ ID NO: 24855 - RNA, 18 nt, artificial
  Chemically synthesized
aucuuuucauccuacgua

SEQ ID NO: 24856 - RNA, 18 nt, artificial
  Chemically synthesized
ccugguccacgcaggugc

SEQ ID NO: 24857 - RNA, 18 nt, artificial
  Chemically synthesized
accaucuaaaacacaugg

SEQ ID NO: 24858 - RNA, 18 nt, artificial
  Chemically synthesized
ugaaguugagggagcagu

SEQ ID NO: 24859 - RNA, 18 nt, artificial
  Chemically synthesized
uagccugggcggcagagg

SEQ ID NO: 24860 - RNA, 18 nt, artificial
  Chemically synthesized
gucugguugugcaggcug

SEQ ID NO: 24861 - RNA, 18 nt, artificial
  Chemically synthesized
aguccucggauugccugc

SEQ ID NO: 24862 - RNA, 18 nt, artificial
  Chemically synthesized
guguugaugcacuugccc

SEQ ID NO: 24863 - RNA, 18 nt, artificial
  Chemically synthesized
ugaucucacagugcacac

SEQ ID NO: 24864 - RNA, 18 nt, artificial
  Chemically synthesized
gaagcacugcgaggaggc

SEQ ID NO: 24865 - RNA, 18 nt, artificial
  Chemically synthesized
ccaggugcaaggcggucu

SEQ ID NO: 24866 - RNA, 18 nt, artificial
  Chemically synthesized
uugcaguacuggucguac

SEQ ID NO: 24867 - RNA, 18 nt, artificial
  Chemically synthesized
agcgcacacagacgcccg

SEQ ID NO: 24868 - RNA, 18 nt, artificial
  Chemically synthesized
aggcuauacuugguauug

SEQ ID NO: 24869 - RNA, 18 nt, artificial
  Chemically synthesized
uucucgcugcaguccuca

SEQ ID NO: 24870 - RNA, 18 nt, artificial
  Chemically synthesized
cauuugccgccguucuug

SEQ ID NO: 24871 - RNA, 18 nt, artificial
  Chemically synthesized
ccaucucgggcuuggccg

SEQ ID NO: 24872 - RNA, 18 nt, artificial
  Chemically synthesized
acaacugcggcauccaca

SEQ ID NO: 24873 - RNA, 18 nt, artificial
  Chemically synthesized
cacuucccgccauucagg

SEQ ID NO: 24874 - RNA, 18 nt, artificial
  Chemically synthesized
uucuuccuccgugccuug

SEQ ID NO: 24875 - RNA, 18 nt, artificial
  Chemically synthesized
ucacuggcaugacacaca

SEQ ID NO: 24876 - RNA, 18 nt, artificial
  Chemically synthesized
gugccagaggccacaggc

SEQ ID NO: 24877 - RNA, 18 nt, artificial
  Chemically synthesized
guugauguuggucuggca

SEQ ID NO: 24878 - RNA, 18 nt, artificial
  Chemically synthesized
uagaaggaggccacacgg

SEQ ID NO: 24879 - RNA, 18 nt, artificial
  Chemically synthesized
aggaccaaaggacgcagc

SEQ ID NO: 24880 - RNA, 18 nt, artificial
  Chemically synthesized
auguuggcaucugcgcug

SEQ ID NO: 24881 - RNA, 18 nt, artificial
  Chemically synthesized
ugagccaagucugacguc

SEQ ID NO: 24882 - RNA, 18 nt, artificial
  Chemically synthesized
agggaaccagagcuggcc

SEQ ID NO: 24883 - RNA, 18 nt, artificial
  Chemically synthesized
ccggcucuggcaagucuc

SEQ ID NO: 24884 - RNA, 18 nt, artificial
  Chemically synthesized
ugguucagacauggguug

SEQ ID NO: 24885 - RNA, 18 nt, artificial
  Chemically synthesized
gugggccagucucaaagg

SEQ ID NO: 24886 - RNA, 18 nt, artificial
  Chemically synthesized
ucgcugaagugguccuug

SEQ ID NO: 24887 - RNA, 18 nt, artificial
  Chemically synthesized
acaaggguuggauucaca

SEQ ID NO: 24888 - RNA, 18 nt, artificial
  Chemically synthesized
caguggaagucauugacg

SEQ ID NO: 24889 - RNA, 18 nt, artificial
  Chemically synthesized
caugucuuugcaggugcc

SEQ ID NO: 24890 - RNA, 18 nt, artificial
  Chemically synthesized
cacgucugacagguagcc

SEQ ID NO: 24891 - RNA, 18 nt, artificial
  Chemically synthesized
uuuacuugaaggccuccg

SEQ ID NO: 24892 - RNA, 18 nt, artificial
  Chemically synthesized
acugcaugcuggugggag

SEQ ID NO: 24893 - RNA, 18 nt, artificial
  Chemically synthesized
cucgcuguugcccgucuc

SEQ ID NO: 24894 - RNA, 18 nt, artificial
  Chemically synthesized
uccucccuguuguucugc

SEQ ID NO: 24895 - RNA, 18 nt, artificial
  Chemically synthesized
uaccaugccaugcugcag

SEQ ID NO: 24896 - RNA, 18 nt, artificial
  Chemically synthesized
augcaugaugccuacauu

SEQ ID NO: 24897 - RNA, 18 nt, artificial
  Chemically synthesized
ucuggcaagucuccuaca

SEQ ID NO: 24898 - RNA, 18 nt, artificial
  Chemically synthesized
ucgcaguaaaggccgguc

SEQ ID NO: 24899 - RNA, 18 nt, artificial
  Chemically synthesized
aggucaggcagaaccacg

SEQ ID NO: 24900 - RNA, 18 nt, artificial
  Chemically synthesized
cucguugauguccuccuc

SEQ ID NO: 24901 - RNA, 18 nt, artificial
  Chemically synthesized
ggcauagucugccacgcc

SEQ ID NO: 24902 - RNA, 18 nt, artificial
  Chemically synthesized
guuguacucguccagcag

SEQ ID NO: 24903 - RNA, 18 nt, artificial
  Chemically synthesized
ugcacgccgggcuugagg

SEQ ID NO: 24904 - RNA, 18 nt, artificial
  Chemically synthesized
aaaaaggcuccucugguc

SEQ ID NO: 24905 - RNA, 18 nt, artificial
  Chemically synthesized
acacagagcccuccaugc

SEQ ID NO: 24906 - RNA, 18 nt, artificial
  Chemically synthesized
uuugccgccguucuugca

SEQ ID NO: 24907 - RNA, 18 nt, artificial
  Chemically synthesized
gaaguacuuccagcacug

SEQ ID NO: 24908 - RNA, 18 nt, artificial
  Chemically synthesized
accuugucgcugcgcagc

SEQ ID NO: 24909 - RNA, 18 nt, artificial
  Chemically synthesized
cacgcuggcagucaaagc

SEQ ID NO: 24910 - RNA, 18 nt, artificial
  Chemically synthesized
cauacacacuccgagaac

SEQ ID NO: 24911 - RNA, 18 nt, artificial
  Chemically synthesized
cucucagaacuugcuugu

SEQ ID NO: 24912 - RNA, 18 nt, artificial
  Chemically synthesized
gcugaguugcacuggcug

SEQ ID NO: 24913 - RNA, 18 nt, artificial
  Chemically synthesized
guuggugugcagcacgcg

SEQ ID NO: 24914 - RNA, 18 nt, artificial
  Chemically synthesized
ucaucuacaguuccucau

SEQ ID NO: 24915 - RNA, 18 nt, artificial
  Chemically synthesized
augggcggcuaaggcucc

SEQ ID NO: 24916 - RNA, 18 nt, artificial
  Chemically synthesized
gcacucauugacaucgug

SEQ ID NO: 24917 - RNA, 18 nt, artificial
  Chemically synthesized
uugaagaccacguuggug

SEQ ID NO: 24918 - RNA, 18 nt, artificial
  Chemically synthesized
augugccgccguugaggc

SEQ ID NO: 24919 - RNA, 18 nt, artificial
  Chemically synthesized
ggcacucguugacauccc

SEQ ID NO: 24920 - RNA, 18 nt, artificial
  Chemically synthesized
aguugcacuuguacccgg

SEQ ID NO: 24921 - RNA, 18 nt, artificial
  Chemically synthesized
acaagagcccguugaauu

SEQ ID NO: 24922 - RNA, 18 nt, artificial
  Chemically synthesized
aucaucugggacagggcg

SEQ ID NO: 24923 - RNA, 18 nt, artificial
  Chemically synthesized
gggcgucaggaacugggc

SEQ ID NO: 24924 - RNA, 18 nt, artificial
  Chemically synthesized
auugacguccaugcaguc

SEQ ID NO: 24925 - RNA, 18 nt, artificial
  Chemically synthesized
aggcugcccagguagccg

SEQ ID NO: 24926 - RNA, 18 nt, artificial
  Chemically synthesized
ugcacucuuggcauacac

SEQ ID NO: 24927 - RNA, 18 nt, artificial
  Chemically synthesized
aggugaagguggcgacgc

SEQ ID NO: 24928 - RNA, 18 nt, artificial
  Chemically synthesized
caucgauguccaccucgc

SEQ ID NO: 24929 - RNA, 18 nt, artificial
  Chemically synthesized
cggcugcaggcuuugcug

SEQ ID NO: 24930 - RNA, 18 nt, artificial
  Chemically synthesized
uggucguccaggucaggc

SEQ ID NO: 24931 - RNA, 18 nt, artificial
  Chemically synthesized
agcagucaccgccguccc

SEQ ID NO: 24932 - RNA, 18 nt, artificial
  Chemically synthesized
guugcacagcucaaugug

SEQ ID NO: 24933 - RNA, 18 nt, artificial
  Chemically synthesized
acgucgcaguaaaggccg

SEQ ID NO: 24934 - RNA, 18 nt, artificial
  Chemically synthesized
ugaguugaugagguccuc

SEQ ID NO: 24935 - RNA, 18 nt, artificial
  Chemically synthesized
guugcacucauugaccuc

SEQ ID NO: 24936 - RNA, 18 nt, artificial
  Chemically synthesized
cacacucgugggugacgu

SEQ ID NO: 24937 - RNA, 18 nt, artificial
  Chemically synthesized
ugcagcuucuccuaacag

SEQ ID NO: 24938 - RNA, 18 nt, artificial
  Chemically synthesized
cagccucucggguacaug

SEQ ID NO: 24939 - RNA, 18 nt, artificial
  Chemically synthesized
guucuggcagggcgaggg

SEQ ID NO: 24940 - RNA, 18 nt, artificial
  Chemically synthesized
accaugggugcacucuug

SEQ ID NO: 24941 - RNA, 18 nt, artificial
  Chemically synthesized
uugcaaaaaucugcuccu

SEQ ID NO: 24942 - RNA, 18 nt, artificial
  Chemically synthesized
cggcauccacauuguuca

SEQ ID NO: 24943 - RNA, 18 nt, artificial
  Chemically synthesized
cauucuugcagggcuugc

SEQ ID NO: 24944 - RNA, 18 nt, artificial
  Chemically synthesized
uugugcgucggcagacac

SEQ ID NO: 24945 - RNA, 18 nt, artificial
  Chemically synthesized
aagcugggugggcagugg

SEQ ID NO: 24946 - RNA, 18 nt, artificial
  Chemically synthesized
gaagacaccuugugcguc

SEQ ID NO: 24947 - RNA, 18 nt, artificial
  Chemically synthesized
augucuuugcaggugccg

SEQ ID NO: 24948 - RNA, 18 nt, artificial
  Chemically synthesized
uguagcccggcucacagg

SEQ ID NO: 24949 - RNA, 18 nt, artificial
  Chemically synthesized
cacagacgcccgaaggcu

SEQ ID NO: 24950 - RNA, 18 nt, artificial
  Chemically synthesized
gucugucuggucguccag

SEQ ID NO: 24951 - RNA, 18 nt, artificial
  Chemically synthesized
cuggagcaucuucuucgg

SEQ ID NO: 24952 - RNA, 18 nt, artificial
  Chemically synthesized
cgucaaccucacccuggg

SEQ ID NO: 24953 - RNA, 18 nt, artificial
  Chemically synthesized
ccagcgccgccaucucgg

SEQ ID NO: 24954 - RNA, 18 nt, artificial
  Chemically synthesized
uuguccacaggcgaggag

SEQ ID NO: 24955 - RNA, 18 nt, artificial
  Chemically synthesized
aagccaucaggcccgcgg

SEQ ID NO: 24956 - RNA, 18 nt, artificial
  Chemically synthesized
cgcacgcgugguuguugc

SEQ ID NO: 24957 - RNA, 18 nt, artificial
  Chemically synthesized
agggcgaggagucacacc

SEQ ID NO: 24958 - RNA, 18 nt, artificial
  Chemically synthesized
gggcuucuggccacacuc

SEQ ID NO: 24959 - RNA, 18 nt, artificial
  Chemically synthesized
ugcaggcuuugcugcugc

SEQ ID NO: 24960 - RNA, 18 nt, artificial
  Chemically synthesized
acacucguagccaucgau

SEQ ID NO: 24961 - RNA, 18 nt, artificial
  Chemically synthesized
gaaguugagggagcaguc

SEQ ID NO: 24962 - RNA, 18 nt, artificial
  Chemically synthesized
uuaaaaaggcuccucugg

SEQ ID NO: 24963 - RNA, 18 nt, artificial
  Chemically synthesized
cauccacagagcgcacac

SEQ ID NO: 24964 - RNA, 18 nt, artificial
  Chemically synthesized
gguucugcugcugcaucu

SEQ ID NO: 24965 - RNA, 18 nt, artificial
  Chemically synthesized
augacggccggcgcgucc

SEQ ID NO: 24966 - RNA, 18 nt, artificial
  Chemically synthesized
uugagguccuuggccucc

SEQ ID NO: 24967 - RNA, 18 nt, artificial
  Chemically synthesized
uugaggcugucccggcag

SEQ ID NO: 24968 - RNA, 18 nt, artificial
  Chemically synthesized
uugaggcugcccagcgag

SEQ ID NO: 24969 - RNA, 18 nt, artificial
  Chemically synthesized
cggucugucugguugugc

SEQ ID NO: 24970 - RNA, 18 nt, artificial
  Chemically synthesized
gggcuggcuggagcacuc

SEQ ID NO: 24971 - RNA, 18 nt, artificial
  Chemically synthesized
guccucacaguagcugcc

SEQ ID NO: 24972 - RNA, 18 nt, artificial
  Chemically synthesized
acacugugcaggcugagg

SEQ ID NO: 24973 - RNA, 18 nt, artificial
  Chemically synthesized
gguugucaaucuccaggu

SEQ ID NO: 24974 - RNA, 18 nt, artificial
  Chemically synthesized
gucgaugucggucucgca

SEQ ID NO: 24975 - RNA, 18 nt, artificial
  Chemically synthesized
uccguggcggcaaagccc

SEQ ID NO: 24976 - RNA, 18 nt, artificial
  Chemically synthesized
acauuuuuucugccauag

SEQ ID NO: 24977 - RNA, 18 nt, artificial
  Chemically synthesized
cugcugcuggauguuugc

SEQ ID NO: 24978 - RNA, 18 nt, artificial
  Chemically synthesized
auguuacacaugcucccu

SEQ ID NO: 24979 - RNA, 18 nt, artificial
  Chemically synthesized
cccaggcuguguugcugg

SEQ ID NO: 24980 - RNA, 18 nt, artificial
  Chemically synthesized
aggccucgaagggcaggc

SEQ ID NO: 24981 - RNA, 18 nt, artificial
  Chemically synthesized
ugcuggcacacucgucug

SEQ ID NO: 24982 - RNA, 18 nt, artificial
  Chemically synthesized
gucaggaacugggcugcg

SEQ ID NO: 24983 - RNA, 18 nt, artificial
  Chemically synthesized
agaacuugcuuguuuucu

SEQ ID NO: 24984 - RNA, 18 nt, artificial
  Chemically synthesized
uggcggcagggcuggcug

SEQ ID NO: 24985 - RNA, 18 nt, artificial
  Chemically synthesized
uuuuucugccauaggcua

SEQ ID NO: 24986 - RNA, 18 nt, artificial
  Chemically synthesized
cgucugaagcguucuuca

SEQ ID NO: 24987 - RNA, 18 nt, artificial
  Chemically synthesized
caguacugaccuguccac

SEQ ID NO: 24988 - RNA, 18 nt, artificial
  Chemically synthesized
cacuugcaggaguagccg

SEQ ID NO: 24989 - RNA, 18 nt, artificial
  Chemically synthesized
ugcagucaggcguguugu

SEQ ID NO: 24990 - RNA, 18 nt, artificial
  Chemically synthesized
ccugguagcucaucaucu

SEQ ID NO: 24991 - RNA, 18 nt, artificial
  Chemically synthesized
gaggcgcacgggucagcc

SEQ ID NO: 24992 - RNA, 18 nt, artificial
  Chemically synthesized
ucgguggcacucuggaag

SEQ ID NO: 24993 - RNA, 18 nt, artificial
  Chemically synthesized
ucgcugcaguccucacca

SEQ ID NO: 24994 - RNA, 18 nt, artificial
  Chemically synthesized
ggucaggcagaaccacgg

SEQ ID NO: 24995 - RNA, 18 nt, artificial
  Chemically synthesized
accgcugaagcccucccg

SEQ ID NO: 24996 - RNA, 18 nt, artificial
  Chemically synthesized
cgcccugguagaugaagu

SEQ ID NO: 24997 - RNA, 18 nt, artificial
  Chemically synthesized
acgcacucguugacgucg

SEQ ID NO: 24998 - RNA, 18 nt, artificial
  Chemically synthesized
ucgcugccaccagggagc

SEQ ID NO: 24999 - RNA, 18 nt, artificial
  Chemically synthesized
uccuugcuuccacaggcc

SEQ ID NO: 25000 - RNA, 18 nt, artificial
  Chemically synthesized
aucccaggcaggugguug

SEQ ID NO: 25001 - RNA, 18 nt, artificial
  Chemically synthesized
cuggcugcugagcucacg

SEQ ID NO: 25002 - RNA, 18 nt, artificial
  Chemically synthesized
aucuuguccaggcagcgg

SEQ ID NO: 25003 - RNA, 18 nt, artificial
  Chemically synthesized
aguccacacaucucaugu

SEQ ID NO: 25004 - RNA, 18 nt, artificial
  Chemically synthesized
uguugaccucgcagugca

SEQ ID NO: 25005 - RNA, 18 nt, artificial
  Chemically synthesized
aaggccuccggaaugcgg

SEQ ID NO: 25006 - RNA, 18 nt, artificial
  Chemically synthesized
uucccgccauucaggcag

SEQ ID NO: 25007 - RNA, 18 nt, artificial
  Chemically synthesized
acuggccuuccgcacgcu

SEQ ID NO: 25008 - RNA, 18 nt, artificial
  Chemically synthesized
augagguccuccagcaug

SEQ ID NO: 25009 - RNA, 18 nt, artificial
  Chemically synthesized
ucaaagccgucgaagagg

SEQ ID NO: 25010 - RNA, 18 nt, artificial
  Chemically synthesized
ccgaagcuguaguccagg

SEQ ID NO: 25011 - RNA, 18 nt, artificial
  Chemically synthesized
cucacagcgcucacccac

SEQ ID NO: 25012 - RNA, 18 nt, artificial
  Chemically synthesized
cugguagcucaucaucug

SEQ ID NO: 25013 - RNA, 18 nt, artificial
  Chemically synthesized
gcgucacgcuugaagacc

SEQ ID NO: 25014 - RNA, 18 nt, artificial
  Chemically synthesized
ucccgguuggcaaagugg

SEQ ID NO: 25015 - RNA, 18 nt, artificial
  Chemically synthesized
ccgguggucugucugguc

SEQ ID NO: 25016 - RNA, 18 nt, artificial
  Chemically synthesized
gacaggugcccgagucgc

SEQ ID NO: 25017 - RNA, 18 nt, artificial
  Chemically synthesized
aggagucacaccagugca

SEQ ID NO: 25018 - RNA, 18 nt, artificial
  Chemically synthesized
ucucaccgggcugggagc

SEQ ID NO: 25019 - RNA, 18 nt, artificial
  Chemically synthesized
cugcugaguccacugccg

SEQ ID NO: 25020 - RNA, 18 nt, artificial
  Chemically synthesized
cacacguagccacugguc

SEQ ID NO: 25021 - RNA, 18 nt, artificial
  Chemically synthesized
cagccaggaucaguggcg

SEQ ID NO: 25022 - RNA, 18 nt, artificial
  Chemically synthesized
aagguggcgacgccgucc

SEQ ID NO: 25023 - RNA, 18 nt, artificial
  Chemically synthesized
ccacuggucaugucuuug

SEQ ID NO: 25024 - RNA, 18 nt, artificial
  Chemically synthesized
acagcucaaugugcccgg

SEQ ID NO: 25025 - RNA, 18 nt, artificial
  Chemically synthesized
uugucgcgguccuggcag

SEQ ID NO: 25026 - RNA, 18 nt, artificial
  Chemically synthesized
gcagcggcaggugaagcc

SEQ ID NO: 25027 - RNA, 18 nt, artificial
  Chemically synthesized
ugugcaccgccaggcugc

SEQ ID NO: 25028 - RNA, 18 nt, artificial
  Chemically synthesized
caaggugcggcuguggug

SEQ ID NO: 25029 - RNA, 18 nt, artificial
  Chemically synthesized
uccggaucaggaucugga

SEQ ID NO: 25030 - RNA, 18 nt, artificial
  Chemically synthesized
ucggcgugugaguugaug

SEQ ID NO: 25031 - RNA, 18 nt, artificial
  Chemically synthesized
uggcucgguuccggauca

SEQ ID NO: 25032 - RNA, 18 nt, artificial
  Chemically synthesized
ggacagccacucgcauug

SEQ ID NO: 25033 - RNA, 18 nt, artificial
  Chemically synthesized
uugcuuguuuucucagaa

SEQ ID NO: 25034 - RNA, 18 nt, artificial
  Chemically synthesized
agguccuccagcaugccc

SEQ ID NO: 25035 - RNA, 18 nt, artificial
  Chemically synthesized
cacguugaucucacagug

SEQ ID NO: 25036 - RNA, 18 nt, artificial
  Chemically synthesized
agaaccacgggcuccucg

SEQ ID NO: 25037 - RNA, 18 nt, artificial
  Chemically synthesized
aagugguccuugcaguac

SEQ ID NO: 25038 - RNA, 18 nt, artificial
  Chemically synthesized
uugaaguugagggagcag

SEQ ID NO: 25039 - RNA, 18 nt, artificial
  Chemically synthesized
acuuguuuccuauuucag

SEQ ID NO: 25040 - RNA, 18 nt, artificial
  Chemically synthesized
agcuuuuuggacuaugcu

SEQ ID NO: 25041 - RNA, 18 nt, artificial
  Chemically synthesized
gacuucuuccuccgugcc

SEQ ID NO: 25042 - RNA, 18 nt, artificial
  Chemically synthesized
ucaacuucccuucuccaa

SEQ ID NO: 25043 - RNA, 18 nt, artificial
  Chemically synthesized
cgguuggcaaaguggucc

SEQ ID NO: 25044 - RNA, 18 nt, artificial
  Chemically synthesized
cagacaggugcccgaguc

SEQ ID NO: 25045 - RNA, 18 nt, artificial
  Chemically synthesized
gcgucgcagggauuggac

SEQ ID NO: 25046 - RNA, 18 nt, artificial
  Chemically synthesized
acacucguugauguccuc

SEQ ID NO: 25047 - RNA, 18 nt, artificial
  Chemically synthesized
guccguccaggcacuugg

SEQ ID NO: 25048 - RNA, 18 nt, artificial
  Chemically synthesized
ccguugacacacacgcag

SEQ ID NO: 25049 - RNA, 18 nt, artificial
  Chemically synthesized
cucacagugcacacccug

SEQ ID NO: 25050 - RNA, 18 nt, artificial
  Chemically synthesized
ggugcagauggccuugcc

SEQ ID NO: 25051 - RNA, 18 nt, artificial
  Chemically synthesized
acacagacgcccgaaggc

SEQ ID NO: 25052 - RNA, 18 nt, artificial
  Chemically synthesized
cauucaggcaggucucac

SEQ ID NO: 25053 - RNA, 18 nt, artificial
  Chemically synthesized
caucgaucuuguccagac

SEQ ID NO: 25054 - RNA, 18 nt, artificial
  Chemically synthesized
guacaugaagugcagcug

SEQ ID NO: 25055 - RNA, 18 nt, artificial
  Chemically synthesized
uuaauccgcgugcggaag

SEQ ID NO: 25056 - RNA, 18 nt, artificial
  Chemically synthesized
aucaucuacaguuccuca

SEQ ID NO: 25057 - RNA, 18 nt, artificial
  Chemically synthesized
gccggcugaguugcacug

SEQ ID NO: 25058 - RNA, 18 nt, artificial
  Chemically synthesized
gcuugggaaaggaagccg

SEQ ID NO: 25059 - RNA, 18 nt, artificial
  Chemically synthesized
ggagggcuggagacgccc

SEQ ID NO: 25060 - RNA, 18 nt, artificial
  Chemically synthesized
aagaucaucugcuggccg

SEQ ID NO: 25061 - RNA, 18 nt, artificial
  Chemically synthesized
aacaccuugucgcugcgc

SEQ ID NO: 25062 - RNA, 18 nt, artificial
  Chemically synthesized
gaccgcugaagcccuccc

SEQ ID NO: 25063 - RNA, 18 nt, artificial
  Chemically synthesized
cucguuguggcaggugcc

SEQ ID NO: 25064 - RNA, 18 nt, artificial
  Chemically synthesized
augccuacauuucaagaa

SEQ ID NO: 25065 - RNA, 18 nt, artificial
  Chemically synthesized
cugggagcaucgcgggcc

SEQ ID NO: 25066 - RNA, 18 nt, artificial
  Chemically synthesized
aggguuguauugguucgg

SEQ ID NO: 25067 - RNA, 18 nt, artificial
  Chemically synthesized
augcgggcauccaggucu

SEQ ID NO: 25068 - RNA, 18 nt, artificial
  Chemically synthesized
uccaggugcugcugaguc

SEQ ID NO: 25069 - RNA, 18 nt, artificial
  Chemically synthesized
guguuggguccguccagg

SEQ ID NO: 25070 - RNA, 18 nt, artificial
  Chemically synthesized
gcacucgcagcgguacug

SEQ ID NO: 25071 - RNA, 18 nt, artificial
  Chemically synthesized
accaguccagccguugac

SEQ ID NO: 25072 - RNA, 18 nt, artificial
  Chemically synthesized
ucugccuggcucggcucu

SEQ ID NO: 25073 - RNA, 18 nt, artificial
  Chemically synthesized
gcgagagcaugccggagc

SEQ ID NO: 25074 - RNA, 18 nt, artificial
  Chemically synthesized
gucgcacucaucgauguc

SEQ ID NO: 25075 - RNA, 18 nt, artificial
  Chemically synthesized
gguccagcagcaccuugg

SEQ ID NO: 25076 - RNA, 18 nt, artificial
  Chemically synthesized
gaccuucuugcccugcac

SEQ ID NO: 25077 - RNA, 18 nt, artificial
  Chemically synthesized
agagcaugccggagcugu

SEQ ID NO: 25078 - RNA, 18 nt, artificial
  Chemically synthesized
gguagcucaucaucuggg

SEQ ID NO: 25079 - RNA, 18 nt, artificial
  Chemically synthesized
gggcucucggaugugggc

SEQ ID NO: 25080 - RNA, 18 nt, artificial
  Chemically synthesized
ucaggugcggcccagccc

SEQ ID NO: 25081 - RNA, 18 nt, artificial
  Chemically synthesized
cuggagcaucuucuucgg

SEQ ID NO: 25082 - RNA, 18 nt, artificial
  Chemically synthesized
ucucgcaguugcgcccac

SEQ ID NO: 25083 - RNA, 18 nt, artificial
  Chemically synthesized
augcgggcgaucugggac

SEQ ID NO: 25084 - RNA, 18 nt, artificial
  Chemically synthesized
caccucgcagugcguccc

SEQ ID NO: 25085 - RNA, 18 nt, artificial
  Chemically synthesized
cauguguuuuaaaaaggc

SEQ ID NO: 25086 - RNA, 18 nt, artificial
  Chemically synthesized
uucacacucauuguuguu

SEQ ID NO: 25087 - RNA, 18 nt, artificial
  Chemically synthesized
ucacaggcacacucguag

SEQ ID NO: 25088 - RNA, 18 nt, artificial
  Chemically synthesized
caggcacacucgugggug

SEQ ID NO: 25089 - RNA, 18 nt, artificial
  Chemically synthesized
ugggugcacucuuggcau

SEQ ID NO: 25090 - RNA, 18 nt, artificial
  Chemically synthesized
gacgcacacucguugaug

SEQ ID NO: 25091 - RNA, 18 nt, artificial
  Chemically synthesized
uagcucaucaucugggac

SEQ ID NO: 25092 - RNA, 18 nt, artificial
  Chemically synthesized
ugcgcagcugcuccggcg

SEQ ID NO: 25093 - RNA, 18 nt, artificial
  Chemically synthesized
cuucuuccuccgugccuu

SEQ ID NO: 25094 - RNA, 18 nt, artificial
  Chemically synthesized
cacauuguucacggcggc

SEQ ID NO: 25095 - RNA, 18 nt, artificial
  Chemically synthesized
auggcagacaugcgcagg

SEQ ID NO: 25096 - RNA, 18 nt, artificial
  Chemically synthesized
caaucuccagguagacga

SEQ ID NO: 25097 - RNA, 18 nt, artificial
  Chemically synthesized
augcuccgcacaguccag

SEQ ID NO: 25098 - RNA, 18 nt, artificial
  Chemically synthesized
cugcugcuggauguuugc

SEQ ID NO: 25099 - RNA, 18 nt, artificial
  Chemically synthesized
cuucuucuugcuggccuc

SEQ ID NO: 25100 - RNA, 18 nt, artificial
  Chemically synthesized
ccacgucugacagguagc

SEQ ID NO: 25101 - RNA, 18 nt, artificial
  Chemically synthesized
acacuggcacucgaagga

SEQ ID NO: 25102 - RNA, 18 nt, artificial
  Chemically synthesized
ggugcuggugccagaggc

SEQ ID NO: 25103 - RNA, 18 nt, artificial
  Chemically synthesized
augaagucggagaugacg

SEQ ID NO: 25104 - RNA, 18 nt, artificial
  Chemically synthesized
gcucccgccgcuucuucu

SEQ ID NO: 25105 - RNA, 18 nt, artificial
  Chemically synthesized
uccauaugauccgugaug

SEQ ID NO: 25106 - RNA, 18 nt, artificial
  Chemically synthesized
cacucgcagcgguacugg

SEQ ID NO: 25107 - RNA, 18 nt, artificial
  Chemically synthesized
uuuucugccauaggcuau

SEQ ID NO: 25108 - RNA, 18 nt, artificial
  Chemically synthesized
auagucugccacgccucu

SEQ ID NO: 25109 - RNA, 18 nt, artificial
  Chemically synthesized
aguucugggugccacggg

SEQ ID NO: 25110 - RNA, 18 nt, artificial
  Chemically synthesized
ugcguguugcccgcgucc

SEQ ID NO: 25111 - RNA, 18 nt, artificial
  Chemically synthesized
cacugccgguggucuguc

SEQ ID NO: 25112 - RNA, 18 nt, artificial
  Chemically synthesized
ggaucuggaagacaccuu

SEQ ID NO: 25113 - RNA, 18 nt, artificial
  Chemically synthesized
acucguccagcagccuca

SEQ ID NO: 25114 - RNA, 18 nt, artificial
  Chemically synthesized
ccuccucacagaaagugc

SEQ ID NO: 25115 - RNA, 18 nt, artificial
  Chemically synthesized
acacaacagacucauuca

SEQ ID NO: 25116 - RNA, 18 nt, artificial
  Chemically synthesized
uggaagucauugacgcgc

SEQ ID NO: 25117 - RNA, 18 nt, artificial
  Chemically synthesized
uccucccaaacuaggagg

SEQ ID NO: 25118 - RNA, 18 nt, artificial
  Chemically synthesized
cucaggaagcuccggccc

SEQ ID NO: 25119 - RNA, 18 nt, artificial
  Chemically synthesized
cacccagggucacagucg

SEQ ID NO: 25120 - RNA, 18 nt, artificial
  Chemically synthesized
ugcugggucugcaccagg

SEQ ID NO: 25121 - RNA, 18 nt, artificial
  Chemically synthesized
caccugcugggucugcac

SEQ ID NO: 25122 - RNA, 18 nt, artificial
  Chemically synthesized
uggcgucgugccaucaug

SEQ ID NO: 25123 - RNA, 18 nt, artificial
  Chemically synthesized
aggcacucguugacaucc

SEQ ID NO: 25124 - RNA, 18 nt, artificial
  Chemically synthesized
aaccggaacuucuugguc

SEQ ID NO: 25125 - RNA, 18 nt, artificial
  Chemically synthesized
ugcaugaugccuacauuu

SEQ ID NO: 25126 - RNA, 18 nt, artificial
  Chemically synthesized
cgcccacagugaaauuca

SEQ ID NO: 25127 - RNA, 18 nt, artificial
  Chemically synthesized
aaggcggucucgcccgug

SEQ ID NO: 25128 - RNA, 18 nt, artificial
  Chemically synthesized
cucgucuguguugaccuc

SEQ ID NO: 25129 - RNA, 18 nt, artificial
  Chemically synthesized
cuggcugcugagcucacg

SEQ ID NO: 25130 - RNA, 18 nt, artificial
  Chemically synthesized
auggcaacaucuaaccca

SEQ ID NO: 25131 - RNA, 18 nt, artificial
  Chemically synthesized
caguugcacuuguacccg

SEQ ID NO: 25132 - RNA, 18 nt, artificial
  Chemically synthesized
ugcggaaggugagccagc

SEQ ID NO: 25133 - RNA, 18 nt, artificial
  Chemically synthesized
cugggcuugcggaccuuc

SEQ ID NO: 25134 - RNA, 18 nt, artificial
  Chemically synthesized
aguguuggguccguccag

SEQ ID NO: 25135 - RNA, 18 nt, artificial
  Chemically synthesized
guggcaccuguguagggc

SEQ ID NO: 25136 - RNA, 18 nt, artificial
  Chemically synthesized
acuugcaggaguagccgc

SEQ ID NO: 25137 - RNA, 18 nt, artificial
  Chemically synthesized
cugguagcucaucaucug

SEQ ID NO: 25138 - RNA, 18 nt, artificial
  Chemically synthesized
cguucaggugcccgaugc

SEQ ID NO: 25139 - RNA, 18 nt, artificial
  Chemically synthesized
gccgcuucuucuugcugg

SEQ ID NO: 25140 - RNA, 18 nt, artificial
  Chemically synthesized
aggccuuugcugcugggc

SEQ ID NO: 25141 - RNA, 18 nt, artificial
  Chemically synthesized
augccgucugugcaggag

SEQ ID NO: 25142 - RNA, 18 nt, artificial
  Chemically synthesized
uccaggucuguggcucgg

SEQ ID NO: 25143 - RNA, 18 nt, artificial
  Chemically synthesized
uccucauguagaucacuu

SEQ ID NO: 25144 - RNA, 18 nt, artificial
  Chemically synthesized
cuuugccuccguuugccu

SEQ ID NO: 25145 - RNA, 18 nt, artificial
  Chemically synthesized
aacugggcugcggucacg

SEQ ID NO: 25146 - RNA, 18 nt, artificial
  Chemically synthesized
uguugcacugcaggcugc

SEQ ID NO: 25147 - RNA, 18 nt, artificial
  Chemically synthesized
gugccacgggcgucgcag

SEQ ID NO: 25148 - RNA, 18 nt, artificial
  Chemically synthesized
ucgcccgugcggucuguc

SEQ ID NO: 25149 - RNA, 18 nt, artificial
  Chemically synthesized
agcacucguccaccaggu

SEQ ID NO: 25150 - RNA, 18 nt, artificial
  Chemically synthesized
aggaaugcggccacgucg

SEQ ID NO: 25151 - RNA, 18 nt, artificial
  Chemically synthesized
cacauggcaacaucuaac

SEQ ID NO: 25152 - RNA, 18 nt, artificial
  Chemically synthesized
ucguugauguuggucugg

SEQ ID NO: 25153 - RNA, 18 nt, artificial
  Chemically synthesized
aagucauugacgcgcugc

SEQ ID NO: 25154 - RNA, 18 nt, artificial
  Chemically synthesized
gugguggcggcugcaggc

SEQ ID NO: 25155 - RNA, 18 nt, artificial
  Chemically synthesized
ucagcgugagcaggucgc

SEQ ID NO: 25156 - RNA, 18 nt, artificial
  Chemically synthesized
uaguccaggauguggcac

SEQ ID NO: 25157 - RNA, 18 nt, artificial
  Chemically synthesized
acacuccgagaacacauu

SEQ ID NO: 25158 - RNA, 18 nt, artificial
  Chemically synthesized
ugcugcugaguccacugc

SEQ ID NO: 25159 - RNA, 18 nt, artificial
  Chemically synthesized
augcuggugggagggcug

SEQ ID NO: 25160 - RNA, 18 nt, artificial
  Chemically synthesized
aguccacugccggugguc

SEQ ID NO: 25161 - RNA, 18 nt, artificial
  Chemically synthesized
gaagcuguaguccaggau

SEQ ID NO: 25162 - RNA, 18 nt, artificial
  Chemically synthesized
gacaggaccaaaggacgc

SEQ ID NO: 25163 - RNA, 18 nt, artificial
  Chemically synthesized
aggagaagcucucauagu

SEQ ID NO: 25164 - RNA, 18 nt, artificial
  Chemically synthesized
gaaaacccuggcucucag

SEQ ID NO: 25165 - RNA, 18 nt, artificial
  Chemically synthesized
gcaugacacacaacagac

SEQ ID NO: 25166 - RNA, 18 nt, artificial
  Chemically synthesized
gaacacauuuucacaagc

SEQ ID NO: 25167 - RNA, 18 nt, artificial
  Chemically synthesized
uugcccgcguccacacag

SEQ ID NO: 25168 - RNA, 18 nt, artificial
  Chemically synthesized
cuaugcucguucaacuuc

SEQ ID NO: 25169 - RNA, 18 nt, artificial
  Chemically synthesized
ugcucaggcaccuguagc

SEQ ID NO: 25170 - RNA, 18 nt, artificial
  Chemically synthesized
ugcaguccucaccagucc

SEQ ID NO: 25171 - RNA, 18 nt, artificial
  Chemically synthesized
guguugaugccgucugug

SEQ ID NO: 25172 - RNA, 18 nt, artificial
  Chemically synthesized
cgaugucgugaugcaugc

SEQ ID NO: 25173 - RNA, 18 nt, artificial
  Chemically synthesized
acgcuugaagaccacguu

SEQ ID NO: 25174 - RNA, 18 nt, artificial
  Chemically synthesized
ccaggagcuuuuuggacu

SEQ ID NO: 25175 - RNA, 18 nt, artificial
  Chemically synthesized
guagccacuggucauguc

SEQ ID NO: 25176 - RNA, 18 nt, artificial
  Chemically synthesized
accaugccaugcugcagg

SEQ ID NO: 25177 - RNA, 18 nt, artificial
  Chemically synthesized
guugcugaugcaugcguc

SEQ ID NO: 25178 - RNA, 18 nt, artificial
  Chemically synthesized
acacgcaguuguagccac

SEQ ID NO: 25179 - RNA, 18 nt, artificial
  Chemically synthesized
aggugaggcuggguggcc

SEQ ID NO: 25180 - RNA, 18 nt, artificial
  Chemically synthesized
gcacacucguccacaucg

SEQ ID NO: 25181 - RNA, 18 nt, artificial
  Chemically synthesized
cacacucguugauguccu

SEQ ID NO: 25182 - RNA, 18 nt, artificial
  Chemically synthesized
aggaucuggaagacaccu

SEQ ID NO: 25183 - RNA, 18 nt, artificial
  Chemically synthesized
ccaucuaaaacacauggc

SEQ ID NO: 25184 - RNA, 18 nt, artificial
  Chemically synthesized
aaucuuuucauccuacgu

SEQ ID NO: 25185 - RNA, 18 nt, artificial
  Chemically synthesized
gaagcaggcggcgcuggc

SEQ ID NO: 25186 - RNA, 18 nt, artificial
  Chemically synthesized
aucuacggcguugacguc

SEQ ID NO: 25187 - RNA, 18 nt, artificial
  Chemically synthesized
cugggagcaucgcgggcc

SEQ ID NO: 25188 - RNA, 18 nt, artificial
  Chemically synthesized
cgcugaagcccucccggc

SEQ ID NO: 25189 - RNA, 18 nt, artificial
  Chemically synthesized
ccacacucguugacaucc

SEQ ID NO: 25190 - RNA, 18 nt, artificial
  Chemically synthesized
cucugugcagucaggcgu

SEQ ID NO: 25191 - RNA, 18 nt, artificial
  Chemically synthesized
ugcccugaggagugcagg

SEQ ID NO: 25192 - RNA, 18 nt, artificial
  Chemically synthesized
agacacuuugaagcccuc

SEQ ID NO: 25193 - RNA, 18 nt, artificial
  Chemically synthesized
ccuccucgaucagcggcg

SEQ ID NO: 25194 - RNA, 18 nt, artificial
  Chemically synthesized
cuguugcagcccuggucg

SEQ ID NO: 25195 - RNA, 18 nt, artificial
  Chemically synthesized
accacguuggugugcagc

SEQ ID NO: 25196 - RNA, 18 nt, artificial
  Chemically synthesized
cggaacuucuuggucucc

SEQ ID NO: 25197 - RNA, 18 nt, artificial
  Chemically synthesized
augcaugcgcuccugugc

SEQ ID NO: 25198 - RNA, 18 nt, artificial
  Chemically synthesized
cucacaguagcugccugu

SEQ ID NO: 25199 - RNA, 18 nt, artificial
  Chemically synthesized
uugccuccguuugccucu

SEQ ID NO: 25200 - RNA, 18 nt, artificial
  Chemically synthesized
gccuggugccacacuccc

SEQ ID NO: 25201 - RNA, 18 nt, artificial
  Chemically synthesized
acaugaagugcagcugcg

SEQ ID NO: 25202 - RNA, 18 nt, artificial
  Chemically synthesized
guucuugcagggcgagga

SEQ ID NO: 25203 - RNA, 18 nt, artificial
  Chemically synthesized
aaccaucuaaaacacaug

SEQ ID NO: 25204 - RNA, 18 nt, artificial
  Chemically synthesized
gccauugaugacggacuc

SEQ ID NO: 25205 - RNA, 18 nt, artificial
  Chemically synthesized
ccaugggugcacucuugg

SEQ ID NO: 25206 - RNA, 18 nt, artificial
  Chemically synthesized
gugugaguugaugagguc

SEQ ID NO: 25207 - RNA, 18 nt, artificial
  Chemically synthesized
cucaaugugcccggcucu

SEQ ID NO: 25208 - RNA, 18 nt, artificial
  Chemically synthesized
uugugacacggguugggc

SEQ ID NO: 25209 - RNA, 18 nt, artificial
  Chemically synthesized
guguaaguguuggguccg

SEQ ID NO: 25210 - RNA, 18 nt, artificial
  Chemically synthesized
caugcaugaugccuacau

SEQ ID NO: 25211 - RNA, 18 nt, artificial
  Chemically synthesized
cucuggaugcagcuucuc

SEQ ID NO: 25212 - RNA, 18 nt, artificial
  Chemically synthesized
guugauguuacacaugcu

SEQ ID NO: 25213 - RNA, 18 nt, artificial
  Chemically synthesized
gucuguggcucgguuccg

SEQ ID NO: 25214 - RNA, 18 nt, artificial
  Chemically synthesized
ugcccagcgaggcgagcg

SEQ ID NO: 25215 - RNA, 18 nt, artificial
  Chemically synthesized
gcagaugcacuggaacuc

SEQ ID NO: 25216 - RNA, 18 nt, artificial
  Chemically synthesized
uccacaucguacuggcac

SEQ ID NO: 25217 - RNA, 18 nt, artificial
  Chemically synthesized
agcacuuguagguguugg

SEQ ID NO: 25218 - RNA, 18 nt, artificial
  Chemically synthesized
ucgaucuccucagagcag

SEQ ID NO: 25219 - RNA, 18 nt, artificial
  Chemically synthesized
gugaagccauugaugccg

SEQ ID NO: 25220 - RNA, 18 nt, artificial
  Chemically synthesized
ccgucugugcaggagccc

SEQ ID NO: 25221 - RNA, 18 nt, artificial
  Chemically synthesized
aggugccguuguuaaagc

SEQ ID NO: 25222 - RNA, 18 nt, artificial
  Chemically synthesized
auccagguugaucucgca

SEQ ID NO: 25223 - RNA, 18 nt, artificial
  Chemically synthesized
agguucugcugcugcauc

SEQ ID NO: 25224 - RNA, 18 nt, artificial
  Chemically synthesized
cagcaaggcuacugugca

SEQ ID NO: 25225 - RNA, 18 nt, artificial
  Chemically synthesized
uuggcaucagcuggcacu

SEQ ID NO: 25226 - RNA, 18 nt, artificial
  Chemically synthesized
acggagacugcuggaacg

SEQ ID NO: 25227 - RNA, 18 nt, artificial
  Chemically synthesized
agacgcacucguugacgu

SEQ ID NO: 25228 - RNA, 18 nt, artificial
  Chemically synthesized
gaaugcgggcgaucuggg

SEQ ID NO: 25229 - RNA, 18 nt, artificial
  Chemically synthesized
acugccgguggucugucu

SEQ ID NO: 25230 - RNA, 18 nt, artificial
  Chemically synthesized
accagucggagacguugg

SEQ ID NO: 25231 - RNA, 18 nt, artificial
  Chemically synthesized
auaaaaaggcaguguuuc

SEQ ID NO: 25232 - RNA, 18 nt, artificial
  Chemically synthesized
cagucaggcguguuguuc

SEQ ID NO: 25233 - RNA, 18 nt, artificial
  Chemically synthesized
uggcacacucguugaugu

SEQ ID NO: 25234 - RNA, 18 nt, artificial
  Chemically synthesized
accuuguugcccgcgucc

SEQ ID NO: 25235 - RNA, 18 nt, artificial
  Chemically synthesized
gcaggaaguggaaggagc

SEQ ID NO: 25236 - RNA, 18 nt, artificial
  Chemically synthesized
gcacucuggaagcacugc

SEQ ID NO: 25237 - RNA, 18 nt, artificial
  Chemically synthesized
cgccaugcaggcagggcu

SEQ ID NO: 25238 - RNA, 18 nt, artificial
  Chemically synthesized
acaucuugggacgcaucu

SEQ ID NO: 25239 - RNA, 18 nt, artificial
  Chemically synthesized
ucuccuacaaaacacggg

SEQ ID NO: 25240 - RNA, 18 nt, artificial
  Chemically synthesized
ucgucgaugucggucucg

SEQ ID NO: 25241 - RNA, 18 nt, artificial
  Chemically synthesized
cuggaccacuggucaggg

SEQ ID NO: 25242 - RNA, 18 nt, artificial
  Chemically synthesized
acucgggcagcucgcacg

SEQ ID NO: 25243 - RNA, 18 nt, artificial
  Chemically synthesized
acguuggugugcagcacg

SEQ ID NO: 25244 - RNA, 18 nt, artificial
  Chemically synthesized
uugagggagcagucaccg

SEQ ID NO: 25245 - RNA, 18 nt, artificial
  Chemically synthesized
gcagaagcagagguaggc

SEQ ID NO: 25246 - RNA, 18 nt, artificial
  Chemically synthesized
cucccuguguagcccggc

SEQ ID NO: 25247 - RNA, 18 nt, artificial
  Chemically synthesized
ggcugcugagcucacgcc

SEQ ID NO: 25248 - RNA, 18 nt, artificial
  Chemically synthesized
gguuguugcacugcaggc

SEQ ID NO: 25249 - RNA, 18 nt, artificial
  Chemically synthesized
uugcuuccacaggccagg

SEQ ID NO: 25250 - RNA, 18 nt, artificial
  Chemically synthesized
ggauugcagucguccacg

SEQ ID NO: 25251 - RNA, 18 nt, artificial
  Chemically synthesized
caggcugccgcagguacg

SEQ ID NO: 25252 - RNA, 18 nt, artificial
  Chemically synthesized
ucagcggcauccaggugc

SEQ ID NO: 25253 - RNA, 18 nt, artificial
  Chemically synthesized
cauccugccggcaggugg

SEQ ID NO: 25254 - RNA, 18 nt, artificial
  Chemically synthesized
cugggcuugcggaccuuc

SEQ ID NO: 25255 - RNA, 18 nt, artificial
  Chemically synthesized
cagcuguagccgcccacc

SEQ ID NO: 25256 - RNA, 18 nt, artificial
  Chemically synthesized
ccgggaacuggcauucgg

SEQ ID NO: 25257 - RNA, 18 nt, artificial
  Chemically synthesized
gauguuggcaucugcgcu

SEQ ID NO: 25258 - RNA, 18 nt, artificial
  Chemically synthesized
guggcagauguaggaggc

SEQ ID NO: 25259 - RNA, 18 nt, artificial
  Chemically synthesized
acacucguugauguuggu

SEQ ID NO: 25260 - RNA, 18 nt, artificial
  Chemically synthesized
cauugaugccguccucgc

SEQ ID NO: 25261 - RNA, 18 nt, artificial
  Chemically synthesized
ccauugacaggguuggug

SEQ ID NO: 25262 - RNA, 18 nt, artificial
  Chemically synthesized
caacagacucauucauua

SEQ ID NO: 25263 - RNA, 18 nt, artificial
  Chemically synthesized
ccacguacaugaagugca

SEQ ID NO: 25264 - RNA, 18 nt, artificial
  Chemically synthesized
ugcugaguccacugccgg

SEQ ID NO: 25265 - RNA, 18 nt, artificial
  Chemically synthesized
gcugcugaguccacugcc

SEQ ID NO: 25266 - RNA, 18 nt, artificial
  Chemically synthesized
uccagcagcaccuuggcg

SEQ ID NO: 25267 - RNA, 18 nt, artificial
  Chemically synthesized
ucaggcguguuguucuca

SEQ ID NO: 25268 - RNA, 18 nt, artificial
  Chemically synthesized
ugcucguucaacuucccu

SEQ ID NO: 25269 - RNA, 18 nt, artificial
  Chemically synthesized
gggcggcuccacggucuc

SEQ ID NO: 25270 - RNA, 18 nt, artificial
  Chemically synthesized
gagcaucuucuucggaac

SEQ ID NO: 25271 - RNA, 18 nt, artificial
  Chemically synthesized
gggcgaggagucacacca

SEQ ID NO: 25272 - RNA, 18 nt, artificial
  Chemically synthesized
cauugacguccaugcagu

SEQ ID NO: 25273 - RNA, 18 nt, artificial
  Chemically synthesized
ucaauacacgugcccugg

SEQ ID NO: 25274 - RNA, 18 nt, artificial
  Chemically synthesized
ugcacuggcugucacagu

SEQ ID NO: 25275 - RNA, 18 nt, artificial
  Chemically synthesized
augucgcgcggcaggcgg

SEQ ID NO: 25276 - RNA, 18 nt, artificial
  Chemically synthesized
ucacaccagugcacaagg

SEQ ID NO: 25277 - RNA, 18 nt, artificial
  Chemically synthesized
uggccacacucguugaca

SEQ ID NO: 25278 - RNA, 18 nt, artificial
  Chemically synthesized
agcugggugggcaguggc

SEQ ID NO: 25279 - RNA, 18 nt, artificial
  Chemically synthesized
cuccacggucucacucug

SEQ ID NO: 25280 - RNA, 18 nt, artificial
  Chemically synthesized
uccgcacaguccagcccg

SEQ ID NO: 25281 - RNA, 18 nt, artificial
  Chemically synthesized
cagugcacacccucguag

SEQ ID NO: 25282 - RNA, 18 nt, artificial
  Chemically synthesized
cugacgucccucacuggc

SEQ ID NO: 25283 - RNA, 18 nt, artificial
  Chemically synthesized
gucgaucuccucagagca

SEQ ID NO: 25284 - RNA, 18 nt, artificial
  Chemically synthesized
uggauucacacucauugu

SEQ ID NO: 25285 - RNA, 18 nt, artificial
  Chemically synthesized
gcgugcggaaggugagcc

SEQ ID NO: 25286 - RNA, 18 nt, artificial
  Chemically synthesized
agagcccuccaugcuggc

SEQ ID NO: 25287 - RNA, 18 nt, artificial
  Chemically synthesized
guucgagacgcacucguu

SEQ ID NO: 25288 - RNA, 18 nt, artificial
  Chemically synthesized
uucuugcaguuguuuccu

SEQ ID NO: 25289 - RNA, 18 nt, artificial
  Chemically synthesized
aggcugcccugaggagug

SEQ ID NO: 25290 - RNA, 18 nt, artificial
  Chemically synthesized
agucgcacucauugacau

SEQ ID NO: 25291 - RNA, 18 nt, artificial
  Chemically synthesized
guucucgcugcaguccuc

SEQ ID NO: 25292 - RNA, 18 nt, artificial
  Chemically synthesized
cucggauugccugcacuc

SEQ ID NO: 25293 - RNA, 18 nt, artificial
  Chemically synthesized
cuggcacacucguugaug

SEQ ID NO: 25294 - RNA, 18 nt, artificial
  Chemically synthesized
gccgggacagccacucgc

SEQ ID NO: 25295 - RNA, 18 nt, artificial
  Chemically synthesized
gagguaggcguugucgcg

SEQ ID NO: 25296 - RNA, 18 nt, artificial
  Chemically synthesized
cauugacaggguuggugu

SEQ ID NO: 25297 - RNA, 18 nt, artificial
  Chemically synthesized
agguaggcguugucgcgg

SEQ ID NO: 25298 - RNA, 18 nt, artificial
  Chemically synthesized
caugggugcacucuuggc

SEQ ID NO: 25299 - RNA, 18 nt, artificial
  Chemically synthesized
acaaucgucgauauuuuc

SEQ ID NO: 25300 - RNA, 18 nt, artificial
  Chemically synthesized
acgucugacagguagcca

SEQ ID NO: 25301 - RNA, 18 nt, artificial
  Chemically synthesized
cauaauacugaaccugaa

SEQ ID NO: 25302 - RNA, 18 nt, artificial
  Chemically synthesized
uucuccaacaucauuucu

SEQ ID NO: 25303 - RNA, 18 nt, artificial
  Chemically synthesized
ccaguggcugcacgucug

SEQ ID NO: 25304 - RNA, 18 nt, artificial
  Chemically synthesized
cuuggcggucucguagcu

SEQ ID NO: 25305 - RNA, 18 nt, artificial
  Chemically synthesized
aaugcggccacgucggug

SEQ ID NO: 25306 - RNA, 18 nt, artificial
  Chemically synthesized
ugacaggugccgccaugc

SEQ ID NO: 25307 - RNA, 18 nt, artificial
  Chemically synthesized
cgcaguccgugcaguugg

SEQ ID NO: 25308 - RNA, 18 nt, artificial
  Chemically synthesized
gugccuugagguccuugg

SEQ ID NO: 25309 - RNA, 18 nt, artificial
  Chemically synthesized
cgugguuguugcacugca

SEQ ID NO: 25310 - RNA, 18 nt, artificial
  Chemically synthesized
aagcccucagggaaccag

SEQ ID NO: 25311 - RNA, 18 nt, artificial
  Chemically synthesized
ccacucgcacuccgcgcu

SEQ ID NO: 25312 - RNA, 18 nt, artificial
  Chemically synthesized
gcacacucaucgauguug

SEQ ID NO: 25313 - RNA, 18 nt, artificial
  Chemically synthesized
ugcucccuguguagcccg

SEQ ID NO: 25314 - RNA, 18 nt, artificial
  Chemically synthesized
acuucccuucuccaacau

SEQ ID NO: 25315 - RNA, 18 nt, artificial
  Chemically synthesized
cagugcacaagguucugg

SEQ ID NO: 25316 - RNA, 18 nt, artificial
  Chemically synthesized
aauagugugcaccgccag

SEQ ID NO: 25317 - RNA, 18 nt, artificial
  Chemically synthesized
agcccuugccguccuggg

SEQ ID NO: 25318 - RNA, 18 nt, artificial
  Chemically synthesized
gugcugcugaguccacug

SEQ ID NO: 25319 - RNA, 18 nt, artificial
  Chemically synthesized
guuggacgcacacucguu

SEQ ID NO: 25320 - RNA, 18 nt, artificial
  Chemically synthesized
cguugaagcaggagcucu

SEQ ID NO: 25321 - RNA, 18 nt, artificial
  Chemically synthesized
ggaccaagaacuuguaua

SEQ ID NO: 25322 - RNA, 18 nt, artificial
  Chemically synthesized
gcaguuguagguguucac

SEQ ID NO: 25323 - RNA, 18 nt, artificial
  Chemically synthesized
acggcagcggagcguccc

SEQ ID NO: 25324 - RNA, 18 nt, artificial
  Chemically synthesized
ccagcaccaccucacacg

SEQ ID NO: 25325 - RNA, 18 nt, artificial
  Chemically synthesized
uacgagcgucauucucac

SEQ ID NO: 25326 - RNA, 18 nt, artificial
  Chemically synthesized
aggcggucucgcccgugc

SEQ ID NO: 25327 - RNA, 18 nt, artificial
  Chemically synthesized
ccacgggcuccucgaacc

SEQ ID NO: 25328 - RNA, 18 nt, artificial
  Chemically synthesized
ggcagaauagugugcacc

SEQ ID NO: 25329 - RNA, 18 nt, artificial
  Chemically synthesized
cacggacggagacugcug

SEQ ID NO: 25330 - RNA, 18 nt, artificial
  Chemically synthesized
cuguugcagcccuggucg

SEQ ID NO: 25331 - RNA, 18 nt, artificial
  Chemically synthesized
uccucgguacaguacuga

SEQ ID NO: 25332 - RNA, 18 nt, artificial
  Chemically synthesized
guauugcaaaaaucugcu

SEQ ID NO: 25333 - RNA, 18 nt, artificial
  Chemically synthesized
cggagacugcuggaacgg

SEQ ID NO: 25334 - RNA, 18 nt, artificial
  Chemically synthesized
uccgugugugacccaggc

SEQ ID NO: 25335 - RNA, 18 nt, artificial
  Chemically synthesized
cagcggcacuuguacucc

SEQ ID NO: 25336 - RNA, 18 nt, artificial
  Chemically synthesized
acacucguugacauccug

SEQ ID NO: 25337 - RNA, 18 nt, artificial
  Chemically synthesized
ugacacacaacagacuca

SEQ ID NO: 25338 - RNA, 18 nt, artificial
  Chemically synthesized
caguggcugcacgucugc

SEQ ID NO: 25339 - RNA, 18 nt, artificial
  Chemically synthesized
ugcacacccucguagccg

SEQ ID NO: 25340 - RNA, 18 nt, artificial
  Chemically synthesized
ggcgucaggaacugggcu

SEQ ID NO: 25341 - RNA, 18 nt, artificial
  Chemically synthesized
uagcccugcagacacugg

SEQ ID NO: 25342 - RNA, 18 nt, artificial
  Chemically synthesized
cguugaugucgaccucac

SEQ ID NO: 25343 - RNA, 18 nt, artificial
  Chemically synthesized
gcuggaccacuggucagg

SEQ ID NO: 25344 - RNA, 18 nt, artificial
  Chemically synthesized
uggcaggcauuuggcauc

SEQ ID NO: 25345 - RNA, 18 nt, artificial
  Chemically synthesized
uggccuccagcaggcgcu

SEQ ID NO: 25346 - RNA, 18 nt, artificial
  Chemically synthesized
aucaguggcgucgugcca

SEQ ID NO: 25347 - RNA, 18 nt, artificial
  Chemically synthesized
gguguuguggcagguccc

SEQ ID NO: 25348 - RNA, 18 nt, artificial
  Chemically synthesized
uggcaccauucuugcagg

SEQ ID NO: 25349 - RNA, 18 nt, artificial
  Chemically synthesized
caucagcuggcacucguc

SEQ ID NO: 25350 - RNA, 18 nt, artificial
  Chemically synthesized
gggacacugugcaggcug

SEQ ID NO: 25351 - RNA, 18 nt, artificial
  Chemically synthesized
aucucgggcuuggccgcc

SEQ ID NO: 25352 - RNA, 18 nt, artificial
  Chemically synthesized
ggugaagccaucaggccc

SEQ ID NO: 25353 - RNA, 18 nt, artificial
  Chemically synthesized
ugcuggauguuugcuggc

SEQ ID NO: 25354 - RNA, 18 nt, artificial
  Chemically synthesized
gagaggcacucgucgauc

SEQ ID NO: 25355 - RNA, 18 nt, artificial
  Chemically synthesized
gaggguuguauugguucg

SEQ ID NO: 25356 - RNA, 18 nt, artificial
  Chemically synthesized
ucgcaguuggguccugug

SEQ ID NO: 25357 - RNA, 18 nt, artificial
  Chemically synthesized
gcauugaccauucaaacu

SEQ ID NO: 25358 - RNA, 18 nt, artificial
  Chemically synthesized
gaggcugcccagguagcc

SEQ ID NO: 25359 - RNA, 18 nt, artificial
  Chemically synthesized
gguucgagacgcacucgu

SEQ ID NO: 25360 - RNA, 18 nt, artificial
  Chemically synthesized
ucuuccucgcuguugccc

SEQ ID NO: 25361 - RNA, 18 nt, artificial
  Chemically synthesized
ugcaucuguaaguuuugu

SEQ ID NO: 25362 - RNA, 18 nt, artificial
  Chemically synthesized
ucuggaagcacugcgagg

SEQ ID NO: 25363 - RNA, 18 nt, artificial
  Chemically synthesized
aacaucuugggacgcauc

SEQ ID NO: 25364 - RNA, 18 nt, artificial
  Chemically synthesized
acucuggcgggcagcggc

SEQ ID NO: 25365 - RNA, 18 nt, artificial
  Chemically synthesized
aggcugucccggcaggcc

SEQ ID NO: 25366 - RNA, 18 nt, artificial
  Chemically synthesized
ucauccacguccuggcug

SEQ ID NO: 25367 - RNA, 18 nt, artificial
  Chemically synthesized
guacgagcgucauucuca

SEQ ID NO: 25368 - RNA, 18 nt, artificial
  Chemically synthesized
auguuggucuggcaguug

SEQ ID NO: 25369 - RNA, 18 nt, artificial
  Chemically synthesized
ucacuuguuuccuauuuc

SEQ ID NO: 25370 - RNA, 18 nt, artificial
  Chemically synthesized
aacgucgucaauacacgu

SEQ ID NO: 25371 - RNA, 18 nt, artificial
  Chemically synthesized
aaaaaggcaguguuucug

SEQ ID NO: 25372 - RNA, 18 nt, artificial
  Chemically synthesized
uccaugcuggcacaggcg

SEQ ID NO: 25373 - RNA, 18 nt, artificial
  Chemically synthesized
uugcccgcaugcucgcag

SEQ ID NO: 25374 - RNA, 18 nt, artificial
  Chemically synthesized
guguuggaggccacggcg

SEQ ID NO: 25375 - RNA, 18 nt, artificial
  Chemically synthesized
accuguagcugguggcug

SEQ ID NO: 25376 - RNA, 18 nt, artificial
  Chemically synthesized
uguuggguccguccaggc

SEQ ID NO: 25377 - RNA, 18 nt, artificial
  Chemically synthesized
cagacacuuugaagcccu

SEQ ID NO: 25378 - RNA, 18 nt, artificial
  Chemically synthesized
caugggcggcuaaggcuc

SEQ ID NO: 25379 - RNA, 18 nt, artificial
  Chemically synthesized
aucgaucuuguccagaca

SEQ ID NO: 25380 - RNA, 18 nt, artificial
  Chemically synthesized
guccugacaggugccgcc

SEQ ID NO: 25381 - RNA, 18 nt, artificial
  Chemically synthesized
ugcggucacgggugggac

SEQ ID NO: 25382 - RNA, 18 nt, artificial
  Chemically synthesized
aguuggagcccucguuac

SEQ ID NO: 25383 - RNA, 18 nt, artificial
  Chemically synthesized
caaaaaucugcuccuccc

SEQ ID NO: 25384 - RNA, 18 nt, artificial
  Chemically synthesized
acaacagacucauucauu

SEQ ID NO: 25385 - RNA, 18 nt, artificial
  Chemically synthesized
cauggcaacaucuaaccc

SEQ ID NO: 25386 - RNA, 18 nt, artificial
  Chemically synthesized
gauguggcacaagagccc

SEQ ID NO: 25387 - RNA, 18 nt, artificial
  Chemically synthesized
cgguacuggguguggguc

SEQ ID NO: 25388 - RNA, 18 nt, artificial
  Chemically synthesized
acuggcaugacacacaac

SEQ ID NO: 25389 - RNA, 18 nt, artificial
  Chemically synthesized
caugucccggcguucuug

SEQ ID NO: 25390 - RNA, 18 nt, artificial
  Chemically synthesized
cguugggcgagcagagcg

SEQ ID NO: 25391 - RNA, 18 nt, artificial
  Chemically synthesized
cuggugggagggcuggag

SEQ ID NO: 25392 - RNA, 18 nt, artificial
  Chemically synthesized
cuacguaggaaaacccug

SEQ ID NO: 25393 - RNA, 18 nt, artificial
  Chemically synthesized
cauuuucacaagcaugcu

SEQ ID NO: 25394 - RNA, 18 nt, artificial
  Chemically synthesized
cacuugcccgcaugcucg

SEQ ID NO: 25395 - RNA, 18 nt, artificial
  Chemically synthesized
cugcagacacuggcacuc

SEQ ID NO: 25396 - RNA, 18 nt, artificial
  Chemically synthesized
agacgcccgaaggcuugg

SEQ ID NO: 25397 - RNA, 18 nt, artificial
  Chemically synthesized
agcgcaggcugccgcagg

SEQ ID NO: 25398 - RNA, 18 nt, artificial
  Chemically synthesized
cgcccaccugguccacgc

SEQ ID NO: 25399 - RNA, 18 nt, artificial
  Chemically synthesized
acgggcucagaacgcacu

SEQ ID NO: 25400 - RNA, 18 nt, artificial
  Chemically synthesized
acgugcccugguucagac

SEQ ID NO: 25401 - RNA, 18 nt, artificial
  Chemically synthesized
ugcccugguucagacaug

SEQ ID NO: 25402 - RNA, 18 nt, artificial
  Chemically synthesized
cguccacgcaggugccac

SEQ ID NO: 25403 - RNA, 18 nt, artificial
  Chemically synthesized
uccucacagaaagugccc

SEQ ID NO: 25404 - RNA, 18 nt, artificial
  Chemically synthesized
acaugcucccuguguagc

SEQ ID NO: 25405 - RNA, 18 nt, artificial
  Chemically synthesized
uucuugcagggcgaggag

SEQ ID NO: 25406 - RNA, 18 nt, artificial
  Chemically synthesized
uguguagcccggcucaca

SEQ ID NO: 25407 - RNA, 18 nt, artificial
  Chemically synthesized
acaccagugcacaagguu

SEQ ID NO: 25408 - RNA, 18 nt, artificial
  Chemically synthesized
uuguucacggcggcggcc

SEQ ID NO: 25409 - RNA, 18 nt, artificial
  Chemically synthesized
cagcaccuuggcggucuc

SEQ ID NO: 25410 - RNA, 18 nt, artificial
  Chemically synthesized
gcugggugagcacucguc

SEQ ID NO: 25411 - RNA, 18 nt, artificial
  Chemically synthesized
ugcuggagcaucuucuuc

SEQ ID NO: 25412 - RNA, 18 nt, artificial
  Chemically synthesized
ucccuguguagcccggcu

SEQ ID NO: 25413 - RNA, 18 nt, artificial
  Chemically synthesized
aaagugguccagcagcac

SEQ ID NO: 25414 - RNA, 18 nt, artificial
  Chemically synthesized
ugggccagucucaaaggc

SEQ ID NO: 25415 - RNA, 18 nt, artificial
  Chemically synthesized
ugaagugguccuugcagu

SEQ ID NO: 25416 - RNA, 18 nt, artificial
  Chemically synthesized
uugaaggccuccggaaug

SEQ ID NO: 25417 - RNA, 18 nt, artificial
  Chemically synthesized
ucgaccucacaggucugc

SEQ ID NO: 25418 - RNA, 18 nt, artificial
  Chemically synthesized
cacacagacgcccgaagg

SEQ ID NO: 25419 - RNA, 18 nt, artificial
  Chemically synthesized
agggcuggcuggagcacu

SEQ ID NO: 25420 - RNA, 18 nt, artificial
  Chemically synthesized
cccgcacacucaucgaug

SEQ ID NO: 25421 - RNA, 18 nt, artificial
  Chemically synthesized
aguugggaccgcugaagc

SEQ ID NO: 25422 - RNA, 18 nt, artificial
  Chemically synthesized
aagcuccggcccaggugg

SEQ ID NO: 25423 - RNA, 18 nt, artificial
  Chemically synthesized
caccacguggcauguccc

SEQ ID NO: 25424 - RNA, 18 nt, artificial
  Chemically synthesized
gcaguggcagcgguagcc

SEQ ID NO: 25425 - RNA, 18 nt, artificial
  Chemically synthesized
aggcgaggaguagcugug

SEQ ID NO: 25426 - RNA, 18 nt, artificial
  Chemically synthesized
uccuugcaguacuggucg

SEQ ID NO: 25427 - RNA, 18 nt, artificial
  Chemically synthesized
uugugcaggcuggcgccc

SEQ ID NO: 25428 - RNA, 18 nt, artificial
  Chemically synthesized
ggucucgcagugguggcc

SEQ ID NO: 25429 - RNA, 18 nt, artificial
  Chemically synthesized
cguugaggcugucccggc

SEQ ID NO: 25430 - RNA, 18 nt, artificial
  Chemically synthesized
gcauccacauuguucacg

SEQ ID NO: 25431 - RNA, 18 nt, artificial
  Chemically synthesized
acacucgugggugacguc

SEQ ID NO: 25432 - RNA, 18 nt, artificial
  Chemically synthesized
cagccauugaugacggac

SEQ ID NO: 25433 - RNA, 18 nt, artificial
  Chemically synthesized
gcugcuggagcccaggac

SEQ ID NO: 25434 - RNA, 18 nt, artificial
  Chemically synthesized
acguggcgcccucgaagc

SEQ ID NO: 25435 - RNA, 18 nt, artificial
  Chemically synthesized
gagggaccaagaacuugu

SEQ ID NO: 25436 - RNA, 18 nt, artificial
  Chemically synthesized
uucugcugcugcaucugu

SEQ ID NO: 25437 - RNA, 18 nt, artificial
  Chemically synthesized
aggucccgccguucuggc

SEQ ID NO: 25438 - RNA, 18 nt, artificial
  Chemically synthesized
aggcauuuggcaucagcu

SEQ ID NO: 25439 - RNA, 18 nt, artificial
  Chemically synthesized
uugacauccugccggcag

SEQ ID NO: 25440 - RNA, 18 nt, artificial
  Chemically synthesized
caugcuugcaagaaacca

SEQ ID NO: 25441 - RNA, 18 nt, artificial
  Chemically synthesized
ggucucacucugcacggc

SEQ ID NO: 25442 - RNA, 18 nt, artificial
  Chemically synthesized
uccacugccgguggucug

SEQ ID NO: 25443 - RNA, 18 nt, artificial
  Chemically synthesized
gcaggugcacguguagcu

SEQ ID NO: 25444 - RNA, 18 nt, artificial
  Chemically synthesized
gacggagacugcuggaac

SEQ ID NO: 25445 - RNA, 18 nt, artificial
  Chemically synthesized
cccguguacccuuccgug

SEQ ID NO: 25446 - RNA, 18 nt, artificial
  Chemically synthesized
acguacaugaagugcagc

SEQ ID NO: 25447 - RNA, 18 nt, artificial
  Chemically synthesized
ucuacaguuccucaugua

SEQ ID NO: 25448 - RNA, 18 nt, artificial
  Chemically synthesized
uccagcaggcgcuuggcg

SEQ ID NO: 25449 - RNA, 18 nt, artificial
  Chemically synthesized
caagugccacaguccaca

SEQ ID NO: 25450 - RNA, 18 nt, artificial
  Chemically synthesized
aggguaggaugccuccgu

SEQ ID NO: 25451 - RNA, 18 nt, artificial
  Chemically synthesized
gaugcccagugaagcccg

SEQ ID NO: 25452 - RNA, 18 nt, artificial
  Chemically synthesized
cucgcagugcacacccuc

SEQ ID NO: 25453 - RNA, 18 nt, artificial
  Chemically synthesized
guccacugccgguggucu

SEQ ID NO: 25454 - RNA, 18 nt, artificial
  Chemically synthesized
gcugcacgucugccuggc

SEQ ID NO: 25455 - RNA, 18 nt, artificial
  Chemically synthesized
uuggccgcuucacacuuc

SEQ ID NO: 25456 - RNA, 18 nt, artificial
  Chemically synthesized
gugacuccagggagucca

SEQ ID NO: 25457 - RNA, 18 nt, artificial
  Chemically synthesized
accguugaagcaggagcu

SEQ ID NO: 25458 - RNA, 18 nt, artificial
  Chemically synthesized
uugacacacacgcaguug

SEQ ID NO: 25459 - RNA, 18 nt, artificial
  Chemically synthesized
cucauaguccucggauug

SEQ ID NO: 25460 - RNA, 18 nt, artificial
  Chemically synthesized
cagccggcugaguugcac

SEQ ID NO: 25461 - RNA, 18 nt, artificial
  Chemically synthesized
cacacucaucgauguuga

SEQ ID NO: 25462 - RNA, 18 nt, artificial
  Chemically synthesized
gcacacucguugaugucc

SEQ ID NO: 25463 - RNA, 18 nt, artificial
  Chemically synthesized
aggauguggcacaagagc

SEQ ID NO: 25464 - RNA, 18 nt, artificial
  Chemically synthesized
cuguggcucgguuccgga

SEQ ID NO: 25465 - RNA, 18 nt, artificial
  Chemically synthesized
auugaucuuguccaggca

SEQ ID NO: 25466 - RNA, 18 nt, artificial
  Chemically synthesized
cuggauguuggcaucugc

SEQ ID NO: 25467 - RNA, 18 nt, artificial
  Chemically synthesized
cacacucguccacaucgu

SEQ ID NO: 25468 - RNA, 18 nt, artificial
  Chemically synthesized
uggagcccaggacggugc

SEQ ID NO: 25469 - RNA, 18 nt, artificial
  Chemically synthesized
ugcaggcuggcgcccugg

SEQ ID NO: 25470 - RNA, 18 nt, artificial
  Chemically synthesized
aggcugcccagcgaggcg

SEQ ID NO: 25471 - RNA, 18 nt, artificial
  Chemically synthesized
uacggcguugacgucggc

SEQ ID NO: 25472 - RNA, 18 nt, artificial
  Chemically synthesized
uucuggcaggaugcgccg

SEQ ID NO: 25473 - RNA, 18 nt, artificial
  Chemically synthesized
cgucaacaccuugucgcu

SEQ ID NO: 25474 - RNA, 18 nt, artificial
  Chemically synthesized
aaggagcuguugcgcagc

SEQ ID NO: 25475 - RNA, 18 nt, artificial
  Chemically synthesized
aggugcagauggccuugc

SEQ ID NO: 25476 - RNA, 18 nt, artificial
  Chemically synthesized
gucauccagguugaucuc

SEQ ID NO: 25477 - RNA, 18 nt, artificial
  Chemically synthesized
auggguuggacgcacacu

SEQ ID NO: 25478 - RNA, 18 nt, artificial
  Chemically synthesized
ugcuggccgggaacuggc

SEQ ID NO: 25479 - RNA, 18 nt, artificial
  Chemically synthesized
cguugucgcgguccuggc

SEQ ID NO: 25480 - RNA, 18 nt, artificial
  Chemically synthesized
gcauuuggcaucagcugg

SEQ ID NO: 25481 - RNA, 18 nt, artificial
  Chemically synthesized
guggaagcaggcggcgcu

SEQ ID NO: 25482 - RNA, 18 nt, artificial
  Chemically synthesized
uuguggcugcaccugcug

SEQ ID NO: 25483 - RNA, 18 nt, artificial
  Chemically synthesized
uuuccuauuucagaugca

SEQ ID NO: 25484 - RNA, 18 nt, artificial
  Chemically synthesized
cacaggcaacgguagaag

SEQ ID NO: 25485 - RNA, 18 nt, artificial
  Chemically synthesized
agacgcagcgguaggagc

SEQ ID NO: 25486 - RNA, 18 nt, artificial
  Chemically synthesized
agcggcacuuguacuccg

SEQ ID NO: 25487 - RNA, 18 nt, artificial
  Chemically synthesized
ccuuccgcacgcuggcag

SEQ ID NO: 25488 - RNA, 18 nt, artificial
  Chemically synthesized
ugcaggcugcagaccuug

SEQ ID NO: 25489 - RNA, 18 nt, artificial
  Chemically synthesized
gcaccuguagcugguggc

SEQ ID NO: 25490 - RNA, 18 nt, artificial
  Chemically synthesized
caggcuguguugcuggag

SEQ ID NO: 25491 - RNA, 18 nt, artificial
  Chemically synthesized
auguaggaggccucgaag

SEQ ID NO: 25492 - RNA, 18 nt, artificial
  Chemically synthesized
uugaugccgucugugcag

SEQ ID NO: 25493 - RNA, 18 nt, artificial
  Chemically synthesized
uucacgccguccacacag

SEQ ID NO: 25494 - RNA, 18 nt, artificial
  Chemically synthesized
gugcggcccauguugucc

SEQ ID NO: 25495 - RNA, 18 nt, artificial
  Chemically synthesized
guggcagcgguagccgcc

SEQ ID NO: 25496 - RNA, 18 nt, artificial
  Chemically synthesized
gaagcaggagcucucugu

SEQ ID NO: 25497 - RNA, 18 nt, artificial
  Chemically synthesized
ugaaccugaaacaaagau

SEQ ID NO: 25498 - RNA, 18 nt, artificial
  Chemically synthesized
uggcgccguggaagcagg

SEQ ID NO: 25499 - RNA, 18 nt, artificial
  Chemically synthesized
cagaagaaucuuuucauc

SEQ ID NO: 25500 - RNA, 18 nt, artificial
  Chemically synthesized
uugacgucggcgugugag

SEQ ID NO: 25501 - RNA, 18 nt, artificial
  Chemically synthesized
gaagggcaggcacuggcc

SEQ ID NO: 25502 - RNA, 18 nt, artificial
  Chemically synthesized
gagcacucguugauguug

SEQ ID NO: 25503 - RNA, 18 nt, artificial
  Chemically synthesized
cgugcaguucuuccaggg

SEQ ID NO: 25504 - RNA, 18 nt, artificial
  Chemically synthesized
uagcgggcggccaggugc

SEQ ID NO: 25505 - RNA, 18 nt, artificial
  Chemically synthesized
guuggauucacacucauu

SEQ ID NO: 25506 - RNA, 18 nt, artificial
  Chemically synthesized
ugcggucugucugguugu

SEQ ID NO: 25507 - RNA, 18 nt, artificial
  Chemically synthesized
acguagccacuggucaug

SEQ ID NO: 25508 - RNA, 18 nt, artificial
  Chemically synthesized
gucaugucuuugcaggug

SEQ ID NO: 25509 - RNA, 18 nt, artificial
  Chemically synthesized
ucauugaaguugagggag

SEQ ID NO: 25510 - RNA, 18 nt, artificial
  Chemically synthesized
acacucgucuguguugac

SEQ ID NO: 25511 - RNA, 18 nt, artificial
  Chemically synthesized
aaagggcgcggccuggac

SEQ ID NO: 25512 - RNA, 18 nt, artificial
  Chemically synthesized
ccaccucacaggacacgc

SEQ ID NO: 25513 - RNA, 18 nt, artificial
  Chemically synthesized
augcagcuucuccuaaca

SEQ ID NO: 25514 - RNA, 18 nt, artificial
  Chemically synthesized
cauaugauccgugauguc

SEQ ID NO: 25515 - RNA, 18 nt, artificial
  Chemically synthesized
guggcgcccucgaagccc

SEQ ID NO: 25516 - RNA, 18 nt, artificial
  Chemically synthesized
ccuuugcagccauugaug

SEQ ID NO: 25517 - RNA, 18 nt, artificial
  Chemically synthesized
gccuugccauugacaggg

SEQ ID NO: 25518 - RNA, 18 nt, artificial
  Chemically synthesized
acccagggucacagucgc

SEQ ID NO: 25519 - RNA, 18 nt, artificial
  Chemically synthesized
agcgagcacucauccacg

SEQ ID NO: 25520 - RNA, 18 nt, artificial
  Chemically synthesized
ucgggucccgcgagcugg

SEQ ID NO: 25521 - RNA, 18 nt, artificial
  Chemically synthesized
agcagcgaggccuucacc

SEQ ID NO: 25522 - RNA, 18 nt, artificial
  Chemically synthesized
cagcgguaggagccgacc

SEQ ID NO: 25523 - RNA, 18 nt, artificial
  Chemically synthesized
aaaacacauggcaacauc

SEQ ID NO: 25524 - RNA, 18 nt, artificial
  Chemically synthesized
cacucguugacgucgauc

SEQ ID NO: 25525 - RNA, 18 nt, artificial
  Chemically synthesized
agcucacgccaaggugcg

SEQ ID NO: 25526 - RNA, 18 nt, artificial
  Chemically synthesized
ucuggagggaccaagaac

SEQ ID NO: 25527 - RNA, 18 nt, artificial
  Chemically synthesized
uugcacugcaggcugcag

SEQ ID NO: 25528 - RNA, 18 nt, artificial
  Chemically synthesized
uuggagcccucguuacag

SEQ ID NO: 25529 - RNA, 18 nt, artificial
  Chemically synthesized
cuggugggagggcuggag

SEQ ID NO: 25530 - RNA, 18 nt, artificial
  Chemically synthesized
ggaacucauugaucuugu

SEQ ID NO: 25531 - RNA, 18 nt, artificial
  Chemically synthesized
agcauuugccgccguucu

SEQ ID NO: 25532 - RNA, 18 nt, artificial
  Chemically synthesized
caccguggguguuguggc

SEQ ID NO: 25533 - RNA, 18 nt, artificial
  Chemically synthesized
acugccgguugucaaucu

SEQ ID NO: 25534 - RNA, 18 nt, artificial
  Chemically synthesized
ggcucagaacgcacucgu

SEQ ID NO: 25535 - RNA, 18 nt, artificial
  Chemically synthesized
aggugccgccguugacac

SEQ ID NO: 25536 - RNA, 18 nt, artificial
  Chemically synthesized
uagguguucacgccgucc

SEQ ID NO: 25537 - RNA, 18 nt, artificial
  Chemically synthesized
ugcgggcugcgcaccagg

SEQ ID NO: 25538 - RNA, 18 nt, artificial
  Chemically synthesized
gggccugugugcucaggg

SEQ ID NO: 25539 - RNA, 18 nt, artificial
  Chemically synthesized
acuucuuccuccgugccu

SEQ ID NO: 25540 - RNA, 18 nt, artificial
  Chemically synthesized
auccacauuguucacggc

SEQ ID NO: 25541 - RNA, 18 nt, artificial
  Chemically synthesized
cuucuccuaacaggcagg

SEQ ID NO: 25542 - RNA, 18 nt, artificial
  Chemically synthesized
ucuuggucuccagguccu

SEQ ID NO: 25543 - RNA, 18 nt, artificial
  Chemically synthesized
gcucgguuccggaucagg

SEQ ID NO: 25544 - RNA, 18 nt, artificial
  Chemically synthesized
auucugguugucguccau

SEQ ID NO: 25545 - RNA, 18 nt, artificial
  Chemically synthesized
uugaugcacuugcccgca

SEQ ID NO: 25546 - RNA, 18 nt, artificial
  Chemically synthesized
cuccggcggcaucagcac

SEQ ID NO: 25547 - RNA, 18 nt, artificial
  Chemically synthesized
ucgaaggagcccagcgug

SEQ ID NO: 25548 - RNA, 18 nt, artificial
  Chemically synthesized
agguccucacaguagcug

SEQ ID NO: 25549 - RNA, 18 nt, artificial
  Chemically synthesized
cgcaggucagcggcaucc

SEQ ID NO: 25550 - RNA, 18 nt, artificial
  Chemically synthesized
cgccguggaagcaggcgg

SEQ ID NO: 25551 - RNA, 18 nt, artificial
  Chemically synthesized
cacucauccacguccugg

SEQ ID NO: 25552 - RNA, 18 nt, artificial
  Chemically synthesized
ugcagggcuugccuuugc

SEQ ID NO: 25553 - RNA, 18 nt, artificial
  Chemically synthesized
ugucgcaguuggagcccu

SEQ ID NO: 25554 - RNA, 18 nt, artificial
  Chemically synthesized
cacucgucgaucuccuca

SEQ ID NO: 25555 - RNA, 18 nt, artificial
  Chemically synthesized
cccaggucaucuacggcg

SEQ ID NO: 25556 - RNA, 18 nt, artificial
  Chemically synthesized
gauguugauguuacacau

SEQ ID NO: 25557 - RNA, 18 nt, artificial
  Chemically synthesized
uacuggcacagaugccca

SEQ ID NO: 25558 - RNA, 18 nt, artificial
  Chemically synthesized
aucaggaucuggaagaca

SEQ ID NO: 25559 - RNA, 18 nt, artificial
  Chemically synthesized
ggugagcacucguccacc

SEQ ID NO: 25560 - RNA, 18 nt, artificial
  Chemically synthesized
aggcuggcgcccugguag

SEQ ID NO: 25561 - RNA, 18 nt, artificial
  Chemically synthesized
augccgcucugcagccgg

SEQ ID NO: 25562 - RNA, 18 nt, artificial
  Chemically synthesized
agcgugagcaggucgcag

SEQ ID NO: 25563 - RNA, 18 nt, artificial
  Chemically synthesized
cuccugugcgaugucgcg

SEQ ID NO: 25564 - RNA, 18 nt, artificial
  Chemically synthesized
acugaccuguccacucug

SEQ ID NO: 25565 - RNA, 18 nt, artificial
  Chemically synthesized
acaggaccaaaggacgca

SEQ ID NO: 25566 - RNA, 18 nt, artificial
  Chemically synthesized
cacguggcaugucccggc

SEQ ID NO: 25567 - RNA, 18 nt, artificial
  Chemically synthesized
uguugcgcagcugcuccg

SEQ ID NO: 25568 - RNA, 18 nt, artificial
  Chemically synthesized
uaccaugggugcacucuu

SEQ ID NO: 25569 - RNA, 18 nt, artificial
  Chemically synthesized
uaaaaaggcaguguuucu

SEQ ID NO: 25570 - RNA, 18 nt, artificial
  Chemically synthesized
guuugccucuggaugcag

SEQ ID NO: 25571 - RNA, 18 nt, artificial
  Chemically synthesized
cacgcaguucugggugcc

SEQ ID NO: 25572 - RNA, 18 nt, artificial
  Chemically synthesized
caggagcacaacugcggc

SEQ ID NO: 25573 - RNA, 18 nt, artificial
  Chemically synthesized
gcucguucaacuucccuu

SEQ ID NO: 25574 - RNA, 18 nt, artificial
  Chemically synthesized
cucggaccagucggagac

SEQ ID NO: 25575 - RNA, 18 nt, artificial
  Chemically synthesized
cacagagcgcacacagac

SEQ ID NO: 25576 - RNA, 18 nt, artificial
  Chemically synthesized
cgggcugggagcaucgcg

SEQ ID NO: 25577 - RNA, 18 nt, artificial
  Chemically synthesized
agcccguugaauuuggcg

SEQ ID NO: 25578 - RNA, 18 nt, artificial
  Chemically synthesized
uugaagcaggagcucucu

SEQ ID NO: 25579 - RNA, 18 nt, artificial
  Chemically synthesized
gguacugggugugggucu

SEQ ID NO: 25580 - RNA, 18 nt, artificial
  Chemically synthesized
acagccacucgcauugac

SEQ ID NO: 25581 - RNA, 18 nt, artificial
  Chemically synthesized
caggaucuggaagacacc

SEQ ID NO: 25582 - RNA, 18 nt, artificial
  Chemically synthesized
gaugugggcucacagguc

SEQ ID NO: 25583 - RNA, 18 nt, artificial
  Chemically synthesized
uguguagggcagcaggca

SEQ ID NO: 25584 - RNA, 18 nt, artificial
  Chemically synthesized
ugccgguggucugucugg

SEQ ID NO: 25585 - RNA, 18 nt, artificial
  Chemically synthesized
agcucaaugugcccggcu

SEQ ID NO: 25586 - RNA, 18 nt, artificial
  Chemically synthesized
uccguuugccucuggaug

SEQ ID NO: 25587 - RNA, 18 nt, artificial
  Chemically synthesized
agcucgcacgccuccucg

SEQ ID NO: 25588 - RNA, 18 nt, artificial
  Chemically synthesized
auugguaccaugggugca

SEQ ID NO: 25589 - RNA, 18 nt, artificial
  Chemically synthesized
gagucacaccagugcaca

SEQ ID NO: 25590 - RNA, 18 nt, artificial
  Chemically synthesized
ugaucuuguccaggcagc

SEQ ID NO: 25591 - RNA, 18 nt, artificial
  Chemically synthesized
accucacaggacacgcug

SEQ ID NO: 25592 - RNA, 18 nt, artificial
  Chemically synthesized
cuggauguuggcaucugc

SEQ ID NO: 25593 - RNA, 18 nt, artificial
  Chemically synthesized
ugggagggcuggagacgc

SEQ ID NO: 25594 - RNA, 18 nt, artificial
  Chemically synthesized
gccugcacacacugccgg

SEQ ID NO: 25595 - RNA, 18 nt, artificial
  Chemically synthesized
gcaugcuugcaagaaacc

SEQ ID NO: 25596 - RNA, 18 nt, artificial
  Chemically synthesized
gcacuggaacucauugau

SEQ ID NO: 25597 - RNA, 18 nt, artificial
  Chemically synthesized
cugacagguagccauggg

SEQ ID NO: 25598 - RNA, 18 nt, artificial
  Chemically synthesized
uuggcacccagcgagcac

SEQ ID NO: 25599 - RNA, 18 nt, artificial
  Chemically synthesized
gguacaugcuccgcacag

SEQ ID NO: 25600 - RNA, 18 nt, artificial
  Chemically synthesized
acccagcgccgccaucuc

SEQ ID NO: 25601 - RNA, 18 nt, artificial
  Chemically synthesized
gaggagucacaccagugc

SEQ ID NO: 25602 - RNA, 18 nt, artificial
  Chemically synthesized
ugcuugcgcagcuccucc

SEQ ID NO: 25603 - RNA, 18 nt, artificial
  Chemically synthesized
cgucgaucuccucagagc

SEQ ID NO: 25604 - RNA, 18 nt, artificial
  Chemically synthesized
gggcugggugagcacucg

SEQ ID NO: 25605 - RNA, 18 nt, artificial
  Chemically synthesized
caggcuuugcugcugcug

SEQ ID NO: 25606 - RNA, 18 nt, artificial
  Chemically synthesized
agaagcucucauaguccu

SEQ ID NO: 25607 - RNA, 18 nt, artificial
  Chemically synthesized
gugacccaggcaagugcc

SEQ ID NO: 25608 - RNA, 18 nt, artificial
  Chemically synthesized
cggcaacgucgucaauac

SEQ ID NO: 25609 - RNA, 18 nt, artificial
  Chemically synthesized
agucauugacgcgcugca

SEQ ID NO: 25610 - RNA, 18 nt, artificial
  Chemically synthesized
ggaugugggcucacaggu

SEQ ID NO: 25611 - RNA, 18 nt, artificial
  Chemically synthesized
cccacucgcacuccgcgc

SEQ ID NO: 25612 - RNA, 18 nt, artificial
  Chemically synthesized
uggugguggugguggcgg

SEQ ID NO: 25613 - RNA, 18 nt, artificial
  Chemically synthesized
cugcaguccucaccaguc

SEQ ID NO: 25614 - RNA, 18 nt, artificial
  Chemically synthesized
agcuggccaugcugccgc

SEQ ID NO: 25615 - RNA, 18 nt, artificial
  Chemically synthesized
cgccauucaggcaggucu

SEQ ID NO: 25616 - RNA, 18 nt, artificial
  Chemically synthesized
cauugaaguugagggagc

SEQ ID NO: 25617 - RNA, 18 nt, artificial
  Chemically synthesized
cccagcgagcacucaucc

SEQ ID NO: 25618 - RNA, 18 nt, artificial
  Chemically synthesized
aggugcaccuguaggagc

SEQ ID NO: 25619 - RNA, 18 nt, artificial
  Chemically synthesized
ugcugcugcaucuguaag

SEQ ID NO: 25620 - RNA, 18 nt, artificial
  Chemically synthesized
cugaguugcacuggcugu

SEQ ID NO: 25621 - RNA, 18 nt, artificial
  Chemically synthesized
agcaugcccuccacggcc

SEQ ID NO: 25622 - RNA, 18 nt, artificial
  Chemically synthesized
cucgaagggcaggcacug

SEQ ID NO: 25623 - RNA, 18 nt, artificial
  Chemically synthesized
aaccaacgaacaacuaca

SEQ ID NO: 25624 - RNA, 18 nt, artificial
  Chemically synthesized
uggccgccacguucaggu

SEQ ID NO: 25625 - RNA, 18 nt, artificial
  Chemically synthesized
ugcaugcgggcauccagg

SEQ ID NO: 25626 - RNA, 18 nt, artificial
  Chemically synthesized
caagaaaccaucuaaaac

SEQ ID NO: 25627 - RNA, 18 nt, artificial
  Chemically synthesized
cacacagagcccuccaug

SEQ ID NO: 25628 - RNA, 18 nt, artificial
  Chemically synthesized
gucugcccuugccagccc

SEQ ID NO: 25629 - RNA, 18 nt, artificial
  Chemically synthesized
cagagcccuccaugcugg

SEQ ID NO: 25630 - RNA, 18 nt, artificial
  Chemically synthesized
cccugaggagugcaggcg

SEQ ID NO: 25631 - RNA, 18 nt, artificial
  Chemically synthesized
ugauccgugaugucccgg

SEQ ID NO: 25632 - RNA, 18 nt, artificial
  Chemically synthesized
gguugcacuggccuuccg

SEQ ID NO: 25633 - RNA, 18 nt, artificial
  Chemically synthesized
uguacccuuccgugcaca

SEQ ID NO: 25634 - RNA, 18 nt, artificial
  Chemically synthesized
ggcucucggaugugggcu

SEQ ID NO: 25635 - RNA, 18 nt, artificial
  Chemically synthesized
ucagacacuuugaagccc

SEQ ID NO: 25636 - RNA, 18 nt, artificial
  Chemically synthesized
cagcaugcccuccacggc

SEQ ID NO: 25637 - RNA, 18 nt, artificial
  Chemically synthesized
ucgucgaucuccucagag

SEQ ID NO: 25638 - RNA, 18 nt, artificial
  Chemically synthesized
ggcugaguugcacuggcu

SEQ ID NO: 25639 - RNA, 18 nt, artificial
  Chemically synthesized
ugcuuucacuuguuuccu

SEQ ID NO: 25640 - RNA, 18 nt, artificial
  Chemically synthesized
agcacucauccacguccu

SEQ ID NO: 25641 - RNA, 18 nt, artificial
  Chemically synthesized
aggaacugggcugcgguc

SEQ ID NO: 25642 - RNA, 18 nt, artificial
  Chemically synthesized
gugcacacguagccacug

SEQ ID NO: 25643 - RNA, 18 nt, artificial
  Chemically synthesized
ccaccugguccacgcagg

SEQ ID NO: 25644 - RNA, 18 nt, artificial
  Chemically synthesized
caccucacacguggcacc

SEQ ID NO: 25645 - RNA, 18 nt, artificial
  Chemically synthesized
uguccagcaggcagcccu

SEQ ID NO: 25646 - RNA, 18 nt, artificial
  Chemically synthesized
cgcgugguuguugcacug

SEQ ID NO: 25647 - RNA, 18 nt, artificial
  Chemically synthesized
uccagacaggugcccgag

SEQ ID NO: 25648 - RNA, 18 nt, artificial
  Chemically synthesized
cucgguuccggaucagga

SEQ ID NO: 25649 - RNA, 18 nt, artificial
  Chemically synthesized
aaguggaaggagcuguug

SEQ ID NO: 25650 - RNA, 18 nt, artificial
  Chemically synthesized
guugcccgcacacucauc

SEQ ID NO: 25651 - RNA, 18 nt, artificial
  Chemically synthesized
caggcagggcugugaguc

SEQ ID NO: 25652 - RNA, 18 nt, artificial
  Chemically synthesized
uguuugcuggcugcaggu

SEQ ID NO: 25653 - RNA, 18 nt, artificial
  Chemically synthesized
ucacagcgcucacccacg

SEQ ID NO: 25654 - RNA, 18 nt, artificial
  Chemically synthesized
caucuugggacgcaucug

SEQ ID NO: 25655 - RNA, 18 nt, artificial
  Chemically synthesized
guucuggagggaccaaga

SEQ ID NO: 25656 - RNA, 18 nt, artificial
  Chemically synthesized
auguuugacaugcaugau

SEQ ID NO: 25657 - RNA, 18 nt, artificial
  Chemically synthesized
gcacucgcaguggaaguc

SEQ ID NO: 25658 - RNA, 18 nt, artificial
  Chemically synthesized
aggcaggcauuguccagg

SEQ ID NO: 25659 - RNA, 18 nt, artificial
  Chemically synthesized
cuugcccaggucaucuac

SEQ ID NO: 25660 - RNA, 18 nt, artificial
  Chemically synthesized
gcucggcucuccacucag

SEQ ID NO: 25661 - RNA, 18 nt, artificial
  Chemically synthesized
uccgcugcuggagcccag

SEQ ID NO: 25662 - RNA, 18 nt, artificial
  Chemically synthesized
gucugccuggcucggcuc

SEQ ID NO: 25663 - RNA, 18 nt, artificial
  Chemically synthesized
agcacugcgaggaggccu

SEQ ID NO: 25664 - RNA, 18 nt, artificial
  Chemically synthesized
cgguccauaugauccgug

SEQ ID NO: 25665 - RNA, 18 nt, artificial
  Chemically synthesized
gugagccagcuuugccuc

SEQ ID NO: 25666 - RNA, 18 nt, artificial
  Chemically synthesized
aguaaaggccgguccagc

SEQ ID NO: 25667 - RNA, 18 nt, artificial
  Chemically synthesized
accuguaggagccgcagc

SEQ ID NO: 25668 - RNA, 18 nt, artificial
  Chemically synthesized
aggccacggcgcaggugc

SEQ ID NO: 25669 - RNA, 18 nt, artificial
  Chemically synthesized
ggcggucucguagcugcc

SEQ ID NO: 25670 - RNA, 18 nt, artificial
  Chemically synthesized
ugaagcaggagcucucug

SEQ ID NO: 25671 - RNA, 18 nt, artificial
  Chemically synthesized
ugaaguacuuccagcacu

SEQ ID NO: 25672 - RNA, 18 nt, artificial
  Chemically synthesized
gcgucggcagacacagcc

SEQ ID NO: 25673 - RNA, 18 nt, artificial
  Chemically synthesized
caugacacacaacagacu

SEQ ID NO: 25674 - RNA, 18 nt, artificial
  Chemically synthesized
ggucgugguagcccucgg

SEQ ID NO: 25675 - RNA, 18 nt, artificial
  Chemically synthesized
guaccaugggugcacucu

SEQ ID NO: 25676 - RNA, 18 nt, artificial
  Chemically synthesized
gguuggugucgcaguugg

SEQ ID NO: 25677 - RNA, 18 nt, artificial
  Chemically synthesized
acgcugggcacgucgcag

SEQ ID NO: 25678 - RNA, 18 nt, artificial
  Chemically synthesized
cgccaucucgggcuuggc

SEQ ID NO: 25679 - RNA, 18 nt, artificial
  Chemically synthesized
cuggcgcccugguagaug

SEQ ID NO: 25680 - RNA, 18 nt, artificial
  Chemically synthesized
auuuuccucacaguucug

SEQ ID NO: 25681 - RNA, 18 nt, artificial
  Chemically synthesized
cucccuguuguucugcau

SEQ ID NO: 25682 - RNA, 18 nt, artificial
  Chemically synthesized
ugacaggguuggugucgc

SEQ ID NO: 25683 - RNA, 18 nt, artificial
  Chemically synthesized
gggugagcacucguccac

SEQ ID NO: 25684 - RNA, 18 nt, artificial
  Chemically synthesized
cagguguaaguguugggu

SEQ ID NO: 25685 - RNA, 18 nt, artificial
  Chemically synthesized
cuggagcacucguugaug

SEQ ID NO: 25686 - RNA, 18 nt, artificial
  Chemically synthesized
cccucacagcgcucaccc

SEQ ID NO: 25687 - RNA, 18 nt, artificial
  Chemically synthesized
agggcugugagucgcacu

SEQ ID NO: 25688 - RNA, 18 nt, artificial
  Chemically synthesized
ucauccagguugaucucg

SEQ ID NO: 25689 - RNA, 18 nt, artificial
  Chemically synthesized
uuugaagcccucagggaa

SEQ ID NO: 25690 - RNA, 18 nt, artificial
  Chemically synthesized
guggcucgguuccggauc

SEQ ID NO: 25691 - RNA, 18 nt, artificial
  Chemically synthesized
cacaggagaagcucucau

SEQ ID NO: 25692 - RNA, 18 nt, artificial
  Chemically synthesized
gauauuuuccucacaguu

SEQ ID NO: 25693 - RNA, 18 nt, artificial
  Chemically synthesized
gagcuguugcgcagcugc

SEQ ID NO: 25694 - RNA, 18 nt, artificial
  Chemically synthesized
gguagacgauggagccgc

SEQ ID NO: 25695 - RNA, 18 nt, artificial
  Chemically synthesized
ugcagccauugaugacgg

SEQ ID NO: 25696 - RNA, 18 nt, artificial
  Chemically synthesized
agccacucgcauugacca

SEQ ID NO: 25697 - RNA, 18 nt, artificial
  Chemically synthesized
uguugcccgcguccacac

SEQ ID NO: 25698 - RNA, 18 nt, artificial
  Chemically synthesized
gcaacgucgucaauacac

SEQ ID NO: 25699 - RNA, 18 nt, artificial
  Chemically synthesized
caggcaagugccacaguc

SEQ ID NO: 25700 - RNA, 18 nt, artificial
  Chemically synthesized
agguugaucucgcaguug

SEQ ID NO: 25701 - RNA, 18 nt, artificial
  Chemically synthesized
cagacacaggagaagcuc

SEQ ID NO: 25702 - RNA, 18 nt, artificial
  Chemically synthesized
aucgauguccaccucgca

SEQ ID NO: 25703 - RNA, 18 nt, artificial
  Chemically synthesized
acgccgggcuugaggcug

SEQ ID NO: 25704 - RNA, 18 nt, artificial
  Chemically synthesized
uggcgcccucgaagcccg

SEQ ID NO: 25705 - RNA, 18 nt, artificial
  Chemically synthesized
cuccgugugugacccagg

SEQ ID NO: 25706 - RNA, 18 nt, artificial
  Chemically synthesized
caggaccaaaggacgcag

SEQ ID NO: 25707 - RNA, 18 nt, artificial
  Chemically synthesized
uaggagccgaccucguug

SEQ ID NO: 25708 - RNA, 18 nt, artificial
  Chemically synthesized
acaggagaagcucucaua

SEQ ID NO: 25709 - RNA, 18 nt, artificial
  Chemically synthesized
ggguugcacuggccuucc

SEQ ID NO: 25710 - RNA, 18 nt, artificial
  Chemically synthesized
cccaguggcugcacgucu

SEQ ID NO: 25711 - RNA, 18 nt, artificial
  Chemically synthesized
aacacauuuucacaagca

SEQ ID NO: 25712 - RNA, 18 nt, artificial
  Chemically synthesized
ucuaacccauaugcuuuc

SEQ ID NO: 25713 - RNA, 18 nt, artificial
  Chemically synthesized
acagagcgcacacagacg

SEQ ID NO: 25714 - RNA, 18 nt, artificial
  Chemically synthesized
ccgccgcuucuucuugcu

SEQ ID NO: 25715 - RNA, 18 nt, artificial
  Chemically synthesized
auccugccggcagguggg

SEQ ID NO: 25716 - RNA, 18 nt, artificial
  Chemically synthesized
ggugaagguggcgacgcc

SEQ ID NO: 25717 - RNA, 18 nt, artificial
  Chemically synthesized
cuccgucagcgugagcag

SEQ ID NO: 25718 - RNA, 18 nt, artificial
  Chemically synthesized
ggcaguggcagauguagg

SEQ ID NO: 25719 - RNA, 18 nt, artificial
  Chemically synthesized
ggaggucgaggcaggugc

SEQ ID NO: 25720 - RNA, 18 nt, artificial
  Chemically synthesized
guagcugugcugcgaggg

SEQ ID NO: 25721 - RNA, 18 nt, artificial
  Chemically synthesized
ucugccacgccucugcgg

SEQ ID NO: 25722 - RNA, 18 nt, artificial
  Chemically synthesized
ugcccgaugcccaggugg

SEQ ID NO: 25723 - RNA, 18 nt, artificial
  Chemically synthesized
cacguguagcuguccacg

SEQ ID NO: 25724 - RNA, 18 nt, artificial
  Chemically synthesized
accaaaggacgcagccca

SEQ ID NO: 25725 - RNA, 18 nt, artificial
  Chemically synthesized
guccacgcaggugccacc

SEQ ID NO: 25726 - RNA, 18 nt, artificial
  Chemically synthesized
uugggcgagcagagcggg

SEQ ID NO: 25727 - RNA, 18 nt, artificial
  Chemically synthesized
ugucaaucuccagguaga

SEQ ID NO: 25728 - RNA, 18 nt, artificial
  Chemically synthesized
ugaguccacugccggugg

SEQ ID NO: 25729 - RNA, 18 nt, artificial
  Chemically synthesized
cucggcucuccacucagg

SEQ ID NO: 25730 - RNA, 18 nt, artificial
  Chemically synthesized
gccaucucgggcuuggcc

SEQ ID NO: 25731 - RNA, 18 nt, artificial
  Chemically synthesized
auucaugauugguaccau

SEQ ID NO: 25732 - RNA, 18 nt, artificial
  Chemically synthesized
cacucguccacauccucg

SEQ ID NO: 25733 - RNA, 18 nt, artificial
  Chemically synthesized
ugucguccaugagggcac

SEQ ID NO: 25734 - RNA, 18 nt, artificial
  Chemically synthesized
uccgucagcgugagcagg

SEQ ID NO: 25735 - RNA, 18 nt, artificial
  Chemically synthesized
acugugcaggcugaggug

SEQ ID NO: 25736 - RNA, 18 nt, artificial
  Chemically synthesized
accauucaaacuggugga

SEQ ID NO: 25737 - RNA, 18 nt, artificial
  Chemically synthesized
uugcagaugaacccgcgg

SEQ ID NO: 25738 - RNA, 18 nt, artificial
  Chemically synthesized
uccucuuccucgcuguug

SEQ ID NO: 25739 - RNA, 18 nt, artificial
  Chemically synthesized
aauacacgugcccugguu

SEQ ID NO: 25740 - RNA, 18 nt, artificial
  Chemically synthesized
agcaccuuggcggucucg

SEQ ID NO: 25741 - RNA, 18 nt, artificial
  Chemically synthesized
ccaggacggugcuggugc

SEQ ID NO: 25742 - RNA, 18 nt, artificial
  Chemically synthesized
ggauguugaggcugccca

SEQ ID NO: 25743 - RNA, 18 nt, artificial
  Chemically synthesized
agacgcaggccuccgugc

SEQ ID NO: 25744 - RNA, 18 nt, artificial
  Chemically synthesized
auggaagcugggugggca

SEQ ID NO: 25745 - RNA, 18 nt, artificial
  Chemically synthesized
aucgauguugauguuaca

SEQ ID NO: 25746 - RNA, 18 nt, artificial
  Chemically synthesized
caggaacugggcugcggu

SEQ ID NO: 25747 - RNA, 18 nt, artificial
  Chemically synthesized
gugucgcaguuggagccc

SEQ ID NO: 25748 - RNA, 18 nt, artificial
  Chemically synthesized
ccauuggccgcuucacac

SEQ ID NO: 25749 - RNA, 18 nt, artificial
  Chemically synthesized
auuuucacaagcaugcuu

SEQ ID NO: 25750 - RNA, 18 nt, artificial
  Chemically synthesized
agcuuugccuccguuugc

SEQ ID NO: 25751 - RNA, 18 nt, artificial
  Chemically synthesized
cgcagaggguuguauugg

SEQ ID NO: 25752 - RNA, 18 nt, artificial
  Chemically synthesized
caggugaagccauugaug

SEQ ID NO: 25753 - RNA, 18 nt, artificial
  Chemically synthesized
gugugaccagcacggcac

SEQ ID NO: 25754 - RNA, 18 nt, artificial
  Chemically synthesized
aagcacugcgaggaggcc

SEQ ID NO: 25755 - RNA, 18 nt, artificial
  Chemically synthesized
caccagguuguacucguc

SEQ ID NO: 25756 - RNA, 18 nt, artificial
  Chemically synthesized
ggcucacaggcacacucg

SEQ ID NO: 25757 - RNA, 18 nt, artificial
  Chemically synthesized
cacucgcauugaccauuc

SEQ ID NO: 25758 - RNA, 18 nt, artificial
  Chemically synthesized
augccggagcuguccagc

SEQ ID NO: 25759 - RNA, 18 nt, artificial
  Chemically synthesized
gcaccaccucacacgugg

SEQ ID NO: 25760 - RNA, 18 nt, artificial
  Chemically synthesized
aagagcccguugaauuug

SEQ ID NO: 25761 - RNA, 18 nt, artificial
  Chemically synthesized
uugccgccguucuugcag

SEQ ID NO: 25762 - RNA, 18 nt, artificial
  Chemically synthesized
gaugaagucggagaugac

SEQ ID NO: 25763 - RNA, 18 nt, artificial
  Chemically synthesized
aacaccuugucgcugcgc

SEQ ID NO: 25764 - RNA, 18 nt, artificial
  Chemically synthesized
aggucucaccgggcuggg

SEQ ID NO: 25765 - RNA, 18 nt, artificial
  Chemically synthesized
cuccucccaaacuaggag

SEQ ID NO: 25766 - RNA, 18 nt, artificial
  Chemically synthesized
caggcaggcacacucgug

SEQ ID NO: 25767 - RNA, 18 nt, artificial
  Chemically synthesized
cugggucugcaccaggug

SEQ ID NO: 25768 - RNA, 18 nt, artificial
  Chemically synthesized
cucacaggacacgcuggg

SEQ ID NO: 25769 - RNA, 18 nt, artificial
  Chemically synthesized
gucccucacuggcaugac

SEQ ID NO: 25770 - RNA, 18 nt, artificial
  Chemically synthesized
gcagcaggcaguugcacu

SEQ ID NO: 25771 - RNA, 18 nt, artificial
  Chemically synthesized
ggucucguagcugcccuc

SEQ ID NO: 25772 - RNA, 18 nt, artificial
  Chemically synthesized
cugcaguccucaccaguc

SEQ ID NO: 25773 - RNA, 18 nt, artificial
  Chemically synthesized
cugcacgcaguucugggu

SEQ ID NO: 25774 - RNA, 18 nt, artificial
  Chemically synthesized
aggauggcagcgacgugg

SEQ ID NO: 25775 - RNA, 18 nt, artificial
  Chemically synthesized
ucgcauugaccauucaaa

SEQ ID NO: 25776 - RNA, 18 nt, artificial
  Chemically synthesized
guccacacagagcccucc

SEQ ID NO: 25777 - RNA, 18 nt, artificial
  Chemically synthesized
uuugcugcugcuggaugu

SEQ ID NO: 25778 - RNA, 18 nt, artificial
  Chemically synthesized
uugccauugacaggguug

SEQ ID NO: 25779 - RNA, 18 nt, artificial
  Chemically synthesized
ggacuucuuccuccgugc

SEQ ID NO: 25780 - RNA, 18 nt, artificial
  Chemically synthesized
ucucggaugugggcucac

SEQ ID NO: 25781 - RNA, 18 nt, artificial
  Chemically synthesized
ugcaggcagggcugugag

SEQ ID NO: 25782 - RNA, 18 nt, artificial
  Chemically synthesized
gcccugguagaugaaguc

SEQ ID NO: 25783 - RNA, 18 nt, artificial
  Chemically synthesized
cacugcaggcugcagacc

SEQ ID NO: 25784 - RNA, 18 nt, artificial
  Chemically synthesized
ggcuugcggaccuucuug

SEQ ID NO: 25785 - RNA, 18 nt, artificial
  Chemically synthesized
ggaagaucaucugcuggc

SEQ ID NO: 25786 - RNA, 18 nt, artificial
  Chemically synthesized
gacgcaucuggucaugcc

SEQ ID NO: 25787 - RNA, 18 nt, artificial
  Chemically synthesized
cagagguaggcguugucg

SEQ ID NO: 25788 - RNA, 18 nt, artificial
  Chemically synthesized
gcacucguccacauccuc

SEQ ID NO: 25789 - RNA, 18 nt, artificial
  Chemically synthesized
caagucugacgucccuca

SEQ ID NO: 25790 - RNA, 18 nt, artificial
  Chemically synthesized
agaacacauuuucacaag

SEQ ID NO: 25791 - RNA, 18 nt, artificial
  Chemically synthesized
cugaugcaugcgucguug

SEQ ID NO: 25792 - RNA, 18 nt, artificial
  Chemically synthesized
gguugucguccaugaggg

SEQ ID NO: 25793 - RNA, 18 nt, artificial
  Chemically synthesized
gcacacucguugauguug

SEQ ID NO: 25794 - RNA, 18 nt, artificial
  Chemically synthesized
cugggugugggucugcca

SEQ ID NO: 25795 - RNA, 18 nt, artificial
  Chemically synthesized
agacacagccgcaugcag

SEQ ID NO: 25796 - RNA, 18 nt, artificial
  Chemically synthesized
gggcugcgcaccagguug

SEQ ID NO: 25797 - RNA, 18 nt, artificial
  Chemically synthesized
ugcacgcaguucugggug

SEQ ID NO: 25798 - RNA, 18 nt, artificial
  Chemically synthesized
gccucucggguacaugcu

SEQ ID NO: 25799 - RNA, 18 nt, artificial
  Chemically synthesized
uugcgcagcuccuccucg

SEQ ID NO: 25800 - RNA, 18 nt, artificial
  Chemically synthesized
caucucauguuugacaug

SEQ ID NO: 25801 - RNA, 18 nt, artificial
  Chemically synthesized
uuggguccguccaggcac

SEQ ID NO: 25802 - RNA, 18 nt, artificial
  Chemically synthesized
uuguacccguugaggcug

SEQ ID NO: 25803 - RNA, 18 nt, artificial
  Chemically synthesized
ucugcgguccaccacgug

SEQ ID NO: 25804 - RNA, 18 nt, artificial
  Chemically synthesized
ggagaugcaugugccgcc

SEQ ID NO: 25805 - RNA, 18 nt, artificial
  Chemically synthesized
ucguucaacuucccuucu

SEQ ID NO: 25806 - RNA, 18 nt, artificial
  Chemically synthesized
uggcgacgccguccuugc

SEQ ID NO: 25807 - RNA, 18 nt, artificial
  Chemically synthesized
ugagcacucguccaccag

SEQ ID NO: 25808 - RNA, 18 nt, artificial
  Chemically synthesized
gccauggaagcugggugg

SEQ ID NO: 25809 - RNA, 18 nt, artificial
  Chemically synthesized
caucguacuggcacagau

SEQ ID NO: 25810 - RNA, 18 nt, artificial
  Chemically synthesized
uuccuccgugccuugagg

SEQ ID NO: 25811 - RNA, 18 nt, artificial
  Chemically synthesized
ggaacugggcugcgguca

SEQ ID NO: 25812 - RNA, 18 nt, artificial
  Chemically synthesized
agugcaugggcggcuaag

SEQ ID NO: 25813 - RNA, 18 nt, artificial
  Chemically synthesized
guccagcucccuccgccg

SEQ ID NO: 25814 - RNA, 18 nt, artificial
  Chemically synthesized
gucgcagggauuggacag

SEQ ID NO: 25815 - RNA, 18 nt, artificial
  Chemically synthesized
ugguggacccgcccacag

SEQ ID NO: 25816 - RNA, 18 nt, artificial
  Chemically synthesized
cguacuggcacagaugcc

SEQ ID NO: 25817 - RNA, 18 nt, artificial
  Chemically synthesized
acaagguucuggcaguug

SEQ ID NO: 25818 - RNA, 18 nt, artificial
  Chemically synthesized
gagguggcacagcagacc

SEQ ID NO: 25819 - RNA, 18 nt, artificial
  Chemically synthesized
agccgggcaggcagucgc

SEQ ID NO: 25820 - RNA, 18 nt, artificial
  Chemically synthesized
cacagguguaaguguugg

SEQ ID NO: 25821 - RNA, 18 nt, artificial
  Chemically synthesized
auguggcacaagagcccg

SEQ ID NO: 25822 - RNA, 18 nt, artificial
  Chemically synthesized
cuggcgcccugguagaug

SEQ ID NO: 25823 - RNA, 18 nt, artificial
  Chemically synthesized
aucuggaagacaccuugu

SEQ ID NO: 25824 - RNA, 18 nt, artificial
  Chemically synthesized
aaccggaacuucuugguc

SEQ ID NO: 25825 - RNA, 18 nt, artificial
  Chemically synthesized
cucagggaaccagagcug

SEQ ID NO: 25826 - RNA, 18 nt, artificial
  Chemically synthesized
augcaugcgggcauccag

SEQ ID NO: 25827 - RNA, 18 nt, artificial
  Chemically synthesized
guguagcuguccacgcag

SEQ ID NO: 25828 - RNA, 18 nt, artificial
  Chemically synthesized
cuggagcacucguugaug

SEQ ID NO: 25829 - RNA, 18 nt, artificial
  Chemically synthesized
ggugguucuggagggacc

SEQ ID NO: 25830 - RNA, 18 nt, artificial
  Chemically synthesized
cgucuguguugaccucgc

SEQ ID NO: 25831 - RNA, 18 nt, artificial
  Chemically synthesized
augccaugcugcagggag

SEQ ID NO: 25832 - RNA, 18 nt, artificial
  Chemically synthesized
cagcuuugccuccguuug

SEQ ID NO: 25833 - RNA, 18 nt, artificial
  Chemically synthesized
gugcggcugugguggugg

SEQ ID NO: 25834 - RNA, 18 nt, artificial
  Chemically synthesized
gaaccugaaacaaagauu

SEQ ID NO: 25835 - RNA, 18 nt, artificial
  Chemically synthesized
aaguguuggguccgucca

SEQ ID NO: 25836 - RNA, 18 nt, artificial
  Chemically synthesized
aagggcgcggccuggacg

SEQ ID NO: 25837 - RNA, 18 nt, artificial
  Chemically synthesized
ugguagaugaagucggag

SEQ ID NO: 25838 - RNA, 18 nt, artificial
  Chemically synthesized
agggcuggagacgcccuc

SEQ ID NO: 25839 - RNA, 18 nt, artificial
  Chemically synthesized
caaagccgucgaagaggc

SEQ ID NO: 25840 - RNA, 18 nt, artificial
  Chemically synthesized
ucucagaacuugcuuguu

SEQ ID NO: 25841 - RNA, 18 nt, artificial
  Chemically synthesized
guacaguacugaccuguc

SEQ ID NO: 25842 - RNA, 18 nt, artificial
  Chemically synthesized
acagagcccuccaugcug

SEQ ID NO: 25843 - RNA, 18 nt, artificial
  Chemically synthesized
cggucucguagcugcccu

SEQ ID NO: 25844 - RNA, 18 nt, artificial
  Chemically synthesized
gucccagccgcacgcgug

SEQ ID NO: 25845 - RNA, 18 nt, artificial
  Chemically synthesized
cuuugcugcugggcuugc

SEQ ID NO: 25846 - RNA, 18 nt, artificial
  Chemically synthesized
acaggcaggugaugcugg

SEQ ID NO: 25847 - RNA, 18 nt, artificial
  Chemically synthesized
cacaguccacacaucuca

SEQ ID NO: 25848 - RNA, 18 nt, artificial
  Chemically synthesized
acgucgguggcacucugg

SEQ ID NO: 25849 - RNA, 18 nt, artificial
  Chemically synthesized
ggcugcaggcuuugcugc

SEQ ID NO: 25850 - RNA, 18 nt, artificial
  Chemically synthesized
acguaggaaaacccuggc

SEQ ID NO: 25851 - RNA, 18 nt, artificial
  Chemically synthesized
gccucuggaugcagcuuc

SEQ ID NO: 25852 - RNA, 18 nt, artificial
  Chemically synthesized
uaaaggccgguccagccg

SEQ ID NO: 25853 - RNA, 18 nt, artificial
  Chemically synthesized
acccucgcugccaccagg

SEQ ID NO: 25854 - RNA, 18 nt, artificial
  Chemically synthesized
agaagcagagguaggcgu

SEQ ID NO: 25855 - RNA, 18 nt, artificial
  Chemically synthesized
ccauucaaacugguggac

SEQ ID NO: 25856 - RNA, 18 nt, artificial
  Chemically synthesized
ccgcuucacacuucccgc

SEQ ID NO: 25857 - RNA, 18 nt, artificial
  Chemically synthesized
cggcgucaaccucacccu

SEQ ID NO: 25858 - RNA, 18 nt, artificial
  Chemically synthesized
cuugcaguuguuuccugg

SEQ ID NO: 25859 - RNA, 18 nt, artificial
  Chemically synthesized
cacacacagguguaagug

SEQ ID NO: 25860 - RNA, 18 nt, artificial
  Chemically synthesized
agcgcucccaggaaugcg

SEQ ID NO: 25861 - RNA, 18 nt, artificial
  Chemically synthesized
gcaguggugcguguugcc

SEQ ID NO: 25862 - RNA, 18 nt, artificial
  Chemically synthesized
gggcagccaggaucagug

SEQ ID NO: 25863 - RNA, 18 nt, artificial
  Chemically synthesized
uccgagaacacauuuuca

SEQ ID NO: 25864 - RNA, 18 nt, artificial
  Chemically synthesized
uugacgucgaucucgcau

SEQ ID NO: 25865 - RNA, 18 nt, artificial
  Chemically synthesized
ccaagucugacgucccuc

SEQ ID NO: 25866 - RNA, 18 nt, artificial
  Chemically synthesized
agcugcaggcauagucug

SEQ ID NO: 25867 - RNA, 18 nt, artificial
  Chemically synthesized
caucuaaaacacauggca

SEQ ID NO: 25868 - RNA, 18 nt, artificial
  Chemically synthesized
cgguggucugucuggucg

SEQ ID NO: 25869 - RNA, 18 nt, artificial
  Chemically synthesized
ccguugaggcugucccgg

SEQ ID NO: 25870 - RNA, 18 nt, artificial
  Chemically synthesized
uggccgcuucacacuucc

SEQ ID NO: 25871 - RNA, 18 nt, artificial
  Chemically synthesized
cguugaucucacagugca

SEQ ID NO: 25872 - RNA, 18 nt, artificial
  Chemically synthesized
uagaugaagucggagaug

SEQ ID NO: 25873 - RNA, 18 nt, artificial
  Chemically synthesized
ucucgcagugguggcccg

SEQ ID NO: 25874 - RNA, 18 nt, artificial
  Chemically synthesized
gaccuguccacucuggcg

SEQ ID NO: 25875 - RNA, 18 nt, artificial
  Chemically synthesized
acucgcaguggaagucau

SEQ ID NO: 25876 - RNA, 18 nt, artificial
  Chemically synthesized
uauugcaaaaaucugcuc

SEQ ID NO: 25877 - RNA, 18 nt, artificial
  Chemically synthesized
ugccaucaugcaugcggg

SEQ ID NO: 25878 - RNA, 18 nt, artificial
  Chemically synthesized
ugcuccggcggcaucagc

SEQ ID NO: 25879 - RNA, 18 nt, artificial
  Chemically synthesized
ugggugccacgggcgucg

SEQ ID NO: 25880 - RNA, 18 nt, artificial
  Chemically synthesized
gugaagguggcgacgccg

SEQ ID NO: 25881 - RNA, 18 nt, artificial
  Chemically synthesized
ccaggaucaguggcgucg

SEQ ID NO: 25882 - RNA, 18 nt, artificial
  Chemically synthesized
cguccugacaggugccgc

SEQ ID NO: 25883 - RNA, 18 nt, artificial
  Chemically synthesized
auugaaguugagggagca

SEQ ID NO: 25884 - RNA, 18 nt, artificial
  Chemically synthesized
uguuuuaaaaaggcuccu

SEQ ID NO: 25885 - RNA, 18 nt, artificial
  Chemically synthesized
guagaugaagucggagau

SEQ ID NO: 25886 - RNA, 18 nt, artificial
  Chemically synthesized
gcacucgaaggagcccag

SEQ ID NO: 25887 - RNA, 18 nt, artificial
  Chemically synthesized
agucggcgucaaccucac

SEQ ID NO: 25888 - RNA, 18 nt, artificial
  Chemically synthesized
cagaagcagagguaggcg

SEQ ID NO: 25889 - RNA, 18 nt, artificial
  Chemically synthesized
cacagaagaaucuuuuca

SEQ ID NO: 25890 - RNA, 18 nt, artificial
  Chemically synthesized
cugggucugcaccaggug

SEQ ID NO: 25891 - RNA, 18 nt, artificial
  Chemically synthesized
aaguacuuccagcacugc

SEQ ID NO: 25892 - RNA, 18 nt, artificial
  Chemically synthesized
gcagcggcacuuguacuc

SEQ ID NO: 25893 - RNA, 18 nt, artificial
  Chemically synthesized
agcugcgggcugcgcacc

SEQ ID NO: 25894 - RNA, 18 nt, artificial
  Chemically synthesized
cugcacgcaguucugggu

SEQ ID NO: 25895 - RNA, 18 nt, artificial
  Chemically synthesized
ggugcagcuguagccgcc

SEQ ID NO: 25896 - RNA, 18 nt, artificial
  Chemically synthesized
gugucuccucccuguugu

SEQ ID NO: 25897 - RNA, 18 nt, artificial
  Chemically synthesized
gacacugugcaggcugag

SEQ ID NO: 25898 - RNA, 18 nt, artificial
  Chemically synthesized
cugcuggcacgauuuccc

SEQ ID NO: 25899 - RNA, 18 nt, artificial
  Chemically synthesized
uggauguuggcaucugcg

SEQ ID NO: 25900 - RNA, 18 nt, artificial
  Chemically synthesized
gaccagcgaggauggcag

SEQ ID NO: 25901 - RNA, 18 nt, artificial
  Chemically synthesized
agcgguaggagccgaccu

SEQ ID NO: 25902 - RNA, 18 nt, artificial
  Chemically synthesized
aagugcagcugcgccggc

SEQ ID NO: 25903 - RNA, 18 nt, artificial
  Chemically synthesized
gcacuggccuuccgcacg

SEQ ID NO: 25904 - RNA, 18 nt, artificial
  Chemically synthesized
uguucacggcggcggccc

SEQ ID NO: 25905 - RNA, 18 nt, artificial
  Chemically synthesized
ugugacccaggcaagugc

SEQ ID NO: 25906 - RNA, 18 nt, artificial
  Chemically synthesized
uguuguucugcauaucuu

SEQ ID NO: 25907 - RNA, 18 nt, artificial
  Chemically synthesized
gugcacguguagcugucc

SEQ ID NO: 25908 - RNA, 18 nt, artificial
  Chemically synthesized
cagcaggcagcccuugcc

SEQ ID NO: 25909 - RNA, 18 nt, artificial
  Chemically synthesized
augucacaguugguccca

SEQ ID NO: 25910 - RNA, 18 nt, artificial
  Chemically synthesized
gggauugcagucguccac

SEQ ID NO: 25911 - RNA, 18 nt, artificial
  Chemically synthesized
aguagaaggaggccacac

SEQ ID NO: 25912 - RNA, 18 nt, artificial
  Chemically synthesized
accuguguagggcagcag

SEQ ID NO: 25913 - RNA, 18 nt, artificial
  Chemically synthesized
cagucgucgaugucgguc

SEQ ID NO: 25914 - RNA, 18 nt, artificial
  Chemically synthesized
gucuccucccuguuguuc

SEQ ID NO: 25915 - RNA, 18 nt, artificial
  Chemically synthesized
gugcuggcaguagcugcc

SEQ ID NO: 25916 - RNA, 18 nt, artificial
  Chemically synthesized
cugaccuguccacucugg

SEQ ID NO: 25917 - RNA, 18 nt, artificial
  Chemically synthesized
cugaugcaugcgucguug

SEQ ID NO: 25918 - RNA, 18 nt, artificial
  Chemically synthesized
acggguucgagacgcacu

SEQ ID NO: 25919 - RNA, 18 nt, artificial
  Chemically synthesized
gacauggguuggacgcac

SEQ ID NO: 25920 - RNA, 18 nt, artificial
  Chemically synthesized
ucaaugugcccggcucug

SEQ ID NO: 25921 - RNA, 18 nt, artificial
  Chemically synthesized
aaguugagggagcaguca

SEQ ID NO: 25922 - RNA, 18 nt, artificial
  Chemically synthesized
ccuccuugcuuccacagg

SEQ ID NO: 25923 - RNA, 18 nt, artificial
  Chemically synthesized
cagguggcgucguucugg

SEQ ID NO: 25924 - RNA, 18 nt, artificial
  Chemically synthesized
cggcuccacggucucacu

SEQ ID NO: 25925 - RNA, 18 nt, artificial
  Chemically synthesized
ucgcugcgcagccaccuc

SEQ ID NO: 25926 - RNA, 18 nt, artificial
  Chemically synthesized
cguccaccagguccucac

SEQ ID NO: 25927 - RNA, 18 nt, artificial
  Chemically synthesized
gcucaaugugcccggcuc

SEQ ID NO: 25928 - RNA, 18 nt, artificial
  Chemically synthesized
cuccagcaggcgcuuggc

SEQ ID NO: 25929 - RNA, 18 nt, artificial
  Chemically synthesized
acgggugggaccagcgag

SEQ ID NO: 25930 - RNA, 18 nt, artificial
  Chemically synthesized
gcuguugcagcccugguc

SEQ ID NO: 25931 - RNA, 18 nt, artificial
  Chemically synthesized
caaggcuacugugcagcg

SEQ ID NO: 25932 - RNA, 18 nt, artificial
  Chemically synthesized
auuucccugaccagccgg

SEQ ID NO: 25933 - RNA, 18 nt, artificial
  Chemically synthesized
ucacacguggcaccugug

SEQ ID NO: 25934 - RNA, 18 nt, artificial
  Chemically synthesized
uccugggacuucuuccuc

SEQ ID NO: 25935 - RNA, 18 nt, artificial
  Chemically synthesized
ccgccgccacguacauga

SEQ ID NO: 25936 - RNA, 18 nt, artificial
  Chemically synthesized
ucccgcugaagccugcgg

SEQ ID NO: 25937 - RNA, 18 nt, artificial
  Chemically synthesized
uucuuccuccgugccuug

SEQ ID NO: 25938 - RNA, 18 nt, artificial
  Chemically synthesized
auuucaagaacgggcagg

SEQ ID NO: 25939 - RNA, 18 nt, artificial
  Chemically synthesized
ggccuggugccacacucc

SEQ ID NO: 25940 - RNA, 18 nt, artificial
  Chemically synthesized
gugcagcuguagccgccc

SEQ ID NO: 25941 - RNA, 18 nt, artificial
  Chemically synthesized
ccugguagcucaucaucu

SEQ ID NO: 25942 - RNA, 18 nt, artificial
  Chemically synthesized
acccauaugcuuucacuu

SEQ ID NO: 25943 - RNA, 18 nt, artificial
  Chemically synthesized
uuucacaagcaugcuugc

SEQ ID NO: 25944 - RNA, 18 nt, artificial
  Chemically synthesized
gcaagucuccuacaaaac

SEQ ID NO: 25945 - RNA, 18 nt, artificial
  Chemically synthesized
uugaggcccacggagucc

SEQ ID NO: 25946 - RNA, 18 nt, artificial
  Chemically synthesized
uaacccauaugcuuucac

SEQ ID NO: 25947 - RNA, 18 nt, artificial
  Chemically synthesized
aguagcugccuguguagc

SEQ ID NO: 25948 - RNA, 18 nt, artificial
  Chemically synthesized
ccgccguugacacaaggg

SEQ ID NO: 25949 - RNA, 18 nt, artificial
  Chemically synthesized
ugucccggcguucuugca

SEQ ID NO: 25950 - RNA, 18 nt, artificial
  Chemically synthesized
ggcgcguccuccucuucc

SEQ ID NO: 25951 - RNA, 18 nt, artificial
  Chemically synthesized
ggcagucgucgaugucgg

SEQ ID NO: 25952 - RNA, 18 nt, artificial
  Chemically synthesized
aagccggguggacacagg

SEQ ID NO: 25953 - RNA, 18 nt, artificial
  Chemically synthesized
augcaugugccgccguug

SEQ ID NO: 25954 - RNA, 18 nt, artificial
  Chemically synthesized
gaccaaaggacgcagccc

SEQ ID NO: 25955 - RNA, 18 nt, artificial
  Chemically synthesized
acaggguuggugucgcag

SEQ ID NO: 25956 - RNA, 18 nt, artificial
  Chemically synthesized
caucagagcgugaguagc

SEQ ID NO: 25957 - RNA, 18 nt, artificial
  Chemically synthesized
gucggucucgcaguugcg

SEQ ID NO: 25958 - RNA, 18 nt, artificial
  Chemically synthesized
guuguucucacaguggau

SEQ ID NO: 25959 - RNA, 18 nt, artificial
  Chemically synthesized
guacugggugugggucug

SEQ ID NO: 25960 - RNA, 18 nt, artificial
  Chemically synthesized
acaccuugugcgucggca

SEQ ID NO: 25961 - RNA, 18 nt, artificial
  Chemically synthesized
gcuacugugcagcgggcc

SEQ ID NO: 25962 - RNA, 18 nt, artificial
  Chemically synthesized
cuuccgugcacacacagg

SEQ ID NO: 25963 - RNA, 18 nt, artificial
  Chemically synthesized
cugcugggucugcaccag

SEQ ID NO: 25964 - RNA, 18 nt, artificial
  Chemically synthesized
uggcagcaaggcuacugu

SEQ ID NO: 25965 - RNA, 18 nt, artificial
  Chemically synthesized
gauguugaggcugcccag

SEQ ID NO: 25966 - RNA, 18 nt, artificial
  Chemically synthesized
acucgcacuggaacucau

SEQ ID NO: 25967 - RNA, 18 nt, artificial
  Chemically synthesized
aagugccacaguccacac

SEQ ID NO: 25968 - RNA, 18 nt, artificial
  Chemically synthesized
gcugcagaccuuguugcc

SEQ ID NO: 25969 - RNA, 18 nt, artificial
  Chemically synthesized
cagcucgcacgccuccuc

SEQ ID NO: 25970 - RNA, 18 nt, artificial
  Chemically synthesized
gucgucaauacacgugcc

SEQ ID NO: 25971 - RNA, 18 nt, artificial
  Chemically synthesized
aggagugcaggcggcacg

SEQ ID NO: 25972 - RNA, 18 nt, artificial
  Chemically synthesized
cuuugcugcugcuggaug

SEQ ID NO: 25973 - RNA, 18 nt, artificial
  Chemically synthesized
uccggcggcaucagcacc

SEQ ID NO: 25974 - RNA, 18 nt, artificial
  Chemically synthesized
cgcaguaaaggccggucc

SEQ ID NO: 25975 - RNA, 18 nt, artificial
  Chemically synthesized
auugacaggguugguguc

SEQ ID NO: 25976 - RNA, 18 nt, artificial
  Chemically synthesized
guguagcccugcagacac

SEQ ID NO: 25977 - RNA, 18 nt, artificial
  Chemically synthesized
cgccguccuugcaggagc

SEQ ID NO: 25978 - RNA, 18 nt, artificial
  Chemically synthesized
agucggagacguuggaau

SEQ ID NO: 25979 - RNA, 18 nt, artificial
  Chemically synthesized
caggcugcagaccuuguu

SEQ ID NO: 25980 - RNA, 18 nt, artificial
  Chemically synthesized
ugcgucacgcuugaagac

SEQ ID NO: 25981 - RNA, 18 nt, artificial
  Chemically synthesized
ucauugaccucagacagg

SEQ ID NO: 25982 - RNA, 18 nt, artificial
  Chemically synthesized
cugcauaucuuuguuagc

SEQ ID NO: 25983 - RNA, 18 nt, artificial
  Chemically synthesized
caaugugcccggcucugg

SEQ ID NO: 25984 - RNA, 18 nt, artificial
  Chemically synthesized
cugcccugaggagugcag

SEQ ID NO: 25985 - RNA, 18 nt, artificial
  Chemically synthesized
acgucgaucucgcaucgg

SEQ ID NO: 25986 - RNA, 18 nt, artificial
  Chemically synthesized
guugaggcagcgcaggcu

SEQ ID NO: 25987 - RNA, 18 nt, artificial
  Chemically synthesized
ccucgguacaguacugac

SEQ ID NO: 25988 - RNA, 18 nt, artificial
  Chemically synthesized
aaaggacgcagcccacgg

SEQ ID NO: 25989 - RNA, 18 nt, artificial
  Chemically synthesized
gcgaucugggacugcaug

SEQ ID NO: 25990 - RNA, 18 nt, artificial
  Chemically synthesized
gagacgcacucguugacg

SEQ ID NO: 25991 - RNA, 18 nt, artificial
  Chemically synthesized
acacacacgcaguuguag

SEQ ID NO: 25992 - RNA, 18 nt, artificial
  Chemically synthesized
cgcuuggcggcaucagag

SEQ ID NO: 25993 - RNA, 18 nt, artificial
  Chemically synthesized
ugacgucccucacuggca

SEQ ID NO: 25994 - RNA, 18 nt, artificial
  Chemically synthesized
ucauaguccucggauugc

SEQ ID NO: 25995 - RNA, 18 nt, artificial
  Chemically synthesized
uuucugccauaggcuaua

SEQ ID NO: 25996 - RNA, 18 nt, artificial
  Chemically synthesized
cgcaccagguuguacucg

SEQ ID NO: 25997 - RNA, 18 nt, artificial
  Chemically synthesized
ugcugcuggauguuugcu

SEQ ID NO: 25998 - RNA, 18 nt, artificial
  Chemically synthesized
cgugugaguugaugaggu

SEQ ID NO: 25999 - RNA, 18 nt, artificial
  Chemically synthesized
ggaacuucuuggucucca

SEQ ID NO: 26000 - RNA, 18 nt, artificial
  Chemically synthesized
aucuccagguagacgaug

SEQ ID NO: 26001 - RNA, 18 nt, artificial
  Chemically synthesized
aucgugcuggcaguagcu

SEQ ID NO: 26002 - RNA, 18 nt, artificial
  Chemically synthesized
cuguguugaccucgcagu

SEQ ID NO: 26003 - RNA, 18 nt, artificial
  Chemically synthesized
cacuccgcgcuguugcag

SEQ ID NO: 26004 - RNA, 18 nt, artificial
  Chemically synthesized
uugcccgcguccuccugg

SEQ ID NO: 26005 - RNA, 18 nt, artificial
  Chemically synthesized
cuugcgggacagcagcac

SEQ ID NO: 26006 - RNA, 18 nt, artificial
  Chemically synthesized
aguggcagcgguagccgc

SEQ ID NO: 26007 - RNA, 18 nt, artificial
  Chemically synthesized
uccagcaugcccuccacg

SEQ ID NO: 26008 - RNA, 18 nt, artificial
  Chemically synthesized
cauuuggcaucagcuggc

SEQ ID NO: 26009 - RNA, 18 nt, artificial
  Chemically synthesized
uccucaccaguccagccg

SEQ ID NO: 26010 - RNA, 18 nt, artificial
  Chemically synthesized
gacgcccgaaggcuuggg

SEQ ID NO: 26011 - RNA, 18 nt, artificial
  Chemically synthesized
cugcagggcacguagggc

SEQ ID NO: 26012 - RNA, 18 nt, artificial
  Chemically synthesized
caggugccuccguggcgg

SEQ ID NO: 26013 - RNA, 18 nt, artificial
  Chemically synthesized
cgggcucagaacgcacuc

SEQ ID NO: 26014 - RNA, 18 nt, artificial
  Chemically synthesized
cacuggcacucgaaggag

SEQ ID NO: 26015 - RNA, 18 nt, artificial
  Chemically synthesized
ugcacacacagguguaag

SEQ ID NO: 26016 - RNA, 18 nt, artificial
  Chemically synthesized
gugcggucugucugguug

SEQ ID NO: 26017 - RNA, 18 nt, artificial
  Chemically synthesized
gcacugcgaggaggccug

SEQ ID NO: 26018 - RNA, 18 nt, artificial
  Chemically synthesized
gcucuccacucaggaagc

SEQ ID NO: 26019 - RNA, 18 nt, artificial
  Chemically synthesized
guuguucugcauaucuuu

SEQ ID NO: 26020 - RNA, 18 nt, artificial
  Chemically synthesized
agccauugaugccguccu

SEQ ID NO: 26021 - RNA, 18 nt, artificial
  Chemically synthesized
ggugaugcugguggagcg

SEQ ID NO: 26022 - RNA, 18 nt, artificial
  Chemically synthesized
agccgucgaagaggcagc

SEQ ID NO: 26023 - RNA, 18 nt, artificial
  Chemically synthesized
ccgccaucucgggcuugg

SEQ ID NO: 26024 - RNA, 18 nt, artificial
  Chemically synthesized
guugcuguugcacucauu

SEQ ID NO: 26025 - RNA, 18 nt, artificial
  Chemically synthesized
cuugcuuguuuucucaga

SEQ ID NO: 26026 - RNA, 18 nt, artificial
  Chemically synthesized
uggucccacuccacccag

SEQ ID NO: 26027 - RNA, 18 nt, artificial
  Chemically synthesized
gucacaguuggucccacu

SEQ ID NO: 26028 - RNA, 18 nt, artificial
  Chemically synthesized
gcggcugcaggcuuugcu

SEQ ID NO: 26029 - RNA, 18 nt, artificial
  Chemically synthesized
gaaccggaacuucuuggu

SEQ ID NO: 26030 - RNA, 18 nt, artificial
  Chemically synthesized
uggcgcccugguagauga

SEQ ID NO: 26031 - RNA, 18 nt, artificial
  Chemically synthesized
ggacaggaccaaaggacg

SEQ ID NO: 26032 - RNA, 18 nt, artificial
  Chemically synthesized
ccagguuguacucgucca

SEQ ID NO: 26033 - RNA, 18 nt, artificial
  Chemically synthesized
guugaugucgaccucaca

SEQ ID NO: 26034 - RNA, 18 nt, artificial
  Chemically synthesized
cgucccacucgcacuccg

SEQ ID NO: 26035 - RNA, 18 nt, artificial
  Chemically synthesized
uggaugcagcuucuccua

SEQ ID NO: 26036 - RNA, 18 nt, artificial
  Chemically synthesized
uggauguuugcuggcugc

SEQ ID NO: 26037 - RNA, 18 nt, artificial
  Chemically synthesized
cugcuggcacgauuuccc

SEQ ID NO: 26038 - RNA, 18 nt, artificial
  Chemically synthesized
gcacgucugccuggcucg

SEQ ID NO: 26039 - RNA, 18 nt, artificial
  Chemically synthesized
uacacgugcccugguuca

SEQ ID NO: 26040 - RNA, 18 nt, artificial
  Chemically synthesized
ggcucccgccgcuucuuc

SEQ ID NO: 26041 - RNA, 18 nt, artificial
  Chemically synthesized
aggacgcagcccacggcg

SEQ ID NO: 26042 - RNA, 18 nt, artificial
  Chemically synthesized
uugcagcccuggucgcag

SEQ ID NO: 26043 - RNA, 18 nt, artificial
  Chemically synthesized
agcaaggcuacugugcag

SEQ ID NO: 26044 - RNA, 18 nt, artificial
  Chemically synthesized
gggugaagccaucaggcc

SEQ ID NO: 26045 - RNA, 18 nt, artificial
  Chemically synthesized
caguacuggucguacagg

SEQ ID NO: 26046 - RNA, 18 nt, artificial
  Chemically synthesized
augcugguggagcggccg

SEQ ID NO: 26047 - RNA, 18 nt, artificial
  Chemically synthesized
cugcagagacugcgugca

SEQ ID NO: 26048 - RNA, 18 nt, artificial
  Chemically synthesized
cccaggcuguguugcugg

SEQ ID NO: 26049 - RNA, 18 nt, artificial
  Chemically synthesized
uugcuggccucagacacu

SEQ ID NO: 26050 - RNA, 18 nt, artificial
  Chemically synthesized
ugcuccucccaaacuagg

SEQ ID NO: 26051 - RNA, 18 nt, artificial
  Chemically synthesized
cagcagggcgucaggugc

SEQ ID NO: 26052 - RNA, 18 nt, artificial
  Chemically synthesized
auuaauccgcgugcggaa

SEQ ID NO: 26053 - RNA, 18 nt, artificial
  Chemically synthesized
augacggacucgcagcgg

SEQ ID NO: 26054 - RNA, 18 nt, artificial
  Chemically synthesized
gcuguugcccgucuccag

SEQ ID NO: 26055 - RNA, 18 nt, artificial
  Chemically synthesized
cacgggucagccugcugg

SEQ ID NO: 26056 - RNA, 18 nt, artificial
  Chemically synthesized
cgcacuggaacucauuga

SEQ ID NO: 26057 - RNA, 18 nt, artificial
  Chemically synthesized
uguugcagcccuggucgc

SEQ ID NO: 26058 - RNA, 18 nt, artificial
  Chemically synthesized
augcacuugcccgcaugc

SEQ ID NO: 26059 - RNA, 18 nt, artificial
  Chemically synthesized
cacuugcagaugaacccg

SEQ ID NO: 26060 - RNA, 18 nt, artificial
  Chemically synthesized
uuccgcacgcuggcaguc

SEQ ID NO: 26061 - RNA, 18 nt, artificial
  Chemically synthesized
uccguccaggcacuuggc

SEQ ID NO: 26062 - RNA, 18 nt, artificial
  Chemically synthesized
uggagcccucguuacagg

SEQ ID NO: 26063 - RNA, 18 nt, artificial
  Chemically synthesized
gaagcacaaaggcggccg

SEQ ID NO: 26064 - RNA, 18 nt, artificial
  Chemically synthesized
gcaggugaagguggcgac

SEQ ID NO: 26065 - RNA, 18 nt, artificial
  Chemically synthesized
cguucuucaggagcacaa

SEQ ID NO: 26066 - RNA, 18 nt, artificial
  Chemically synthesized
caggcgguccauaugauc

SEQ ID NO: 26067 - RNA, 18 nt, artificial
  Chemically synthesized
gaagucggagaugacggc

SEQ ID NO: 26068 - RNA, 18 nt, artificial
  Chemically synthesized
uguuguccacaggcgagg

SEQ ID NO: 26069 - RNA, 18 nt, artificial
  Chemically synthesized
uugucgcugcgcagccac

SEQ ID NO: 26070 - RNA, 18 nt, artificial
  Chemically synthesized
cgccguucuugcagggcg

SEQ ID NO: 26071 - RNA, 18 nt, artificial
  Chemically synthesized
aggugcagcuguagccgc

SEQ ID NO: 26072 - RNA, 18 nt, artificial
  Chemically synthesized
aucuaacccauaugcuuu

SEQ ID NO: 26073 - RNA, 18 nt, artificial
  Chemically synthesized
ccgccacagacgcaggcc

SEQ ID NO: 26074 - RNA, 18 nt, artificial
  Chemically synthesized
cucacaguggaucccgcu

SEQ ID NO: 26075 - RNA, 18 nt, artificial
  Chemically synthesized
agagcuggccaugcugcc

SEQ ID NO: 26076 - RNA, 18 nt, artificial
  Chemically synthesized
cuuguauaaccaacgaac

SEQ ID NO: 26077 - RNA, 18 nt, artificial
  Chemically synthesized
aacaucuugggacgcauc

SEQ ID NO: 26078 - RNA, 18 nt, artificial
  Chemically synthesized
ucgcaguggaagucauug

SEQ ID NO: 26079 - RNA, 18 nt, artificial
  Chemically synthesized
ugcaggcugaggugcugg

SEQ ID NO: 26080 - RNA, 18 nt, artificial
  Chemically synthesized
ccguugacacaaggguug

SEQ ID NO: 26081 - RNA, 18 nt, artificial
  Chemically synthesized
cgaggagucacaccagug

SEQ ID NO: 26082 - RNA, 18 nt, artificial
  Chemically synthesized
cggccacgcacuugcagg

SEQ ID NO: 26083 - RNA, 18 nt, artificial
  Chemically synthesized
agcuguccagcaggcagc

SEQ ID NO: 26084 - RNA, 18 nt, artificial
  Chemically synthesized
gaucuuguccagacaggu

SEQ ID NO: 26085 - RNA, 18 nt, artificial
  Chemically synthesized
uguucacgccguccacac

SEQ ID NO: 26086 - RNA, 18 nt, artificial
  Chemically synthesized
gucucaccgggcugggag

SEQ ID NO: 26087 - RNA, 18 nt, artificial
  Chemically synthesized
uuguagccaccgugggug

SEQ ID NO: 26088 - RNA, 18 nt, artificial
  Chemically synthesized
aacgucgucaauacacgu

SEQ ID NO: 26089 - RNA, 18 nt, artificial
  Chemically synthesized
ucgcagugcacacccucg

SEQ ID NO: 26090 - RNA, 18 nt, artificial
  Chemically synthesized
gaagaaucuuuucauccu

SEQ ID NO: 26091 - RNA, 18 nt, artificial
  Chemically synthesized
cggcucacaggcacacuc

SEQ ID NO: 26092 - RNA, 18 nt, artificial
  Chemically synthesized
cagacaugcgcaggucag

SEQ ID NO: 26093 - RNA, 18 nt, artificial
  Chemically synthesized
uucccgccauucaggcag

SEQ ID NO: 26094 - RNA, 18 nt, artificial
  Chemically synthesized
acacagaagaaucuuuuc

SEQ ID NO: 26095 - RNA, 18 nt, artificial
  Chemically synthesized
aaggugagccagcuuugc

SEQ ID NO: 26096 - RNA, 18 nt, artificial
  Chemically synthesized
gcgguacugggugugggu

SEQ ID NO: 26097 - RNA, 18 nt, artificial
  Chemically synthesized
cagucguccacguugauc

SEQ ID NO: 26098 - RNA, 18 nt, artificial
  Chemically synthesized
uauaaccaacgaacaacu

SEQ ID NO: 26099 - RNA, 18 nt, artificial
  Chemically synthesized
aggcauagucugccacgc

SEQ ID NO: 26100 - RNA, 18 nt, artificial
  Chemically synthesized
uaaaaaggcuccucuggu

SEQ ID NO: 26101 - RNA, 18 nt, artificial
  Chemically synthesized
cugcugggucugcaccag

SEQ ID NO: 26102 - RNA, 18 nt, artificial
  Chemically synthesized
gugccgccaugcaggcag

SEQ ID NO: 26103 - RNA, 18 nt, artificial
  Chemically synthesized
caggaggcgaucaugagc

SEQ ID NO: 26104 - RNA, 18 nt, artificial
  Chemically synthesized
cacucgaaggagcccagc

SEQ ID NO: 26105 - RNA, 18 nt, artificial
  Chemically synthesized
aggugccaccguugaagc

SEQ ID NO: 26106 - RNA, 18 nt, artificial
  Chemically synthesized
cucgcacuccgcgcuguu

SEQ ID NO: 26107 - RNA, 18 nt, artificial
  Chemically synthesized
uguggcugcaccugcugg

SEQ ID NO: 26108 - RNA, 18 nt, artificial
  Chemically synthesized
gggcggccagaaacaggg

SEQ ID NO: 26109 - RNA, 18 nt, artificial
  Chemically synthesized
ugucuccucccuguuguu

SEQ ID NO: 26110 - RNA, 18 nt, artificial
  Chemically synthesized
gcagcuucuccuaacagg

SEQ ID NO: 26111 - RNA, 18 nt, artificial
  Chemically synthesized
caugaugccuacauuuca

SEQ ID NO: 26112 - RNA, 18 nt, artificial
  Chemically synthesized
ggagcuuuuuggacuaug

SEQ ID NO: 26113 - RNA, 18 nt, artificial
  Chemically synthesized
agcacggcacucgcagug

SEQ ID NO: 26114 - RNA, 18 nt, artificial
  Chemically synthesized
ucgcaguugcgcccacug

SEQ ID NO: 26115 - RNA, 18 nt, artificial
  Chemically synthesized
guccaggcacuuggcacc

SEQ ID NO: 26116 - RNA, 18 nt, artificial
  Chemically synthesized
ucgcaguuggagcccucg

SEQ ID NO: 26117 - RNA, 18 nt, artificial
  Chemically synthesized
cacgggcgagagcaugcc

SEQ ID NO: 26118 - RNA, 18 nt, artificial
  Chemically synthesized
gugggaccagcgaggaug

SEQ ID NO: 26119 - RNA, 18 nt, artificial
  Chemically synthesized
agggcgucaggugcggcc

SEQ ID NO: 26120 - RNA, 18 nt, artificial
  Chemically synthesized
gugaguugaugagguccu

SEQ ID NO: 26121 - RNA, 18 nt, artificial
  Chemically synthesized
cugcgaggaggccugcac

SEQ ID NO: 26122 - RNA, 18 nt, artificial
  Chemically synthesized
ugguauugcaaaaaucug

SEQ ID NO: 26123 - RNA, 18 nt, artificial
  Chemically synthesized
ccgcuggcugcugagcuc

SEQ ID NO: 26124 - RNA, 18 nt, artificial
  Chemically synthesized
gucgucgaugucggucuc

SEQ ID NO: 26125 - RNA, 18 nt, artificial
  Chemically synthesized
gagccgaccucguugugg

SEQ ID NO: 26126 - RNA, 18 nt, artificial
  Chemically synthesized
ucgaaccggaacuucuug

SEQ ID NO: 26127 - RNA, 18 nt, artificial
  Chemically synthesized
ggaaguggaaggagcugu

SEQ ID NO: 26128 - RNA, 18 nt, artificial
  Chemically synthesized
gaaggagcuguugcgcag

SEQ ID NO: 26129 - RNA, 18 nt, artificial
  Chemically synthesized
caagucuccuacaaaaca

SEQ ID NO: 26130 - RNA, 18 nt, artificial
  Chemically synthesized
acccgcccacagugaaau

SEQ ID NO: 26131 - RNA, 18 nt, artificial
  Chemically synthesized
agaaggccguguugaugc

SEQ ID NO: 26132 - RNA, 18 nt, artificial
  Chemically synthesized
cugcccugaggagugcag

SEQ ID NO: 26133 - RNA, 18 nt, artificial
  Chemically synthesized
cuccgugcagcugcgggc

SEQ ID NO: 26134 - RNA, 18 nt, artificial
  Chemically synthesized
gcacgcggcugagcuccc

SEQ ID NO: 26135 - RNA, 18 nt, artificial
  Chemically synthesized
gcagauguaggaggccuc

SEQ ID NO: 26136 - RNA, 18 nt, artificial
  Chemically synthesized
caucucgggcuuggccgc

SEQ ID NO: 26137 - RNA, 18 nt, artificial
  Chemically synthesized
gcacucguccaccagguc

SEQ ID NO: 26138 - RNA, 18 nt, artificial
  Chemically synthesized
ugcgugcaguucuuccag

SEQ ID NO: 26139 - RNA, 18 nt, artificial
  Chemically synthesized
ggguguuguccacaggcg

SEQ ID NO: 26140 - RNA, 18 nt, artificial
  Chemically synthesized
ucagcuggcacucgucca

SEQ ID NO: 26141 - RNA, 18 nt, artificial
  Chemically synthesized
caccucacaggacacgcu

SEQ ID NO: 26142 - RNA, 18 nt, artificial
  Chemically synthesized
uacccuuccgugcacaca

SEQ ID NO: 26143 - RNA, 18 nt, artificial
  Chemically synthesized
cacucgcacuggaacuca

SEQ ID NO: 26144 - RNA, 18 nt, artificial
  Chemically synthesized
gcacucguugaugucgac

SEQ ID NO: 26145 - RNA, 18 nt, artificial
  Chemically synthesized
cacagcucaaugugcccg

SEQ ID NO: 26146 - RNA, 18 nt, artificial
  Chemically synthesized
auuggacaggcacucguu

SEQ ID NO: 26147 - RNA, 18 nt, artificial
  Chemically synthesized
cgccguggguguucuggc

SEQ ID NO: 26148 - RNA, 18 nt, artificial
  Chemically synthesized
uggcacucuggaagcacu

SEQ ID NO: 26149 - RNA, 18 nt, artificial
  Chemically synthesized
ugugcgaugucgcgcggc

SEQ ID NO: 26150 - RNA, 18 nt, artificial
  Chemically synthesized
uugcaagaaaccaucuaa

SEQ ID NO: 26151 - RNA, 18 nt, artificial
  Chemically synthesized
uguagggcagcaggcagu

SEQ ID NO: 26152 - RNA, 18 nt, artificial
  Chemically synthesized
ugcagaugaacccgcggg

SEQ ID NO: 26153 - RNA, 18 nt, artificial
  Chemically synthesized
ggacugcaugcugguggg

SEQ ID NO: 26154 - RNA, 18 nt, artificial
  Chemically synthesized
cagcggccauugugcagg

SEQ ID NO: 26155 - RNA, 18 nt, artificial
  Chemically synthesized
gggcaugcagaugcacug

SEQ ID NO: 26156 - RNA, 18 nt, artificial
  Chemically synthesized
cugcagggcacguagggc

SEQ ID NO: 26157 - RNA, 18 nt, artificial
  Chemically synthesized
cggcguugacgucggcgu

SEQ ID NO: 26158 - RNA, 18 nt, artificial
  Chemically synthesized
aaaacccuggcucucaga

SEQ ID NO: 26159 - RNA, 18 nt, artificial
  Chemically synthesized
gugggagaggcacucguc

SEQ ID NO: 26160 - RNA, 18 nt, artificial
  Chemically synthesized
ugcacaagguucuggcag

SEQ ID NO: 26161 - RNA, 18 nt, artificial
  Chemically synthesized
caacaucuaacccauaug

SEQ ID NO: 26162 - RNA, 18 nt, artificial
  Chemically synthesized
cugcgguccaccacgugg

SEQ ID NO: 26163 - RNA, 18 nt, artificial
  Chemically synthesized
ggguuguauugguucggc

SEQ ID NO: 26164 - RNA, 18 nt, artificial
  Chemically synthesized
acaggugccgccaugcag

SEQ ID NO: 26165 - RNA, 18 nt, artificial
  Chemically synthesized
cacguacaugaagugcag

SEQ ID NO: 26166 - RNA, 18 nt, artificial
  Chemically synthesized
accaugccgcucugcagc

SEQ ID NO: 26167 - RNA, 18 nt, artificial
  Chemically synthesized
cugugcaggcugaggugc

SEQ ID NO: 26168 - RNA, 18 nt, artificial
  Chemically synthesized
cacagugcacacccugag

SEQ ID NO: 26169 - RNA, 18 nt, artificial
  Chemically synthesized
cccgcaggaaguggaagg

SEQ ID NO: 26170 - RNA, 18 nt, artificial
  Chemically synthesized
ugcggcccauguuguccu

SEQ ID NO: 26171 - RNA, 18 nt, artificial
  Chemically synthesized
cuguaaacuacacucuau

SEQ ID NO: 26172 - RNA, 18 nt, artificial
  Chemically synthesized
agcaugccggagcugucc

SEQ ID NO: 26173 - RNA, 18 nt, artificial
  Chemically synthesized
gguucggcaccaugccgc

SEQ ID NO: 26174 - RNA, 18 nt, artificial
  Chemically synthesized
uggcagcggcaguggugc

SEQ ID NO: 26175 - RNA, 18 nt, artificial
  Chemically synthesized
gaagcuccggcccaggug

SEQ ID NO: 26176 - RNA, 18 nt, artificial
  Chemically synthesized
ucaggcagaaccacgggc

SEQ ID NO: 26177 - RNA, 18 nt, artificial
  Chemically synthesized
gcgugguuguugcacugc

SEQ ID NO: 26178 - RNA, 18 nt, artificial
  Chemically synthesized
aucccgcugaagccugcg

SEQ ID NO: 26179 - RNA, 18 nt, artificial
  Chemically synthesized
cgacgccguccuugcagg

SEQ ID NO: 26180 - RNA, 18 nt, artificial
  Chemically synthesized
ggacuaugcucguucaac

SEQ ID NO: 26181 - RNA, 18 nt, artificial
  Chemically synthesized
uuggugaggcaggcauug

SEQ ID NO: 26182 - RNA, 18 nt, artificial
  Chemically synthesized
gucauugaaguugaggga

SEQ ID NO: 26183 - RNA, 18 nt, artificial
  Chemically synthesized
cugccgguggucugucug

SEQ ID NO: 26184 - RNA, 18 nt, artificial
  Chemically synthesized
acguggcaccuguguagg

SEQ ID NO: 26185 - RNA, 18 nt, artificial
  Chemically synthesized
uccugugcgaugucgcgc

SEQ ID NO: 26186 - RNA, 18 nt, artificial
  Chemically synthesized
ugagcucacgccaaggug

SEQ ID NO: 26187 - RNA, 18 nt, artificial
  Chemically synthesized
gcuauacuugguauugca

SEQ ID NO: 26188 - RNA, 18 nt, artificial
  Chemically synthesized
acauugacguccaugcag

SEQ ID NO: 26189 - RNA, 18 nt, artificial
  Chemically synthesized
gccauucaggcaggucuc

SEQ ID NO: 26190 - RNA, 18 nt, artificial
  Chemically synthesized
gagcuggaccacugguca

SEQ ID NO: 26191 - RNA, 18 nt, artificial
  Chemically synthesized
gaccucgcagugcacacc

SEQ ID NO: 26192 - RNA, 18 nt, artificial
  Chemically synthesized
ugguugugcaggcuggcg

SEQ ID NO: 26193 - RNA, 18 nt, artificial
  Chemically synthesized
ucccucacuggcaugaca

SEQ ID NO: 26194 - RNA, 18 nt, artificial
  Chemically synthesized
agcgucauucucacacgu

SEQ ID NO: 26195 - RNA, 18 nt, artificial
  Chemically synthesized
acgcccgaaggcuuggga

SEQ ID NO: 26196 - RNA, 18 nt, artificial
  Chemically synthesized
cagucgcacuuguacccg

SEQ ID NO: 26197 - RNA, 18 nt, artificial
  Chemically synthesized
aggccacgucugacaggu

SEQ ID NO: 26198 - RNA, 18 nt, artificial
  Chemically synthesized
agcuguagccgcccaccu

SEQ ID NO: 26199 - RNA, 18 nt, artificial
  Chemically synthesized
ugccaccguugaagcagg

SEQ ID NO: 26200 - RNA, 18 nt, artificial
  Chemically synthesized
ccagcaggcgcuuggcgg

SEQ ID NO: 26201 - RNA, 18 nt, artificial
  Chemically synthesized
cuuggucuccagguccuc

SEQ ID NO: 26202 - RNA, 18 nt, artificial
  Chemically synthesized
uguuggaggccacggcgc

SEQ ID NO: 26203 - RNA, 18 nt, artificial
  Chemically synthesized
aggugcaaggcggucucg

SEQ ID NO: 26204 - RNA, 18 nt, artificial
  Chemically synthesized
ugcccgucgcugaagugg

SEQ ID NO: 26205 - RNA, 18 nt, artificial
  Chemically synthesized
gcaccagguuguacucgu

SEQ ID NO: 26206 - RNA, 18 nt, artificial
  Chemically synthesized
ucaguggcgucgugccau

SEQ ID NO: 26207 - RNA, 18 nt, artificial
  Chemically synthesized
acagcagaccugugcggc

SEQ ID NO: 26208 - RNA, 18 nt, artificial
  Chemically synthesized
uugaugccguccacgcag

SEQ ID NO: 26209 - RNA, 18 nt, artificial
  Chemically synthesized
ccucauguagaucacuuu

SEQ ID NO: 26210 - RNA, 18 nt, artificial
  Chemically synthesized
ugagcucccgcaggaagu

SEQ ID NO: 26211 - RNA, 18 nt, artificial
  Chemically synthesized
gcuucacgggcagcuacu

SEQ ID NO: 26212 - RNA, 18 nt, artificial
  Chemically synthesized
cugcaaggaccacuucag

SEQ ID NO: 26213 - RNA, 18 nt, artificial
  Chemically synthesized
gcagccaggacguggaug

SEQ ID NO: 26214 - RNA, 18 nt, artificial
  Chemically synthesized
gugcugcacaccaacgug

SEQ ID NO: 26215 - RNA, 18 nt, artificial
  Chemically synthesized
gcacugcgagguggacau

SEQ ID NO: 26216 - RNA, 18 nt, artificial
  Chemically synthesized
aggcagcuacugugagga

SEQ ID NO: 26217 - RNA, 18 nt, artificial
  Chemically synthesized
augccaacauccaggaca

SEQ ID NO: 26218 - RNA, 18 nt, artificial
  Chemically synthesized
gacugcauggacgucaau

SEQ ID NO: 26219 - RNA, 18 nt, artificial
  Chemically synthesized
cugcugucccgcaagcgc

SEQ ID NO: 26220 - RNA, 18 nt, artificial
  Chemically synthesized
ccucaacuucaaugaccc

SEQ ID NO: 26221 - RNA, 18 nt, artificial
  Chemically synthesized
cugcaaggaccacuucag

SEQ ID NO: 26222 - RNA, 18 nt, artificial
  Chemically synthesized
ggccagcgcagaugccaa

SEQ ID NO: 26223 - RNA, 18 nt, artificial
  Chemically synthesized
ccagcgcagaugccaaca

SEQ ID NO: 26224 - RNA, 18 nt, artificial
  Chemically synthesized
gcacaccaacguggucuu

SEQ ID NO: 26225 - RNA, 18 nt, artificial
  Chemically synthesized
gggcaugcuggaggaccu

SEQ ID NO: 26226 - RNA, 18 nt, artificial
  Chemically synthesized
guacugcaaggaccacuu

SEQ ID NO: 26227 - RNA, 18 nt, artificial
  Chemically synthesized
acguggucuucaagcgug

SEQ ID NO: 26228 - RNA, 18 nt, artificial
  Chemically synthesized
cggccagcagaugaucuu

SEQ ID NO: 26229 - RNA, 18 nt, artificial
  Chemically synthesized
acagaaacacugccuuuu

SEQ ID NO: 26230 - RNA, 18 nt, artificial
  Chemically synthesized
ugugccacauccuggacu

SEQ ID NO: 26231 - RNA, 18 nt, artificial
  Chemically synthesized
gaccacaggacccaacug

SEQ ID NO: 26232 - RNA, 18 nt, artificial
  Chemically synthesized
cggcuucacgggcagcua

SEQ ID NO: 26233 - RNA, 18 nt, artificial
  Chemically synthesized
ggccagcagaugaucuuc

SEQ ID NO: 26234 - RNA, 18 nt, artificial
  Chemically synthesized
gcgugcugcacaccaacg

SEQ ID NO: 26235 - RNA, 18 nt, artificial
  Chemically synthesized
ccguggcacccagaacug

SEQ ID NO: 26236 - RNA, 18 nt, artificial
  Chemically synthesized
ccacuuccugcgggagcu

SEQ ID NO: 26237 - RNA, 18 nt, artificial
  Chemically synthesized
ccacauccuggacuacag

SEQ ID NO: 26238 - RNA, 18 nt, artificial
  Chemically synthesized
aacguggucuucaagcgu

SEQ ID NO: 26239 - RNA, 18 nt, artificial
  Chemically synthesized
aggugucuuccagauccu

SEQ ID NO: 26240 - RNA, 18 nt, artificial
  Chemically synthesized
cuucuacugcgagugucc

SEQ ID NO: 26241 - RNA, 18 nt, artificial
  Chemically synthesized
caguacugcaaggaccac

SEQ ID NO: 26242 - RNA, 18 nt, artificial
  Chemically synthesized
gcugcacaccaacguggu

SEQ ID NO: 26243 - RNA, 18 nt, artificial
  Chemically synthesized
cuguguggacggcgugaa

SEQ ID NO: 26244 - RNA, 18 nt, artificial
  Chemically synthesized
cgagugugccagcagccc

SEQ ID NO: 26245 - RNA, 18 nt, artificial
  Chemically synthesized
agacccagcaggugcagc

SEQ ID NO: 26246 - RNA, 18 nt, artificial
  Chemically synthesized
ccacauccuggacuacag

SEQ ID NO: 26247 - RNA, 18 nt, artificial
  Chemically synthesized
ugacaaccggcagugugu

SEQ ID NO: 26248 - RNA, 18 nt, artificial
  Chemically synthesized
gaccacuuugccaaccgg

SEQ ID NO: 26249 - RNA, 18 nt, artificial
  Chemically synthesized
aacugugacaucaacaac

SEQ ID NO: 26250 - RNA, 18 nt, artificial
  Chemically synthesized
aggccagcaagaagaagc

SEQ ID NO: 26251 - RNA, 18 nt, artificial
  Chemically synthesized
cugaccagugguccagcu

SEQ ID NO: 26252 - RNA, 18 nt, artificial
  Chemically synthesized
acccagcaggugcagcca

SEQ ID NO: 26253 - RNA, 18 nt, artificial
  Chemically synthesized
ggagggcaugcuggagga

SEQ ID NO: 26254 - RNA, 18 nt, artificial
  Chemically synthesized
cguggucuucaagcguga

SEQ ID NO: 26255 - RNA, 18 nt, artificial
  Chemically synthesized
gcuacacagggagcaugu

SEQ ID NO: 26256 - RNA, 18 nt, artificial
  Chemically synthesized
acuucaucuaccagggcg

SEQ ID NO: 26257 - RNA, 18 nt, artificial
  Chemically synthesized
ccugugagcccacauccg

SEQ ID NO: 26258 - RNA, 18 nt, artificial
  Chemically synthesized
ugguggacgagugcucac

SEQ ID NO: 26259 - RNA, 18 nt, artificial
  Chemically synthesized
gccuucugcgacugccug

SEQ ID NO: 26260 - RNA, 18 nt, artificial
  Chemically synthesized
ggccuucugcgacugccu

SEQ ID NO: 26261 - RNA, 18 nt, artificial
  Chemically synthesized
ccaguacugcaaggacca

SEQ ID NO: 26262 - RNA, 18 nt, artificial
  Chemically synthesized
ccagcucugguucccuga

SEQ ID NO: 26263 - RNA, 18 nt, artificial
  Chemically synthesized
gcauggccagcucugguu

SEQ ID NO: 26264 - RNA, 18 nt, artificial
  Chemically synthesized
acauccuggacuacagcu

SEQ ID NO: 26265 - RNA, 18 nt, artificial
  Chemically synthesized
cacccacgagugugccug

SEQ ID NO: 26266 - RNA, 18 nt, artificial
  Chemically synthesized
gaggccagcaagaagaag

SEQ ID NO: 26267 - RNA, 18 nt, artificial
  Chemically synthesized
gugcagacccagcaggug

SEQ ID NO: 26268 - RNA, 18 nt, artificial
  Chemically synthesized
gcugcugucccgcaagcg

SEQ ID NO: 26269 - RNA, 18 nt, artificial
  Chemically synthesized
cgccaaauucaacgggcu

SEQ ID NO: 26270 - RNA, 18 nt, artificial
  Chemically synthesized
gcagcauggccagcucug

SEQ ID NO: 26271 - RNA, 18 nt, artificial
  Chemically synthesized
guacaaccuggugcgcag

SEQ ID NO: 26272 - RNA, 18 nt, artificial
  Chemically synthesized
ggagaccaagaaguuccg

SEQ ID NO: 26273 - RNA, 18 nt, artificial
  Chemically synthesized
caacguggucuucaagcg

SEQ ID NO: 26274 - RNA, 18 nt, artificial
  Chemically synthesized
ggccugcagccaggacgu

SEQ ID NO: 26275 - RNA, 18 nt, artificial
  Chemically synthesized
cgacuucaucuaccaggg

SEQ ID NO: 26276 - RNA, 18 nt, artificial
  Chemically synthesized
guggagggcaugcuggag

SEQ ID NO: 26277 - RNA, 18 nt, artificial
  Chemically synthesized
cccugaccagugguccag

SEQ ID NO: 26278 - RNA, 18 nt, artificial
  Chemically synthesized
agccaggacguggaugag

SEQ ID NO: 26279 - RNA, 18 nt, artificial
  Chemically synthesized
auccuggacuacagcuuc

SEQ ID NO: 26280 - RNA, 18 nt, artificial
  Chemically synthesized
agcucugguucccugagg

SEQ ID NO: 26281 - RNA, 18 nt, artificial
  Chemically synthesized
gacaugaccaguggcuac

SEQ ID NO: 26282 - RNA, 18 nt, artificial
  Chemically synthesized
guacaaccuggugcgcag

SEQ ID NO: 26283 - RNA, 18 nt, artificial
  Chemically synthesized
guggccagugccugcccu

SEQ ID NO: 26284 - RNA, 18 nt, artificial
  Chemically synthesized
gcagacccagcaggugca

SEQ ID NO: 26285 - RNA, 18 nt, artificial
  Chemically synthesized
caacugccagaaccuugu

SEQ ID NO: 26286 - RNA, 18 nt, artificial
  Chemically synthesized
uggagggcucugugugga

SEQ ID NO: 26287 - RNA, 18 nt, artificial
  Chemically synthesized
agcgcagaugccaacauc

SEQ ID NO: 26288 - RNA, 18 nt, artificial
  Chemically synthesized
ugugcuccugaagaacgg

SEQ ID NO: 26289 - RNA, 18 nt, artificial
  Chemically synthesized
ccagcagaugaucuuccc

SEQ ID NO: 26290 - RNA, 18 nt, artificial
  Chemically synthesized
augacuuccacugcgagu

SEQ ID NO: 26291 - RNA, 18 nt, artificial
  Chemically synthesized
ggccagcaagaagaagcg

SEQ ID NO: 26292 - RNA, 18 nt, artificial
  Chemically synthesized
ccacuuugccaaccggga

SEQ ID NO: 26293 - RNA, 18 nt, artificial
  Chemically synthesized
ccaacccuugugucaacg

SEQ ID NO: 26294 - RNA, 18 nt, artificial
  Chemically synthesized
ucaccuggugcagaccca

SEQ ID NO: 26295 - RNA, 18 nt, artificial
  Chemically synthesized
ugacugcucccucaacuu

SEQ ID NO: 26296 - RNA, 18 nt, artificial
  Chemically synthesized
acaugaccaguggcuacg

SEQ ID NO: 26297 - RNA, 18 nt, artificial
  Chemically synthesized
ugacagccagugcaacuc

SEQ ID NO: 26298 - RNA, 18 nt, artificial
  Chemically synthesized
cuggacuggugaggacug

SEQ ID NO: 26299 - RNA, 18 nt, artificial
  Chemically synthesized
gccagcaagaagaagcgg

SEQ ID NO: 26300 - RNA, 18 nt, artificial
  Chemically synthesized
caccuacaagugcuccug

SEQ ID NO: 26301 - RNA, 18 nt, artificial
  Chemically synthesized
uugccaaccgggacauca

SEQ ID NO: 26302 - RNA, 18 nt, artificial
  Chemically synthesized
ccaggacguggaugagug

SEQ ID NO: 26303 - RNA, 18 nt, artificial
  Chemically synthesized
gguggccagugccugccc

SEQ ID NO: 26304 - RNA, 18 nt, artificial
  Chemically synthesized
gugccacauccuggacua

SEQ ID NO: 26305 - RNA, 18 nt, artificial
  Chemically synthesized
ucaucuccgacuucaucu

SEQ ID NO: 26306 - RNA, 18 nt, artificial
  Chemically synthesized
ugacuuccacugcgagug

SEQ ID NO: 26307 - RNA, 18 nt, artificial
  Chemically synthesized
ugccugccugccaggcuu

SEQ ID NO: 26308 - RNA, 18 nt, artificial
  Chemically synthesized
caaccgggacaucacgga

SEQ ID NO: 26309 - RNA, 18 nt, artificial
  Chemically synthesized
cuacacagggagcaugug

SEQ ID NO: 26310 - RNA, 18 nt, artificial
  Chemically synthesized
uggccagugccugcccuu

SEQ ID NO: 26311 - RNA, 18 nt, artificial
  Chemically synthesized
gcauggccagcucugguu

SEQ ID NO: 26312 - RNA, 18 nt, artificial
  Chemically synthesized
accugugagcccacaucc

SEQ ID NO: 26313 - RNA, 18 nt, artificial
  Chemically synthesized
cuuccugcgggagcucag

SEQ ID NO: 26314 - RNA, 18 nt, artificial
  Chemically synthesized
gcuucacgggcagcuacu

SEQ ID NO: 26315 - RNA, 18 nt, artificial
  Chemically synthesized
agcauggccagcucuggu

SEQ ID NO: 26316 - RNA, 18 nt, artificial
  Chemically synthesized
gacuuccacugcgagugc

SEQ ID NO: 26317 - RNA, 18 nt, artificial
  Chemically synthesized
gcacugcgagguggacau

SEQ ID NO: 26318 - RNA, 18 nt, artificial
  Chemically synthesized
gccagcucugguucccug

SEQ ID NO: 26319 - RNA, 18 nt, artificial
  Chemically synthesized
cagccaggacguggauga

SEQ ID NO: 26320 - RNA, 18 nt, artificial
  Chemically synthesized
accaguacugcaaggacc

SEQ ID NO: 26321 - RNA, 18 nt, artificial
  Chemically synthesized
cagcucugguucccugag

SEQ ID NO: 26322 - RNA, 18 nt, artificial
  Chemically synthesized
gccaaccgggacaucacg

SEQ ID NO: 26323 - RNA, 18 nt, artificial
  Chemically synthesized
agcgccggcggcagcaug

SEQ ID NO: 26324 - RNA, 18 nt, artificial
  Chemically synthesized
cuuccugcgggagcucag

SEQ ID NO: 26325 - RNA, 18 nt, artificial
  Chemically synthesized
ugccaacauccaggacaa

SEQ ID NO: 26326 - RNA, 18 nt, artificial
  Chemically synthesized
caaccuggugcgcagccc

SEQ ID NO: 26327 - RNA, 18 nt, artificial
  Chemically synthesized
gccugcagccaggacgug

SEQ ID NO: 26328 - RNA, 18 nt, artificial
  Chemically synthesized
gcacaccaacguggucuu

SEQ ID NO: 26329 - RNA, 18 nt, artificial
  Chemically synthesized
caggaaacaacugcaaga

SEQ ID NO: 26330 - RNA, 18 nt, artificial
  Chemically synthesized
gugcugcugucccgcaag

SEQ ID NO: 26331 - RNA, 18 nt, artificial
  Chemically synthesized
gaguacaagugccgcugc

SEQ ID NO: 26332 - RNA, 18 nt, artificial
  Chemically synthesized
accaacguggucuucaag

SEQ ID NO: 26333 - RNA, 18 nt, artificial
  Chemically synthesized
cuucaucuaccagggcgc

SEQ ID NO: 26334 - RNA, 18 nt, artificial
  Chemically synthesized
gggugccuguguggacgg

SEQ ID NO: 26335 - RNA, 18 nt, artificial
  Chemically synthesized
uugugcuccugaagaacg

SEQ ID NO: 26336 - RNA, 18 nt, artificial
  Chemically synthesized
uggcacccagaacugcgu

SEQ ID NO: 26337 - RNA, 18 nt, artificial
  Chemically synthesized
acaccuacaagugcuccu

SEQ ID NO: 26338 - RNA, 18 nt, artificial
  Chemically synthesized
ccacuuccugcgggagcu

SEQ ID NO: 26339 - RNA, 18 nt, artificial
  Chemically synthesized
ccugcagccaggacgugg

SEQ ID NO: 26340 - RNA, 18 nt, artificial
  Chemically synthesized
ugugagcccacauccgag

SEQ ID NO: 26341 - RNA, 18 nt, artificial
  Chemically synthesized
gugccuguguggacggcg

SEQ ID NO: 26342 - RNA, 18 nt, artificial
  Chemically synthesized
cugcagccaggacgugga

SEQ ID NO: 26343 - RNA, 18 nt, artificial
  Chemically synthesized
agcucugguucccugagg

SEQ ID NO: 26344 - RNA, 18 nt, artificial
  Chemically synthesized
gugcugcacaccaacgug

SEQ ID NO: 26345 - RNA, 18 nt, artificial
  Chemically synthesized
ugacaaccggcagugugu

SEQ ID NO: 26346 - RNA, 18 nt, artificial
  Chemically synthesized
ucccucaacuucaaugac

SEQ ID NO: 26347 - RNA, 18 nt, artificial
  Chemically synthesized
cgacuucaucuaccaggg

SEQ ID NO: 26348 - RNA, 18 nt, artificial
  Chemically synthesized
aaccgggacaucacggau

SEQ ID NO: 26349 - RNA, 18 nt, artificial
  Chemically synthesized
ugaccagugguccagcuc

SEQ ID NO: 26350 - RNA, 18 nt, artificial
  Chemically synthesized
cugaccagugguccagcu

SEQ ID NO: 26351 - RNA, 18 nt, artificial
  Chemically synthesized
cauccaggacaacauggg

SEQ ID NO: 26352 - RNA, 18 nt, artificial
  Chemically synthesized
ugcuggaccacuuugcca

SEQ ID NO: 26353 - RNA, 18 nt, artificial
  Chemically synthesized
ggccuucugcgacugccu

SEQ ID NO: 26354 - RNA, 18 nt, artificial
  Chemically synthesized
ugccaaccgggacaucac

SEQ ID NO: 26355 - RNA, 18 nt, artificial
  Chemically synthesized
cugcugucccgcaagcgc

SEQ ID NO: 26356 - RNA, 18 nt, artificial
  Chemically synthesized
gcgcagaugccaacaucc

SEQ ID NO: 26357 - RNA, 18 nt, artificial
  Chemically synthesized
ccucaacuucaaugaccc

SEQ ID NO: 26358 - RNA, 18 nt, artificial
  Chemically synthesized
cguggagggcaugcugga

SEQ ID NO: 26359 - RNA, 18 nt, artificial
  Chemically synthesized
ucaucuaccagggcgcca

SEQ ID NO: 26360 - RNA, 18 nt, artificial
  Chemically synthesized
cauggccagcucugguuc

SEQ ID NO: 26361 - RNA, 18 nt, artificial
  Chemically synthesized
ugcugcacaccaacgugg

SEQ ID NO: 26362 - RNA, 18 nt, artificial
  Chemically synthesized
ggccaucugcaccugccc

SEQ ID NO: 26363 - RNA, 18 nt, artificial
  Chemically synthesized
gaccacaggacccaacug

SEQ ID NO: 26364 - RNA, 18 nt, artificial
  Chemically synthesized
cggcagcauggccagcuc

SEQ ID NO: 26365 - RNA, 18 nt, artificial
  Chemically synthesized
ugcagacccagcaggugc

SEQ ID NO: 26366 - RNA, 18 nt, artificial
  Chemically synthesized
gugcccugcgggcuucga

SEQ ID NO: 26367 - RNA, 18 nt, artificial
  Chemically synthesized
ggccugcagccaggacgu

SEQ ID NO: 26368 - RNA, 18 nt, artificial
  Chemically synthesized
cgacugccugcccggcuu

SEQ ID NO: 26369 - RNA, 18 nt, artificial
  Chemically synthesized
acuuccugcgggagcuca

SEQ ID NO: 26370 - RNA, 18 nt, artificial
  Chemically synthesized
caagcgccggcggcagca

SEQ ID NO: 26371 - RNA, 18 nt, artificial
  Chemically synthesized
aggcagcuacugugagga

SEQ ID NO: 26372 - RNA, 18 nt, artificial
  Chemically synthesized
cacauccuggacuacagc

SEQ ID NO: 26373 - RNA, 18 nt, artificial
  Chemically synthesized
cgagugugccagcagccc

SEQ ID NO: 26374 - RNA, 18 nt, artificial
  Chemically synthesized
acauugaugacugugcca

SEQ ID NO: 26375 - RNA, 18 nt, artificial
  Chemically synthesized
accgggacaucacggauc

SEQ ID NO: 26376 - RNA, 18 nt, artificial
  Chemically synthesized
agacccagcaggugcagc

SEQ ID NO: 26377 - RNA, 18 nt, artificial
  Chemically synthesized
ugcccugcgggcuucgag

SEQ ID NO: 26378 - RNA, 18 nt, artificial
  Chemically synthesized
ggcggcagcauggccagc

SEQ ID NO: 26379 - RNA, 18 nt, artificial
  Chemically synthesized
gcucugguucccugaggg

SEQ ID NO: 26380 - RNA, 18 nt, artificial
  Chemically synthesized
gccuucugcgacugccug

SEQ ID NO: 26381 - RNA, 18 nt, artificial
  Chemically synthesized
cuuccacugcgagugccg

SEQ ID NO: 26382 - RNA, 18 nt, artificial
  Chemically synthesized
uggugcagacccagcagg

SEQ ID NO: 26383 - RNA, 18 nt, artificial
  Chemically synthesized
aggccagcaagaagaagc

SEQ ID NO: 26384 - RNA, 18 nt, artificial
  Chemically synthesized
uaacgagggcuccaacug

SEQ ID NO: 26385 - RNA, 18 nt, artificial
  Chemically synthesized
gcccugcgggcuucgagg

SEQ ID NO: 26386 - RNA, 18 nt, artificial
  Chemically synthesized
acauccaggacaacaugg

SEQ ID NO: 26387 - RNA, 18 nt, artificial
  Chemically synthesized
cuuugccaaccgggacau

SEQ ID NO: 26388 - RNA, 18 nt, artificial
  Chemically synthesized
gcugcugucccgcaagcg

SEQ ID NO: 26389 - RNA, 18 nt, artificial
  Chemically synthesized
gcagcauggccagcucug

SEQ ID NO: 26390 - RNA, 18 nt, artificial
  Chemically synthesized
ugguggacgagugcucac

SEQ ID NO: 26391 - RNA, 18 nt, artificial
  Chemically synthesized
uccaggaaacaacugcaa

SEQ ID NO: 26392 - RNA, 18 nt, artificial
  Chemically synthesized
gccaacauccaggacaac

SEQ ID NO: 26393 - RNA, 18 nt, artificial
  Chemically synthesized
ugccugccugccaggcuu

SEQ ID NO: 26394 - RNA, 18 nt, artificial
  Chemically synthesized
ucugugaggaggacauca

SEQ ID NO: 26395 - RNA, 18 nt, artificial
  Chemically synthesized
guggagggcaugcuggag

SEQ ID NO: 26396 - RNA, 18 nt, artificial
  Chemically synthesized
uggccagugccugcccuu

SEQ ID NO: 26397 - RNA, 18 nt, artificial
  Chemically synthesized
uggcuacaacugcgugug

SEQ ID NO: 26398 - RNA, 18 nt, artificial
  Chemically synthesized
acccagcaggugcagcca

SEQ ID NO: 26399 - RNA, 18 nt, artificial
  Chemically synthesized
ccuucugcgacugccugc

SEQ ID NO: 26400 - RNA, 18 nt, artificial
  Chemically synthesized
ggagggcaugcuggagga

SEQ ID NO: 26401 - RNA, 18 nt, artificial
  Chemically synthesized
cugccuggaccagauugg

SEQ ID NO: 26402 - RNA, 18 nt, artificial
  Chemically synthesized
aaugacuuccacugcgag

SEQ ID NO: 26403 - RNA, 18 nt, artificial
  Chemically synthesized
ggccagcaagaagaagcg

SEQ ID NO: 26404 - RNA, 18 nt, artificial
  Chemically synthesized
gagggcaugcuggaggac

SEQ ID NO: 26405 - RNA, 18 nt, artificial
  Chemically synthesized
ccaacccuugugucaacg

SEQ ID NO: 26406 - RNA, 18 nt, artificial
  Chemically synthesized
cuggaccacuuugccaac

SEQ ID NO: 26407 - RNA, 18 nt, artificial
  Chemically synthesized
acuuccacugcgagugcc

SEQ ID NO: 26408 - RNA, 18 nt, artificial
  Chemically synthesized
cuggacuggugaggacug

SEQ ID NO: 26409 - RNA, 18 nt, artificial
  Chemically synthesized
caccuacaagugcuccug

SEQ ID NO: 26410 - RNA, 18 nt, artificial
  Chemically synthesized
ccagcagaugaucuuccc

SEQ ID NO: 26411 - RNA, 18 nt, artificial
  Chemically synthesized
ugcugucccgcaagcgcc

SEQ ID NO: 26412 - RNA, 18 nt, artificial
  Chemically synthesized
cauccaggacaacauggg

SEQ ID NO: 26413 - RNA, 18 nt, artificial
  Chemically synthesized
cagcauggccagcucugg

SEQ ID NO: 26414 - RNA, 18 nt, artificial
  Chemically synthesized
ccuguguggacggcguga

SEQ ID NO: 26415 - RNA, 18 nt, artificial
  Chemically synthesized
uggcacccagaacugcgu

SEQ ID NO: 26416 - RNA, 18 nt, artificial
  Chemically synthesized
acaccuacaagugcuccu

SEQ ID NO: 26417 - RNA, 18 nt, artificial
  Chemically synthesized
ugacuuccacugcgagug

SEQ ID NO: 26418 - RNA, 18 nt, artificial
  Chemically synthesized
uggaccacuuugccaacc

SEQ ID NO: 26419 - RNA, 18 nt, artificial
  Chemically synthesized
gacccagcaggugcagcc

SEQ ID NO: 26420 - RNA, 18 nt, artificial
  Chemically synthesized
guacaagugccgcugccc

SEQ ID NO: 26421 - RNA, 18 nt, artificial
  Chemically synthesized
cugcacaccaacgugguc

SEQ ID NO: 26422 - RNA, 18 nt, artificial
  Chemically synthesized
gcagacccagcaggugca

SEQ ID NO: 26423 - RNA, 18 nt, artificial
  Chemically synthesized
uggagggcucugugugga

SEQ ID NO: 26424 - RNA, 18 nt, artificial
  Chemically synthesized
acaaccuggugcgcagcc

SEQ ID NO: 26425 - RNA, 18 nt, artificial
  Chemically synthesized
guggccuccaacaccgcc

SEQ ID NO: 26426 - RNA, 18 nt, artificial
  Chemically synthesized
aaccgggacaucacggau

SEQ ID NO: 26427 - RNA, 18 nt, artificial
  Chemically synthesized
uccugcgggagcucagcc

SEQ ID NO: 26428 - RNA, 18 nt, artificial
  Chemically synthesized
gccaaccgggacaucacg

SEQ ID NO: 26429 - RNA, 18 nt, artificial
  Chemically synthesized
agcgccggcggcagcaug

SEQ ID NO: 26430 - RNA, 18 nt, artificial
  Chemically synthesized
uggagggcaugcuggagg

SEQ ID NO: 26431 - RNA, 18 nt, artificial
  Chemically synthesized
cugucccgcaagcgccgg

SEQ ID NO: 26432 - RNA, 18 nt, artificial
  Chemically synthesized
ucaccuggugcagaccca

SEQ ID NO: 26433 - RNA, 18 nt, artificial
  Chemically synthesized
cacuuugccaaccgggac

SEQ ID NO: 26434 - RNA, 18 nt, artificial
  Chemically synthesized
agaugccaacauccagga

SEQ ID NO: 26435 - RNA, 18 nt, artificial
  Chemically synthesized
gccugcagccaggacgug

SEQ ID NO: 26436 - RNA, 18 nt, artificial
  Chemically synthesized
caaggaccucaaggcacg

SEQ ID NO: 26437 - RNA, 18 nt, artificial
  Chemically synthesized
cagacccagcaggugcag

SEQ ID NO: 26438 - RNA, 18 nt, artificial
  Chemically synthesized
gcacugcgaccagggcug

SEQ ID NO: 26439 - RNA, 18 nt, artificial
  Chemically synthesized
aguagcugcccgugaagc

SEQ ID NO: 26440 - RNA, 18 nt, artificial
  Chemically synthesized
cugaagugguccuugcag

SEQ ID NO: 26441 - RNA, 18 nt, artificial
  Chemically synthesized
cauccacguccuggcugc

SEQ ID NO: 26442 - RNA, 18 nt, artificial
  Chemically synthesized
cacguuggugugcagcac

SEQ ID NO: 26443 - RNA, 18 nt, artificial
  Chemically synthesized
auguccaccucgcagugc

SEQ ID NO: 26444 - RNA, 18 nt, artificial
  Chemically synthesized
uccucacaguagcugccu

SEQ ID NO: 26445 - RNA, 18 nt, artificial
  Chemically synthesized
uguccuggauguuggcau

SEQ ID NO: 26446 - RNA, 18 nt, artificial
  Chemically synthesized
auugacguccaugcaguc

SEQ ID NO: 26447 - RNA, 18 nt, artificial
  Chemically synthesized
gcgcuugcgggacagcag

SEQ ID NO: 26448 - RNA, 18 nt, artificial
  Chemically synthesized
gggucauugaaguugagg

SEQ ID NO: 26449 - RNA, 18 nt, artificial
  Chemically synthesized
cugaagugguccuugcag

SEQ ID NO: 26450 - RNA, 18 nt, artificial
  Chemically synthesized
uuggcaucugcgcuggcc

SEQ ID NO: 26451 - RNA, 18 nt, artificial
  Chemically synthesized
uguuggcaucugcgcugg

SEQ ID NO: 26452 - RNA, 18 nt, artificial
  Chemically synthesized
aagaccacguuggugugc

SEQ ID NO: 26453 - RNA, 18 nt, artificial
  Chemically synthesized
agguccuccagcaugccc

SEQ ID NO: 26454 - RNA, 18 nt, artificial
  Chemically synthesized
aagugguccuugcaguac

SEQ ID NO: 26455 - RNA, 18 nt, artificial
  Chemically synthesized
cacgcuugaagaccacgu

SEQ ID NO: 26456 - RNA, 18 nt, artificial
  Chemically synthesized
aagaucaucugcuggccg

SEQ ID NO: 26457 - RNA, 18 nt, artificial
  Chemically synthesized
aaaaggcaguguuucugu

SEQ ID NO: 26458 - RNA, 18 nt, artificial
  Chemically synthesized
aguccaggauguggcaca

SEQ ID NO: 26459 - RNA, 18 nt, artificial
  Chemically synthesized
caguuggguccugugguc

SEQ ID NO: 26460 - RNA, 18 nt, artificial
  Chemically synthesized
uagcugcccgugaagccg

SEQ ID NO: 26461 - RNA, 18 nt, artificial
  Chemically synthesized
gaagaucaucugcuggcc

SEQ ID NO: 26462 - RNA, 18 nt, artificial
  Chemically synthesized
cguuggugugcagcacgc

SEQ ID NO: 26463 - RNA, 18 nt, artificial
  Chemically synthesized
caguucugggugccacgg

SEQ ID NO: 26464 - RNA, 18 nt, artificial
  Chemically synthesized
agcucccgcaggaagugg

SEQ ID NO: 26465 - RNA, 18 nt, artificial
  Chemically synthesized
cuguaguccaggaugugg

SEQ ID NO: 26466 - RNA, 18 nt, artificial
  Chemically synthesized
acgcuugaagaccacguu

SEQ ID NO: 26467 - RNA, 18 nt, artificial
  Chemically synthesized
aggaucuggaagacaccu

SEQ ID NO: 26468 - RNA, 18 nt, artificial
  Chemically synthesized
ggacacucgcaguagaag

SEQ ID NO: 26469 - RNA, 18 nt, artificial
  Chemically synthesized
gugguccuugcaguacug

SEQ ID NO: 26470 - RNA, 18 nt, artificial
  Chemically synthesized
accacguuggugugcagc

SEQ ID NO: 26471 - RNA, 18 nt, artificial
  Chemically synthesized
uucacgccguccacacag

SEQ ID NO: 26472 - RNA, 18 nt, artificial
  Chemically synthesized
gggcugcuggcacacucg

SEQ ID NO: 26473 - RNA, 18 nt, artificial
  Chemically synthesized
gcugcaccugcugggucu

SEQ ID NO: 26474 - RNA, 18 nt, artificial
  Chemically synthesized
cuguaguccaggaugugg

SEQ ID NO: 26475 - RNA, 18 nt, artificial
  Chemically synthesized
acacacugccgguuguca

SEQ ID NO: 26476 - RNA, 18 nt, artificial
  Chemically synthesized
ccgguuggcaaagugguc

SEQ ID NO: 26477 - RNA, 18 nt, artificial
  Chemically synthesized
guuguugaugucacaguu

SEQ ID NO: 26478 - RNA, 18 nt, artificial
  Chemically synthesized
gcuucuucuugcuggccu

SEQ ID NO: 26479 - RNA, 18 nt, artificial
  Chemically synthesized
agcuggaccacuggucag

SEQ ID NO: 26480 - RNA, 18 nt, artificial
  Chemically synthesized
uggcugcaccugcugggu

SEQ ID NO: 26481 - RNA, 18 nt, artificial
  Chemically synthesized
uccuccagcaugcccucc

SEQ ID NO: 26482 - RNA, 18 nt, artificial
  Chemically synthesized
ucacgcuugaagaccacg

SEQ ID NO: 26483 - RNA, 18 nt, artificial
  Chemically synthesized
acaugcucccuguguagc

SEQ ID NO: 26484 - RNA, 18 nt, artificial
  Chemically synthesized
cgcccugguagaugaagu

SEQ ID NO: 26485 - RNA, 18 nt, artificial
  Chemically synthesized
cggaugugggcucacagg

SEQ ID NO: 26486 - RNA, 18 nt, artificial
  Chemically synthesized
gugagcacucguccacca

SEQ ID NO: 26487 - RNA, 18 nt, artificial
  Chemically synthesized
caggcagucgcagaaggc

SEQ ID NO: 26488 - RNA, 18 nt, artificial
  Chemically synthesized
aggcagucgcagaaggcc

SEQ ID NO: 26489 - RNA, 18 nt, artificial
  Chemically synthesized
ugguccuugcaguacugg

SEQ ID NO: 26490 - RNA, 18 nt, artificial
  Chemically synthesized
ucagggaaccagagcugg

SEQ ID NO: 26491 - RNA, 18 nt, artificial
  Chemically synthesized
aaccagagcuggccaugc

SEQ ID NO: 26492 - RNA, 18 nt, artificial
  Chemically synthesized
agcuguaguccaggaugu

SEQ ID NO: 26493 - RNA, 18 nt, artificial
  Chemically synthesized
caggcacacucgugggug

SEQ ID NO: 26494 - RNA, 18 nt, artificial
  Chemically synthesized
cuucuucuugcuggccuc

SEQ ID NO: 26495 - RNA, 18 nt, artificial
  Chemically synthesized
caccugcugggucugcac

SEQ ID NO: 26496 - RNA, 18 nt, artificial
  Chemically synthesized
cgcuugcgggacagcagc

SEQ ID NO: 26497 - RNA, 18 nt, artificial
  Chemically synthesized
agcccguugaauuuggcg

SEQ ID NO: 26498 - RNA, 18 nt, artificial
  Chemically synthesized
cagagcuggccaugcugc

SEQ ID NO: 26499 - RNA, 18 nt, artificial
  Chemically synthesized
cugcgcaccagguuguac

SEQ ID NO: 26500 - RNA, 18 nt, artificial
  Chemically synthesized
cggaacuucuuggucucc

SEQ ID NO: 26501 - RNA, 18 nt, artificial
  Chemically synthesized
cgcuugaagaccacguug

SEQ ID NO: 26502 - RNA, 18 nt, artificial
  Chemically synthesized
acguccuggcugcaggcc

SEQ ID NO: 26503 - RNA, 18 nt, artificial
  Chemically synthesized
cccugguagaugaagucg

SEQ ID NO: 26504 - RNA, 18 nt, artificial
  Chemically synthesized
cuccagcaugcccuccac

SEQ ID NO: 26505 - RNA, 18 nt, artificial
  Chemically synthesized
cuggaccacuggucaggg

SEQ ID NO: 26506 - RNA, 18 nt, artificial
  Chemically synthesized
cucauccacguccuggcu

SEQ ID NO: 26507 - RNA, 18 nt, artificial
  Chemically synthesized
gaagcuguaguccaggau

SEQ ID NO: 26508 - RNA, 18 nt, artificial
  Chemically synthesized
ccucagggaaccagagcu

SEQ ID NO: 26509 - RNA, 18 nt, artificial
  Chemically synthesized
guagccacuggucauguc

SEQ ID NO: 26510 - RNA, 18 nt, artificial
  Chemically synthesized
cugcgcaccagguuguac

SEQ ID NO: 26511 - RNA, 18 nt, artificial
  Chemically synthesized
agggcaggcacuggccac

SEQ ID NO: 26512 - RNA, 18 nt, artificial
  Chemically synthesized
ugcaccugcugggucugc

SEQ ID NO: 26513 - RNA, 18 nt, artificial
  Chemically synthesized
acaagguucuggcaguug

SEQ ID NO: 26514 - RNA, 18 nt, artificial
  Chemically synthesized
uccacacagagcccucca

SEQ ID NO: 26515 - RNA, 18 nt, artificial
  Chemically synthesized
gauguuggcaucugcgcu

SEQ ID NO: 26516 - RNA, 18 nt, artificial
  Chemically synthesized
ccguucuucaggagcaca

SEQ ID NO: 26517 - RNA, 18 nt, artificial
  Chemically synthesized
gggaagaucaucugcugg

SEQ ID NO: 26518 - RNA, 18 nt, artificial
  Chemically synthesized
acucgcaguggaagucau

SEQ ID NO: 26519 - RNA, 18 nt, artificial
  Chemically synthesized
cgcuucuucuugcuggcc

SEQ ID NO: 26520 - RNA, 18 nt, artificial
  Chemically synthesized
ucccgguuggcaaagugg

SEQ ID NO: 26521 - RNA, 18 nt, artificial
  Chemically synthesized
cguugacacaaggguugg

SEQ ID NO: 26522 - RNA, 18 nt, artificial
  Chemically synthesized
ugggucugcaccagguga

SEQ ID NO: 26523 - RNA, 18 nt, artificial
  Chemically synthesized
aaguugagggagcaguca

SEQ ID NO: 26524 - RNA, 18 nt, artificial
  Chemically synthesized
cguagccacuggucaugu

SEQ ID NO: 26525 - RNA, 18 nt, artificial
  Chemically synthesized
gaguugcacuggcuguca

SEQ ID NO: 26526 - RNA, 18 nt, artificial
  Chemically synthesized
caguccucaccaguccag

SEQ ID NO: 26527 - RNA, 18 nt, artificial
  Chemically synthesized
ccgcuucuucuugcuggc

SEQ ID NO: 26528 - RNA, 18 nt, artificial
  Chemically synthesized
caggagcacuuguaggug

SEQ ID NO: 26529 - RNA, 18 nt, artificial
  Chemically synthesized
ugaugucccgguuggcaa

SEQ ID NO: 26530 - RNA, 18 nt, artificial
  Chemically synthesized
cacucauccacguccugg

SEQ ID NO: 26531 - RNA, 18 nt, artificial
  Chemically synthesized
gggcaggcacuggccacc

SEQ ID NO: 26532 - RNA, 18 nt, artificial
  Chemically synthesized
uaguccaggauguggcac

SEQ ID NO: 26533 - RNA, 18 nt, artificial
  Chemically synthesized
agaugaagucggagauga

SEQ ID NO: 26534 - RNA, 18 nt, artificial
  Chemically synthesized
cacucgcaguggaaguca

SEQ ID NO: 26535 - RNA, 18 nt, artificial
  Chemically synthesized
aagccuggcaggcaggca

SEQ ID NO: 26536 - RNA, 18 nt, artificial
  Chemically synthesized
uccgugaugucccgguug

SEQ ID NO: 26537 - RNA, 18 nt, artificial
  Chemically synthesized
cacaugcucccuguguag

SEQ ID NO: 26538 - RNA, 18 nt, artificial
  Chemically synthesized
aagggcaggcacuggcca

SEQ ID NO: 26539 - RNA, 18 nt, artificial
  Chemically synthesized
aaccagagcuggccaugc

SEQ ID NO: 26540 - RNA, 18 nt, artificial
  Chemically synthesized
ggaugugggcucacaggu

SEQ ID NO: 26541 - RNA, 18 nt, artificial
  Chemically synthesized
cugagcucccgcaggaag

SEQ ID NO: 26542 - RNA, 18 nt, artificial
  Chemically synthesized
aguagcugcccgugaagc

SEQ ID NO: 26543 - RNA, 18 nt, artificial
  Chemically synthesized
accagagcuggccaugcu

SEQ ID NO: 26544 - RNA, 18 nt, artificial
  Chemically synthesized
gcacucgcaguggaaguc

SEQ ID NO: 26545 - RNA, 18 nt, artificial
  Chemically synthesized
auguccaccucgcagugc

SEQ ID NO: 26546 - RNA, 18 nt, artificial
  Chemically synthesized
cagggaaccagagcuggc

SEQ ID NO: 26547 - RNA, 18 nt, artificial
  Chemically synthesized
ucauccacguccuggcug

SEQ ID NO: 26548 - RNA, 18 nt, artificial
  Chemically synthesized
gguccuugcaguacuggu

SEQ ID NO: 26549 - RNA, 18 nt, artificial
  Chemically synthesized
cucagggaaccagagcug

SEQ ID NO: 26550 - RNA, 18 nt, artificial
  Chemically synthesized
cgugaugucccgguuggc

SEQ ID NO: 26551 - RNA, 18 nt, artificial
  Chemically synthesized
caugcugccgccggcgcu

SEQ ID NO: 26552 - RNA, 18 nt, artificial
  Chemically synthesized
cugagcucccgcaggaag

SEQ ID NO: 26553 - RNA, 18 nt, artificial
  Chemically synthesized
uuguccuggauguuggca

SEQ ID NO: 26554 - RNA, 18 nt, artificial
  Chemically synthesized
gggcugcgcaccagguug

SEQ ID NO: 26555 - RNA, 18 nt, artificial
  Chemically synthesized
cacguccuggcugcaggc

SEQ ID NO: 26556 - RNA, 18 nt, artificial
  Chemically synthesized
aagaccacguuggugugc

SEQ ID NO: 26557 - RNA, 18 nt, artificial
  Chemically synthesized
ucuugcaguuguuuccug

SEQ ID NO: 26558 - RNA, 18 nt, artificial
  Chemically synthesized
cuugcgggacagcagcac

SEQ ID NO: 26559 - RNA, 18 nt, artificial
  Chemically synthesized
gcagcggcacuuguacuc

SEQ ID NO: 26560 - RNA, 18 nt, artificial
  Chemically synthesized
cuugaagaccacguuggu

SEQ ID NO: 26561 - RNA, 18 nt, artificial
  Chemically synthesized
gcgcccugguagaugaag

SEQ ID NO: 26562 - RNA, 18 nt, artificial
  Chemically synthesized
ccguccacacaggcaccc

SEQ ID NO: 26563 - RNA, 18 nt, artificial
  Chemically synthesized
cguucuucaggagcacaa

SEQ ID NO: 26564 - RNA, 18 nt, artificial
  Chemically synthesized
acgcaguucugggugcca

SEQ ID NO: 26565 - RNA, 18 nt, artificial
  Chemically synthesized
aggagcacuuguaggugu

SEQ ID NO: 26566 - RNA, 18 nt, artificial
  Chemically synthesized
agcucccgcaggaagugg

SEQ ID NO: 26567 - RNA, 18 nt, artificial
  Chemically synthesized
ccacguccuggcugcagg

SEQ ID NO: 26568 - RNA, 18 nt, artificial
  Chemically synthesized
cucggaugugggcucaca

SEQ ID NO: 26569 - RNA, 18 nt, artificial
  Chemically synthesized
cgccguccacacaggcac

SEQ ID NO: 26570 - RNA, 18 nt, artificial
  Chemically synthesized
uccacguccuggcugcag

SEQ ID NO: 26571 - RNA, 18 nt, artificial
  Chemically synthesized
ccucagggaaccagagcu

SEQ ID NO: 26572 - RNA, 18 nt, artificial
  Chemically synthesized
cacguuggugugcagcac

SEQ ID NO: 26573 - RNA, 18 nt, artificial
  Chemically synthesized
acacacugccgguuguca

SEQ ID NO: 26574 - RNA, 18 nt, artificial
  Chemically synthesized
gucauugaaguugaggga

SEQ ID NO: 26575 - RNA, 18 nt, artificial
  Chemically synthesized
cccugguagaugaagucg

SEQ ID NO: 26576 - RNA, 18 nt, artificial
  Chemically synthesized
auccgugaugucccgguu

SEQ ID NO: 26577 - RNA, 18 nt, artificial
  Chemically synthesized
gagcuggaccacugguca

SEQ ID NO: 26578 - RNA, 18 nt, artificial
  Chemically synthesized
agcuggaccacuggucag

SEQ ID NO: 26579 - RNA, 18 nt, artificial
  Chemically synthesized
cccauguuguccuggaug

SEQ ID NO: 26580 - RNA, 18 nt, artificial
  Chemically synthesized
uggcaaagugguccagca

SEQ ID NO: 26581 - RNA, 18 nt, artificial
  Chemically synthesized
aggcagucgcagaaggcc

SEQ ID NO: 26582 - RNA, 18 nt, artificial
  Chemically synthesized
gugaugucccgguuggca

SEQ ID NO: 26583 - RNA, 18 nt, artificial
  Chemically synthesized
gcgcuugcgggacagcag

SEQ ID NO: 26584 - RNA, 18 nt, artificial
  Chemically synthesized
ggauguuggcaucugcgc

SEQ ID NO: 26585 - RNA, 18 nt, artificial
  Chemically synthesized
gggucauugaaguugagg

SEQ ID NO: 26586 - RNA, 18 nt, artificial
  Chemically synthesized
uccagcaugcccuccacg

SEQ ID NO: 26587 - RNA, 18 nt, artificial
  Chemically synthesized
uggcgcccugguagauga

SEQ ID NO: 26588 - RNA, 18 nt, artificial
  Chemically synthesized
gaaccagagcuggccaug

SEQ ID NO: 26589 - RNA, 18 nt, artificial
  Chemically synthesized
ccacguuggugugcagca

SEQ ID NO: 26590 - RNA, 18 nt, artificial
  Chemically synthesized
gggcaggugcagauggcc

SEQ ID NO: 26591 - RNA, 18 nt, artificial
  Chemically synthesized
caguuggguccugugguc

SEQ ID NO: 26592 - RNA, 18 nt, artificial
  Chemically synthesized
gagcuggccaugcugccg

SEQ ID NO: 26593 - RNA, 18 nt, artificial
  Chemically synthesized
gcaccugcugggucugca

SEQ ID NO: 26594 - RNA, 18 nt, artificial
  Chemically synthesized
ucgaagcccgcagggcac

SEQ ID NO: 26595 - RNA, 18 nt, artificial
  Chemically synthesized
acguccuggcugcaggcc

SEQ ID NO: 26596 - RNA, 18 nt, artificial
  Chemically synthesized
aagccgggcaggcagucg

SEQ ID NO: 26597 - RNA, 18 nt, artificial
  Chemically synthesized
ugagcucccgcaggaagu

SEQ ID NO: 26598 - RNA, 18 nt, artificial
  Chemically synthesized
ugcugccgccggcgcuug

SEQ ID NO: 26599 - RNA, 18 nt, artificial
  Chemically synthesized
uccucacaguagcugccu

SEQ ID NO: 26600 - RNA, 18 nt, artificial
  Chemically synthesized
gcuguaguccaggaugug

SEQ ID NO: 26601 - RNA, 18 nt, artificial
  Chemically synthesized
gggcugcuggcacacucg

SEQ ID NO: 26602 - RNA, 18 nt, artificial
  Chemically synthesized
uggcacagucaucaaugu

SEQ ID NO: 26603 - RNA, 18 nt, artificial
  Chemically synthesized
gauccgugaugucccggu

SEQ ID NO: 26604 - RNA, 18 nt, artificial
  Chemically synthesized
gcugcaccugcugggucu

SEQ ID NO: 26605 - RNA, 18 nt, artificial
  Chemically synthesized
cucgaagcccgcagggca

SEQ ID NO: 26606 - RNA, 18 nt, artificial
  Chemically synthesized
gcuggccaugcugccgcc

SEQ ID NO: 26607 - RNA, 18 nt, artificial
  Chemically synthesized
cccucagggaaccagagc

SEQ ID NO: 26608 - RNA, 18 nt, artificial
  Chemically synthesized
caggcagucgcagaaggc

SEQ ID NO: 26609 - RNA, 18 nt, artificial
  Chemically synthesized
cggcacucgcaguggaag

SEQ ID NO: 26610 - RNA, 18 nt, artificial
  Chemically synthesized
ccugcugggucugcacca

SEQ ID NO: 26611 - RNA, 18 nt, artificial
  Chemically synthesized
gcuucuucuugcuggccu

SEQ ID NO: 26612 - RNA, 18 nt, artificial
  Chemically synthesized
caguuggagcccucguua

SEQ ID NO: 26613 - RNA, 18 nt, artificial
  Chemically synthesized
ccucgaagcccgcagggc

SEQ ID NO: 26614 - RNA, 18 nt, artificial
  Chemically synthesized
ccauguuguccuggaugu

SEQ ID NO: 26615 - RNA, 18 nt, artificial
  Chemically synthesized
augucccgguuggcaaag

SEQ ID NO: 26616 - RNA, 18 nt, artificial
  Chemically synthesized
cgcuugcgggacagcagc

SEQ ID NO: 26617 - RNA, 18 nt, artificial
  Chemically synthesized
cagagcuggccaugcugc

SEQ ID NO: 26618 - RNA, 18 nt, artificial
  Chemically synthesized
gugagcacucguccacca

SEQ ID NO: 26619 - RNA, 18 nt, artificial
  Chemically synthesized
uugcaguuguuuccugga

SEQ ID NO: 26620 - RNA, 18 nt, artificial
  Chemically synthesized
guuguccuggauguuggc

SEQ ID NO: 26621 - RNA, 18 nt, artificial
  Chemically synthesized
aagccuggcaggcaggca

SEQ ID NO: 26622 - RNA, 18 nt, artificial
  Chemically synthesized
ugauguccuccucacaga

SEQ ID NO: 26623 - RNA, 18 nt, artificial
  Chemically synthesized
cuccagcaugcccuccac

SEQ ID NO: 26624 - RNA, 18 nt, artificial
  Chemically synthesized
aagggcaggcacuggcca

SEQ ID NO: 26625 - RNA, 18 nt, artificial
  Chemically synthesized
cacacgcaguuguagcca

SEQ ID NO: 26626 - RNA, 18 nt, artificial
  Chemically synthesized
uggcugcaccugcugggu

SEQ ID NO: 26627 - RNA, 18 nt, artificial
  Chemically synthesized
gcaggcagucgcagaagg

SEQ ID NO: 26628 - RNA, 18 nt, artificial
  Chemically synthesized
uccuccagcaugcccucc

SEQ ID NO: 26629 - RNA, 18 nt, artificial
  Chemically synthesized
ccaaucugguccaggcag

SEQ ID NO: 26630 - RNA, 18 nt, artificial
  Chemically synthesized
cucgcaguggaagucauu

SEQ ID NO: 26631 - RNA, 18 nt, artificial
  Chemically synthesized
cgcuucuucuugcuggcc

SEQ ID NO: 26632 - RNA, 18 nt, artificial
  Chemically synthesized
guccuccagcaugcccuc

SEQ ID NO: 26633 - RNA, 18 nt, artificial
  Chemically synthesized
cguugacacaaggguugg

SEQ ID NO: 26634 - RNA, 18 nt, artificial
  Chemically synthesized
guuggcaaagugguccag

SEQ ID NO: 26635 - RNA, 18 nt, artificial
  Chemically synthesized
ggcacucgcaguggaagu

SEQ ID NO: 26636 - RNA, 18 nt, artificial
  Chemically synthesized
caguccucaccaguccag

SEQ ID NO: 26637 - RNA, 18 nt, artificial
  Chemically synthesized
caggagcacuuguaggug

SEQ ID NO: 26638 - RNA, 18 nt, artificial
  Chemically synthesized
gggaagaucaucugcugg

SEQ ID NO: 26639 - RNA, 18 nt, artificial
  Chemically synthesized
ggcgcuugcgggacagca

SEQ ID NO: 26640 - RNA, 18 nt, artificial
  Chemically synthesized
cccauguuguccuggaug

SEQ ID NO: 26641 - RNA, 18 nt, artificial
  Chemically synthesized
ccagagcuggccaugcug

SEQ ID NO: 26642 - RNA, 18 nt, artificial
  Chemically synthesized
ucacgccguccacacagg

SEQ ID NO: 26643 - RNA, 18 nt, artificial
  Chemically synthesized
acgcaguucugggugcca

SEQ ID NO: 26644 - RNA, 18 nt, artificial
  Chemically synthesized
aggagcacuuguaggugu

SEQ ID NO: 26645 - RNA, 18 nt, artificial
  Chemically synthesized
cacucgcaguggaaguca

SEQ ID NO: 26646 - RNA, 18 nt, artificial
  Chemically synthesized
gguuggcaaaguggucca

SEQ ID NO: 26647 - RNA, 18 nt, artificial
  Chemically synthesized
ggcugcaccugcuggguc

SEQ ID NO: 26648 - RNA, 18 nt, artificial
  Chemically synthesized
gggcagcggcacuuguac

SEQ ID NO: 26649 - RNA, 18 nt, artificial
  Chemically synthesized
gaccacguuggugugcag

SEQ ID NO: 26650 - RNA, 18 nt, artificial
  Chemically synthesized
ugcaccugcugggucugc

SEQ ID NO: 26651 - RNA, 18 nt, artificial
  Chemically synthesized
uccacacagagcccucca

SEQ ID NO: 26652 - RNA, 18 nt, artificial
  Chemically synthesized
ggcugcgcaccagguugu

SEQ ID NO: 26653 - RNA, 18 nt, artificial
  Chemically synthesized
ggcgguguuggaggccac

SEQ ID NO: 26654 - RNA, 18 nt, artificial
  Chemically synthesized
auccgugaugucccgguu

SEQ ID NO: 26655 - RNA, 18 nt, artificial
  Chemically synthesized
ggcugagcucccgcagga

SEQ ID NO: 26656 - RNA, 18 nt, artificial
  Chemically synthesized
cgugaugucccgguuggc

SEQ ID NO: 26657 - RNA, 18 nt, artificial
  Chemically synthesized
caugcugccgccggcgcu

SEQ ID NO: 26658 - RNA, 18 nt, artificial
  Chemically synthesized
ccuccagcaugcccucca

SEQ ID NO: 26659 - RNA, 18 nt, artificial
  Chemically synthesized
ccggcgcuugcgggacag

SEQ ID NO: 26660 - RNA, 18 nt, artificial
  Chemically synthesized
ugggucugcaccagguga

SEQ ID NO: 26661 - RNA, 18 nt, artificial
  Chemically synthesized
gucccgguuggcaaagug

SEQ ID NO: 26662 - RNA, 18 nt, artificial
  Chemically synthesized
uccuggauguuggcaucu

SEQ ID NO: 26663 - RNA, 18 nt, artificial
  Chemically synthesized
cacguccuggcugcaggc

SEQ ID NO: 26664 - RNA, 18 nt, artificial
  Chemically synthesized
cgugccuugagguccuug

SEQ ID NO: 26665 - RNA, 18 nt, artificial
  Chemically synthesized
cugcaccugcugggucug

SEQ ID NO: 26666 - RNA, 18 nt, Artificial Sequence
  Chemically synthesized
cagcccuggucgcagugc

SEQ ID NO: 26667 - RNA, 19 nt, artificial
  Chemically synthesized
gccagcugauauaauggaa

SEQ ID NO: 26668 - RNA, 19 nt, artificial
  Chemically synthesized
gccagugucaacacgacaa

SEQ ID NO: 26669 - RNA, 19 nt, artificial
  Chemically synthesized
cagcgagugcaugaacgaa

SEQ ID NO: 26670 - RNA, 19 nt, artificial
  Chemically synthesized
gaacgaggugacccgcuua

SEQ ID NO: 26671 - RNA, 19 nt, artificial
  Chemically synthesized
ccagugucaacacgacaca

SEQ ID NO: 26672 - RNA, 19 nt, artificial
  Chemically synthesized
cgagugcaugaacgaggua

SEQ ID NO: 26673 - RNA, 19 nt, artificial
  Chemically synthesized
ugucaacacgacaccggaa

SEQ ID NO: 26674 - RNA, 19 nt, artificial
  Chemically synthesized
cagugucaacacgacacca

SEQ ID NO: 26675 - RNA, 19 nt, artificial
  Chemically synthesized
ggcggacuccauguggaga

SEQ ID NO: 26676 - RNA, 19 nt, artificial
  Chemically synthesized
cggauaaaccaaagacaga

SEQ ID NO: 26677 - RNA, 19 nt, artificial
  Chemically synthesized
agugcaugaacgaggugaa

SEQ ID NO: 26678 - RNA, 19 nt, artificial
  Chemically synthesized
cagcgagugcaugaacgau

SEQ ID NO: 26679 - RNA, 19 nt, artificial
  Chemically synthesized
uuccauuauaucagcuggc

SEQ ID NO: 26680 - RNA, 19 nt, artificial
  Chemically synthesized
uugucguguugacacuggc

SEQ ID NO: 26681 - RNA, 19 nt, artificial
  Chemically synthesized
uucguucaugcacucgcug

SEQ ID NO: 26682 - RNA, 19 nt, artificial
  Chemically synthesized
uaagcgggucaccucguuc

SEQ ID NO: 26683 - RNA, 19 nt, artificial
  Chemically synthesized
ugugucguguugacacugg

SEQ ID NO: 26684 - RNA, 19 nt, artificial
  Chemically synthesized
uaccucguucaugcacucg

SEQ ID NO: 26685 - RNA, 19 nt, artificial
  Chemically synthesized
uuccggugucguguugaca

SEQ ID NO: 26686 - RNA, 19 nt, artificial
  Chemically synthesized
uggugucguguugacacug

SEQ ID NO: 26687 - RNA, 19 nt, artificial
  Chemically synthesized
ucuccacauggaguccgcc

SEQ ID NO: 26688 - RNA, 19 nt, artificial
  Chemically synthesized
ucugucuuugguuuauccg

SEQ ID NO: 26689 - RNA, 19 nt, artificial
  Chemically synthesized
uucaccucguucaugcacu

SEQ ID NO: 26690 - RNA, 19 nt, Artificial Sequence
  Chemically synthesized
aucguucaugcacucgcug

SEQ ID NO: 26691 - RNA, 19 nt, artificial
  Chemically synthesized
guauuaagugacugaccau

SEQ ID NO: 26692 - RNA, 19 nt, artificial
  Chemically synthesized
gaaaacacugauuuuggau

SEQ ID NO: 26693 - RNA, 19 nt, artificial
  Chemically synthesized
acugcaugacccagaucaa

SEQ ID NO: 26694 - RNA, 19 nt, artificial
  Chemically synthesized
agccagugucaacacgaca

SEQ ID NO: 26695 - RNA, 19 nt, artificial
  Chemically synthesized
gugucaacacgacaccgga

SEQ ID NO: 26696 - RNA, 19 nt, artificial
  Chemically synthesized
cagugaagcaccuccggaa

SEQ ID NO: 26697 - RNA, 19 nt, artificial
  Chemically synthesized
cauggagaaaagacgaaga

SEQ ID NO: 26698 - RNA, 19 nt, artificial
  Chemically synthesized
cagcugauauaauggagaa

SEQ ID NO: 26699 - RNA, 19 nt, artificial
  Chemically synthesized
auggucagucacuuaauac

SEQ ID NO: 26700 - RNA, 19 nt, artificial
  Chemically synthesized
auccaaaaucaguguuuuc

SEQ ID NO: 26701 - RNA, 19 nt, artificial
  Chemically synthesized
uugaucugggucaugcagu

SEQ ID NO: 26702 - RNA, 19 nt, artificial
  Chemically synthesized
ugucguguugacacuggcu

SEQ ID NO: 26703 - RNA, 19 nt, artificial
  Chemically synthesized
uccggugucguguugacac

SEQ ID NO: 26704 - RNA, 19 nt, artificial
  Chemically synthesized
uuccggaggugcuucacug

SEQ ID NO: 26705 - RNA, 19 nt, artificial
  Chemically synthesized
ucuucgucuuuucuccaug

SEQ ID NO: 26706 - RNA, 19 nt, Artificial Sequence
  Chemically synthesized
uucuccauuauaucagcug

SEQ ID NO: 26707 - RNA, 19 nt, artificial
  Chemically synthesized
ggaguucgcgcggcaccaa

SEQ ID NO: 26708 - RNA, 19 nt, artificial
  Chemically synthesized
gcgacacgcagaugaagca

SEQ ID NO: 26709 - RNA, 19 nt, artificial
  Chemically synthesized
cgggcacauuugccuuuua

SEQ ID NO: 26710 - RNA, 19 nt, artificial
  Chemically synthesized
cgccagcgacacgcagaua

SEQ ID NO: 26711 - RNA, 19 nt, artificial
  Chemically synthesized
ccgacugcggaagccggua

SEQ ID NO: 26712 - RNA, 19 nt, artificial
  Chemically synthesized
gcgcggcaccagcccaaca

SEQ ID NO: 26713 - RNA, 19 nt, artificial
  Chemically synthesized
aaccgacugcggaagccga

SEQ ID NO: 26714 - RNA, 19 nt, artificial
  Chemically synthesized
cgacugcggaagccgguga

SEQ ID NO: 26715 - RNA, 19 nt, artificial
  Chemically synthesized
cgacacgcagaugaagcua

SEQ ID NO: 26716 - RNA, 19 nt, artificial
  Chemically synthesized
uuggugccgcgcgaacucc

SEQ ID NO: 26717 - RNA, 19 nt, artificial
  Chemically synthesized
ugcuucaucugcgugucgc

SEQ ID NO: 26718 - RNA, 19 nt, artificial
  Chemically synthesized
uaaaaggcaaaugugcccg

SEQ ID NO: 26719 - RNA, 19 nt, artificial
  Chemically synthesized
uaucugcgugucgcuggcg

SEQ ID NO: 26720 - RNA, 19 nt, artificial
  Chemically synthesized
uaccggcuuccgcagucgg

SEQ ID NO: 26721 - RNA, 19 nt, artificial
  Chemically synthesized
uguugggcuggugccgcgc

SEQ ID NO: 26722 - RNA, 19 nt, artificial
  Chemically synthesized
ucggcuuccgcagucgguu

SEQ ID NO: 26723 - RNA, 19 nt, artificial
  Chemically synthesized
ucaccggcuuccgcagucg

SEQ ID NO: 26724 - RNA, 19 nt, Artificial Sequence
  Chemically synthesized
uagcuucaucugcgugucg

SEQ ID NO: 26725 - RNA, 19 nt, artificial
  Chemically synthesized
cuguagaggacuuucuuca

SEQ ID NO: 26726 - RNA, 19 nt, artificial
  Chemically synthesized
gccagcgacacgcagauga

SEQ ID NO: 26727 - RNA, 19 nt, artificial
  Chemically synthesized
gcgacacgcagaugaagcu

SEQ ID NO: 26728 - RNA, 19 nt, artificial
  Chemically synthesized
ggguucuaugauauuugua

SEQ ID NO: 26729 - RNA, 19 nt, artificial
  Chemically synthesized
ugaagaaaguccucuacag

SEQ ID NO: 26730 - RNA, 19 nt, artificial
  Chemically synthesized
ucaucugcgugucgcuggc

SEQ ID NO: 26731 - RNA, 19 nt, artificial
  Chemically synthesized
agcuucaucugcgugucgc

SEQ ID NO: 26732 - RNA, 19 nt, Artificial Sequence
  Chemically synthesized
uacaaauaucauagaaccc

SEQ ID NO: 26733 - RNA, 19 nt, artificial
  Chemically synthesized
guuugucugagcugagaaa

SEQ ID NO: 26734 - RNA, 19 nt, artificial
  Chemically synthesized
gagcugagaaggcugguaa

SEQ ID NO: 26735 - RNA, 19 nt, artificial
  Chemically synthesized
ugagcaucauugaaggaca

SEQ ID NO: 26736 - RNA, 19 nt, artificial
  Chemically synthesized
ugagaagcgccgacgagaa

SEQ ID NO: 26737 - RNA, 19 nt, artificial
  Chemically synthesized
acaguuugucugagcugaa

SEQ ID NO: 26738 - RNA, 19 nt, artificial
  Chemically synthesized
ugucugagcugagaaggca

SEQ ID NO: 26739 - RNA, 19 nt, artificial
  Chemically synthesized
gagaagcgccgacgagaca

SEQ ID NO: 26740 - RNA, 19 nt, artificial
  Chemically synthesized
gaagcgccgacgagaccga

SEQ ID NO: 26741 - RNA, 19 nt, artificial
  Chemically synthesized
gcaucucaacaacuacgca

SEQ ID NO: 26742 - RNA, 19 nt, artificial
  Chemically synthesized
agcccuauagaccuuggga

SEQ ID NO: 26743 - RNA, 19 nt, artificial
  Chemically synthesized
ugcaaaccuuggcaagcca

SEQ ID NO: 26744 - RNA, 19 nt, artificial
  Chemically synthesized
ggccucggacacauuccca

SEQ ID NO: 26745 - RNA, 19 nt, artificial
  Chemically synthesized
ccagcgggaagccgcgaga

SEQ ID NO: 26746 - RNA, 19 nt, artificial
  Chemically synthesized
uggacuaucggaguuugga

SEQ ID NO: 26747 - RNA, 19 nt, artificial
  Chemically synthesized
uuucucagcucagacaaac

SEQ ID NO: 26748 - RNA, 19 nt, artificial
  Chemically synthesized
uuaccagccuucucagcuc

SEQ ID NO: 26749 - RNA, 19 nt, artificial
  Chemically synthesized
uguccuucaaugaugcuca

SEQ ID NO: 26750 - RNA, 19 nt, artificial
  Chemically synthesized
uucucgucggcgcuucuca

SEQ ID NO: 26751 - RNA, 19 nt, artificial
  Chemically synthesized
uucagcucagacaaacugu

SEQ ID NO: 26752 - RNA, 19 nt, artificial
  Chemically synthesized
ugccuucucagcucagaca

SEQ ID NO: 26753 - RNA, 19 nt, artificial
  Chemically synthesized
ugucucgucggcgcuucuc

SEQ ID NO: 26754 - RNA, 19 nt, artificial
  Chemically synthesized
ucggucucgucggcgcuuc

SEQ ID NO: 26755 - RNA, 19 nt, artificial
  Chemically synthesized
ugcguaguuguugagaugc

SEQ ID NO: 26756 - RNA, 19 nt, artificial
  Chemically synthesized
ucccaaggucuauagggcu

SEQ ID NO: 26757 - RNA, 19 nt, artificial
  Chemically synthesized
uggcuugccaagguuugca

SEQ ID NO: 26758 - RNA, 19 nt, artificial
  Chemically synthesized
ugggaauguguccgaggcc

SEQ ID NO: 26759 - RNA, 19 nt, artificial
  Chemically synthesized
ucucgcggcuucccgcugg

SEQ ID NO: 26760 - RNA, 19 nt, Artificial Sequence
  Chemically synthesized
uccaaacuccgauagucca

SEQ ID NO: 26761 - RNA, 19 nt, artificial
  Chemically synthesized
aguuugucugagcugagaa

SEQ ID NO: 26762 - RNA, 19 nt, artificial
  Chemically synthesized
ugagcaucauugaaggacu

SEQ ID NO: 26763 - RNA, 19 nt, artificial
  Chemically synthesized
cugagaaggcugguaccca

SEQ ID NO: 26764 - RNA, 19 nt, artificial
  Chemically synthesized
guuugucugagcugagaag

SEQ ID NO: 26765 - RNA, 19 nt, artificial
  Chemically synthesized
aacaguuugucugagcuga

SEQ ID NO: 26766 - RNA, 19 nt, artificial
  Chemically synthesized
ugucugagcugagaaggcu

SEQ ID NO: 26767 - RNA, 19 nt, artificial
  Chemically synthesized
ugcuauggacuaucggagu

SEQ ID NO: 26768 - RNA, 19 nt, artificial
  Chemically synthesized
gagcugagaaggcugguac

SEQ ID NO: 26769 - RNA, 19 nt, artificial
  Chemically synthesized
ugcggacgagaauggaaac

SEQ ID NO: 26770 - RNA, 19 nt, artificial
  Chemically synthesized
uucucagcucagacaaacu

SEQ ID NO: 26771 - RNA, 19 nt, artificial
  Chemically synthesized
aguccuucaaugaugcuca

SEQ ID NO: 26772 - RNA, 19 nt, artificial
  Chemically synthesized
uggguaccagccuucucag

SEQ ID NO: 26773 - RNA, 19 nt, artificial
  Chemically synthesized
cuucucagcucagacaaac

SEQ ID NO: 26774 - RNA, 19 nt, artificial
  Chemically synthesized
ucagcucagacaaacuguu

SEQ ID NO: 26775 - RNA, 19 nt, artificial
  Chemically synthesized
agccuucucagcucagaca

SEQ ID NO: 26776 - RNA, 19 nt, artificial
  Chemically synthesized
acuccgauaguccauagca

SEQ ID NO: 26777 - RNA, 19 nt, artificial
  Chemically synthesized
guaccagccuucucagcuc

SEQ ID NO: 26778 - RNA, 19 nt, Artificial Sequence
  Chemically synthesized
guuuccauucucguccgca

SEQ ID NO: 26779 - RNA, 19 nt, artificial
  Chemically synthesized
gggagcgagaacaauuaca

SEQ ID NO: 26780 - RNA, 19 nt, artificial
  Chemically synthesized
ggguaaaggcuacuuugaa

SEQ ID NO: 26781 - RNA, 19 nt, artificial
  Chemically synthesized
gaaaaggcgucgggaucga

SEQ ID NO: 26782 - RNA, 19 nt, artificial
  Chemically synthesized
uguaauuguucucgcuccc

SEQ ID NO: 26783 - RNA, 19 nt, artificial
  Chemically synthesized
uucaaaguagccuuuaccc

SEQ ID NO: 26784 - RNA, 19 nt, Artificial Sequence
  Chemically synthesized
ucgaucccgacgccuuuuc

SEQ ID NO: 26785 - RNA, 19 nt, artificial
  Chemically synthesized
ggguaaaggcuacuuugac

SEQ ID NO: 26786 - RNA, 19 nt, artificial
  Chemically synthesized
ccauggcccaccaccauca

SEQ ID NO: 26787 - RNA, 19 nt, artificial
  Chemically synthesized
gucaaaguagccuuuaccc

SEQ ID NO: 26788 - RNA, 19 nt, Artificial Sequence
  Chemically synthesized
ugaugguggugggccaugg

SEQ ID NO: 26789 - RNA, 19 nt, artificial
  Chemically synthesized
agcacgucaucgacuacaa

SEQ ID NO: 26790 - RNA, 19 nt, artificial
  Chemically synthesized
gcacgucaucgacuacaua

SEQ ID NO: 26791 - RNA, 19 nt, artificial
  Chemically synthesized
ccagcacgucaucgacuaa

SEQ ID NO: 26792 - RNA, 19 nt, artificial
  Chemically synthesized
ugcucuacgacaugaacga

SEQ ID NO: 26793 - RNA, 19 nt, artificial
  Chemically synthesized
gacgaucgcaucuugugua

SEQ ID NO: 26794 - RNA, 19 nt, artificial
  Chemically synthesized
gcucuacgacaugaacgga

SEQ ID NO: 26795 - RNA, 19 nt, artificial
  Chemically synthesized
gaucgcaucuugugucgca

SEQ ID NO: 26796 - RNA, 19 nt, artificial
  Chemically synthesized
ucuacgacaugaacggcua

SEQ ID NO: 26797 - RNA, 19 nt, artificial
  Chemically synthesized
ucaaggagcuggugcccaa

SEQ ID NO: 26798 - RNA, 19 nt, artificial
  Chemically synthesized
acgaucgcaucuuguguca

SEQ ID NO: 26799 - RNA, 19 nt, artificial
  Chemically synthesized
uuguagucgaugacgugcu

SEQ ID NO: 26800 - RNA, 19 nt, artificial
  Chemically synthesized
uauguagucgaugacgugc

SEQ ID NO: 26801 - RNA, 19 nt, artificial
  Chemically synthesized
uuagucgaugacgugcugg

SEQ ID NO: 26802 - RNA, 19 nt, artificial
  Chemically synthesized
ucguucaugucguagagca

SEQ ID NO: 26803 - RNA, 19 nt, artificial
  Chemically synthesized
uacacaagaugcgaucguc

SEQ ID NO: 26804 - RNA, 19 nt, artificial
  Chemically synthesized
uccguucaugucguagagc

SEQ ID NO: 26805 - RNA, 19 nt, artificial
  Chemically synthesized
ugcgacacaagaugcgauc

SEQ ID NO: 26806 - RNA, 19 nt, artificial
  Chemically synthesized
uagccguucaugucguaga

SEQ ID NO: 26807 - RNA, 19 nt, artificial
  Chemically synthesized
uugggcaccagcuccuuga

SEQ ID NO: 26808 - RNA, 19 nt, Artificial Sequence
  Chemically synthesized
ugacacaagaugcgaucgu

SEQ ID NO: 26809 - RNA, 19 nt, artificial
  Chemically synthesized
agcacgucaucgacuacau

SEQ ID NO: 26810 - RNA, 19 nt, artificial
  Chemically synthesized
cgcaucuugugucgcugaa

SEQ ID NO: 26811 - RNA, 19 nt, artificial
  Chemically synthesized
cacgucaucgacuacauca

SEQ ID NO: 26812 - RNA, 19 nt, artificial
  Chemically synthesized
cagcacgucaucgacuaca

SEQ ID NO: 26813 - RNA, 19 nt, artificial
  Chemically synthesized
uuguagucgaugacgugcu

SEQ ID NO: 26814 - RNA, 19 nt, artificial
  Chemically synthesized
uucagcgacacaagaugcg

SEQ ID NO: 26815 - RNA, 19 nt, artificial
  Chemically synthesized
ugauguagucgaugacgug

SEQ ID NO: 26816 - RNA, 19 nt, Artificial Sequence
  Chemically synthesized
uguagucgaugacgugcug

SEQ ID NO: 26817 - RNA, 19 nt, artificial
  Chemically synthesized
ggagcgugaauaccagaaa

SEQ ID NO: 26818 - RNA, 19 nt, artificial
  Chemically synthesized
aaagguggagcgugaauaa

SEQ ID NO: 26819 - RNA, 19 nt, artificial
  Chemically synthesized
cagccugucggaccacaga

SEQ ID NO: 26820 - RNA, 19 nt, artificial
  Chemically synthesized
gaaccaggcguccaggaca

SEQ ID NO: 26821 - RNA, 19 nt, artificial
  Chemically synthesized
uuucugguauucacgcucc

SEQ ID NO: 26822 - RNA, 19 nt, artificial
  Chemically synthesized
uuauucacgcuccaccuuu

SEQ ID NO: 26823 - RNA, 19 nt, artificial
  Chemically synthesized
ucugugguccgacaggcug

SEQ ID NO: 26824 - RNA, 19 nt, Artificial Sequence
  Chemically synthesized
uguccuggacgccugguuc

SEQ ID NO: 26825 - RNA, 19 nt, artificial
  Chemically synthesized
caaagguggagcgugaaua

SEQ ID NO: 26826 - RNA, 19 nt, artificial
  Chemically synthesized
uggagcgugaauaccagaa

SEQ ID NO: 26827 - RNA, 19 nt, artificial
  Chemically synthesized
ggagcgugaauaccagaag

SEQ ID NO: 26828 - RNA, 19 nt, artificial
  Chemically synthesized
agaucgcccuggacucgca

SEQ ID NO: 26829 - RNA, 19 nt, artificial
  Chemically synthesized
uauucacgcuccaccuuug

SEQ ID NO: 26830 - RNA, 19 nt, artificial
  Chemically synthesized
uucugguauucacgcucca

SEQ ID NO: 26831 - RNA, 19 nt, artificial
  Chemically synthesized
cuucugguauucacgcucc

SEQ ID NO: 26832 - RNA, 19 nt, Artificial Sequence
  Chemically synthesized
ugcgaguccagggcgaucu

SEQ ID NO: 26833 - RNA, 19 nt, artificial
  Chemically synthesized
agcuuagccagguggaaaa

SEQ ID NO: 26834 - RNA, 19 nt, artificial
  Chemically synthesized
agcucacuccggaacuuga

SEQ ID NO: 26835 - RNA, 19 nt, artificial
  Chemically synthesized
cgacaugaaccacugcuaa

SEQ ID NO: 26836 - RNA, 19 nt, artificial
  Chemically synthesized
gcucacuccggaacuugua

SEQ ID NO: 26837 - RNA, 19 nt, artificial
  Chemically synthesized
cgagcucacuccggaacua

SEQ ID NO: 26838 - RNA, 19 nt, artificial
  Chemically synthesized
ugugcugccugucggaaca

SEQ ID NO: 26839 - RNA, 19 nt, artificial
  Chemically synthesized
gaacgcaggugcuggcgca

SEQ ID NO: 26840 - RNA, 19 nt, artificial
  Chemically synthesized
gcugcuacgaggcggugua

SEQ ID NO: 26841 - RNA, 19 nt, artificial
  Chemically synthesized
cccggugcgcggcugcuaa

SEQ ID NO: 26842 - RNA, 19 nt, artificial
  Chemically synthesized
uuuuccaccuggcuaagcu

SEQ ID NO: 26843 - RNA, 19 nt, artificial
  Chemically synthesized
ucaaguuccggagugagcu

SEQ ID NO: 26844 - RNA, 19 nt, artificial
  Chemically synthesized
uuagcagugguucaugucg

SEQ ID NO: 26845 - RNA, 19 nt, artificial
  Chemically synthesized
uacaaguuccggagugagc

SEQ ID NO: 26846 - RNA, 19 nt, artificial
  Chemically synthesized
uaguuccggagugagcucg

SEQ ID NO: 26847 - RNA, 19 nt, artificial
  Chemically synthesized
uguuccgacaggcagcaca

SEQ ID NO: 26848 - RNA, 19 nt, artificial
  Chemically synthesized
ugcgccagcaccugcguuc

SEQ ID NO: 26849 - RNA, 19 nt, artificial
  Chemically synthesized
uacaccgccucguagcagc

SEQ ID NO: 26850 - RNA, 19 nt, Artificial Sequence
  Chemically synthesized
uuagcagccgcgcaccggg

SEQ ID NO: 26851 - RNA, 19 nt, artificial
  Chemically synthesized
agcuuagccagguggaaau

SEQ ID NO: 26852 - RNA, 19 nt, artificial
  Chemically synthesized
acgacaugaaccacugcua

SEQ ID NO: 26853 - RNA, 19 nt, artificial
  Chemically synthesized
gacaugaaccacugcuacu

SEQ ID NO: 26854 - RNA, 19 nt, artificial
  Chemically synthesized
agcucacuccggaacuugu

SEQ ID NO: 26855 - RNA, 19 nt, artificial
  Chemically synthesized
cgagcucacuccggaacuu

SEQ ID NO: 26856 - RNA, 19 nt, artificial
  Chemically synthesized
ccgccugcgggaacuggua

SEQ ID NO: 26857 - RNA, 19 nt, artificial
  Chemically synthesized
gaggcacucagcuuagcca

SEQ ID NO: 26858 - RNA, 19 nt, artificial
  Chemically synthesized
cgacaugaaccacugcuac

SEQ ID NO: 26859 - RNA, 19 nt, artificial
  Chemically synthesized
auuuccaccuggcuaagcu

SEQ ID NO: 26860 - RNA, 19 nt, artificial
  Chemically synthesized
uagcagugguucaugucgu

SEQ ID NO: 26861 - RNA, 19 nt, artificial
  Chemically synthesized
aguagcagugguucauguc

SEQ ID NO: 26862 - RNA, 19 nt, artificial
  Chemically synthesized
acaaguuccggagugagcu

SEQ ID NO: 26863 - RNA, 19 nt, artificial
  Chemically synthesized
aaguuccggagugagcucg

SEQ ID NO: 26864 - RNA, 19 nt, artificial
  Chemically synthesized
uaccaguucccgcaggcgg

SEQ ID NO: 26865 - RNA, 19 nt, artificial
  Chemically synthesized
uggcuaagcugagugccuc

SEQ ID NO: 26866 - RNA, 19 nt, Artificial Sequence
  Chemically synthesized
guagcagugguucaugucg

SEQ ID NO: 26867 - RNA, 19 nt, artificial
  Chemically synthesized
agccaaaguggcauguuua

SEQ ID NO: 26868 - RNA, 19 nt, artificial
  Chemically synthesized
gcauacugagccaaguaua

SEQ ID NO: 26869 - RNA, 19 nt, artificial
  Chemically synthesized
cagcgcaaguggaauuuca

SEQ ID NO: 26870 - RNA, 19 nt, artificial
  Chemically synthesized
ugcauacugagccaaguaa

SEQ ID NO: 26871 - RNA, 19 nt, artificial
  Chemically synthesized
ggagcggauggacgccaga

SEQ ID NO: 26872 - RNA, 19 nt, artificial
  Chemically synthesized
agggcagcuugcccgagua

SEQ ID NO: 26873 - RNA, 19 nt, artificial
  Chemically synthesized
guacuaccuguguauauag

SEQ ID NO: 26874 - RNA, 19 nt, artificial
  Chemically synthesized
ugcauacugagccaaguau

SEQ ID NO: 26875 - RNA, 19 nt, artificial
  Chemically synthesized
gagugucuaacgggagcca

SEQ ID NO: 26876 - RNA, 19 nt, artificial
  Chemically synthesized
gcgcaaguggaauuucgaa

SEQ ID NO: 26877 - RNA, 19 nt, artificial
  Chemically synthesized
uaaacaugccacuuuggcu

SEQ ID NO: 26878 - RNA, 19 nt, artificial
  Chemically synthesized
uacauccuggcucuccugc

SEQ ID NO: 26879 - RNA, 19 nt, artificial
  Chemically synthesized
ugaaauuccacuugcgcug

SEQ ID NO: 26880 - RNA, 19 nt, artificial
  Chemically synthesized
uaugccacuuuggcuugua

SEQ ID NO: 26881 - RNA, 19 nt, artificial
  Chemically synthesized
ucugacauccuggcucucc

SEQ ID NO: 26882 - RNA, 19 nt, artificial
  Chemically synthesized
uacucgggcaagcugcccu

SEQ ID NO: 26883 - RNA, 19 nt, artificial
  Chemically synthesized
uuuggcucaguaugcaacc

SEQ ID NO: 26884 - RNA, 19 nt, artificial
  Chemically synthesized
uuacuuggcucaguaugca

SEQ ID NO: 26885 - RNA, 19 nt, artificial
  Chemically synthesized
uccgcugacauccuggcuc

SEQ ID NO: 26886 - RNA, 19 nt, Artificial Sequence
  Chemically synthesized
uucgaaauuccacuugcgc

SEQ ID NO: 26887 - RNA, 19 nt, artificial
  Chemically synthesized
cgcauuugguggacccaaa

SEQ ID NO: 26888 - RNA, 19 nt, artificial
  Chemically synthesized
gcaauuagguuuuuccuua

SEQ ID NO: 26889 - RNA, 19 nt, artificial
  Chemically synthesized
cauuguacuaccuguguau

SEQ ID NO: 26890 - RNA, 19 nt, artificial
  Chemically synthesized
gguuuuuccuuauuugcuu

SEQ ID NO: 26891 - RNA, 19 nt, artificial
  Chemically synthesized
agcgcaaguggaauuucga

SEQ ID NO: 26892 - RNA, 19 nt, artificial
  Chemically synthesized
gguugcauacugagccaaa

SEQ ID NO: 26893 - RNA, 19 nt, artificial
  Chemically synthesized
agccaaaguggcauguuuu

SEQ ID NO: 26894 - RNA, 19 nt, artificial
  Chemically synthesized
uuuggguccaccaaaugcg

SEQ ID NO: 26895 - RNA, 19 nt, artificial
  Chemically synthesized
uaaggaaaaaccuaauugc

SEQ ID NO: 26896 - RNA, 19 nt, artificial
  Chemically synthesized
auacacagguaguacaaug

SEQ ID NO: 26897 - RNA, 19 nt, artificial
  Chemically synthesized
aagcaaauaaggaaaaacc

SEQ ID NO: 26898 - RNA, 19 nt, artificial
  Chemically synthesized
ucgaaauuccacuugcgcu

SEQ ID NO: 26899 - RNA, 19 nt, artificial
  Chemically synthesized
auccuggcucuccugcgcc

SEQ ID NO: 26900 - RNA, 19 nt, Artificial Sequence
  Chemically synthesized
aaaacaugccacuuuggcu

SEQ ID NO: 26901 - RNA, 19 nt, artificial
  Chemically synthesized
ccuucuacugcgaguguca

SEQ ID NO: 26902 - RNA, 19 nt, artificial
  Chemically synthesized
gcuacaacugcguguguga

SEQ ID NO: 26903 - RNA, 19 nt, artificial
  Chemically synthesized
uccuucuacugcgagugua

SEQ ID NO: 26904 - RNA, 19 nt, artificial
  Chemically synthesized
cuccuucuacugcgaguga

SEQ ID NO: 26905 - RNA, 19 nt, artificial
  Chemically synthesized
cagcgcagaugccaacaua

SEQ ID NO: 26906 - RNA, 19 nt, artificial
  Chemically synthesized
ugacacucgcaguagaagg

SEQ ID NO: 26907 - RNA, 19 nt, artificial
  Chemically synthesized
ucacacacgcaguuguagc

SEQ ID NO: 26908 - RNA, 19 nt, artificial
  Chemically synthesized
uacacucgcaguagaagga

SEQ ID NO: 26909 - RNA, 19 nt, artificial
  Chemically synthesized
ucacucgcaguagaaggag

SEQ ID NO: 26910 - RNA, 19 nt, Artificial Sequence
  Chemically synthesized
uauguuggcaucugcgcug

SEQ ID NO: 26911 - RNA, 19 nt, artificial
  Chemically synthesized
acaacugcgugugugucaa

SEQ ID NO: 26912 - RNA, 19 nt, Artificial Sequence
  Chemically synthesized
uugacacacacgcaguugu

We claim:

1. A method of preventing, treating or delaying the progression of a hearing disorder, a hearing loss and/or a balance impairment in a subject, or preventing the loss of otic (sensory) hair cells of the inner ear in a subject comprising administering to the subject
    (i) a combination of a HES1 (SEQ ID NO:1) inhibitor, a HES5 (SEQ ID NO:2) inhibitor and a HEY2 (SEQ ID NO:10) inhibitor; or
    (ii) a combination of a CDKN1B (SEQ ID NO:7) inhibitor, a NOTCH1 (SEQ ID NO:11) inhibitor and a HEY2 (SEQ ID NO:10) inhibitor,
    wherein the inhibitors are double stranded oligonucleotides.

2. The method of claim 1, wherein the combination of inhibitors is administered to the subject in the same formulation.

3. The method of claim 1, wherein the combination of inhibitors is administered to the subject in the different formulations.

4. The method of claim 1, wherein the combination of inhibitors is administered to the subject by different routes.

5. The method of claim 1, wherein one or more inhibitors is administered to the subject separately or sequentially.

6. The method of claim 1, wherein one or more inhibitors is administered to the subject substantially simultaneously.

7. The method of claim 1, wherein the inhibitors are co-administered to the subject by transtympanic injection or topically.

8. The method of claim 7, wherein the topical administration comprises application of ear drops to the eardrum.

9. The method of claim 1, wherein each of the double-stranded oligonucleotides comprises a strand configured to specifically bind mRNA encoding HES1, HES5, HEY2, CDKN1B or NOTCH1.

10. The method of claim 1, wherein each of the double-stranded oligonucleotides comprises a dsRNA molecule having a sense strand and an antisense strand and the double-stranded oligonucleotides are linked or annealed in a RNAistar formation.

11. The method of claim 1, wherein:
each double-stranded oligonucleotide comprises a sense strand and an antisense strand, wherein:
(a) each strand is independently 18 to 49 nucleotides in length;
(b) a 18 to 49 nucleotide sequence of the antisense strand is complementary to a sequence of an mRNA encoding (i) HES1, HES5 or HEY2 respectively, or (ii) CDKN1B, NOTCH1, or HEY2 respectively; and
(c) a 18 to 49 nucleotide sequence of the sense strand is complementary to the antisense strand.

12. The method of claim 1, wherein at least one double-stranded oligonucleotide independently comprises a structure (A1):

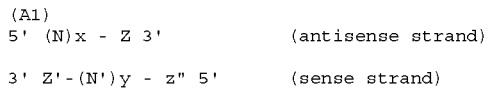

wherein each of N and N' is a ribonucleotide which may be unmodified or modified, or an unconventional moiety;
each of (N)x and (N')y is an oligonucleotide in which each consecutive N or N' is joined to the next N or N' by a covalent bond;
each of Z and Z' is independently present or absent, but if present is independently 1-5 consecutive nucleotides, 1-5 consecutive non-nucleotide moieties or a combination thereof covalently attached at the 3' terminus of the strand in which it is present;
z" may be present or absent, but if present is a capping moiety covalently attached at the 5' terminus of (N')y;
each of x and y is independently an integer between 18 and 40;
the sequence of (N')y is complementary to the sequence of (N)x; and
(N)x comprises an antisense sequence complementary to an mRNA selected from (i) an mRNA encoding HES1, an mRNA encoding HES5, or an mRNA encoding HEY2, or (ii) an mRNA encoding CDKN1B, an mRNA encoding NOTCH1 or an mRNA encoding HEY2.

13. The method of claim 1, wherein at least one double-stranded oligonucleotide independently comprises a structure (A2):

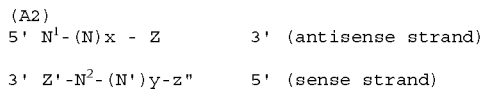

wherein each of N2, N and N' is independently an unmodified or modified ribonucleotide, or an unconventional moiety;
each of (N)x and (N')y is an oligonucleotide in which each consecutive N or N' is joined to the adjacent N or N' by a covalent bond;
each of x and y is independently an integer between 17 and 39;
N2 is covalently bound to (N')y;
N1 is covalently bound to (N)x and is mismatched to the target mRNA selected from HES1 mRNA, HES5 mRNA, HEY2 mRNA, CDKN1B mRNA and NOTCH1 mRNA or is a complementary deoxyribonucleotide moiety to the mRNA selected from HES1 mRNA, HES5 mRNA, HEY2 mRNA, CDKN1B mRNA and NOTCH1 mRNA;
N1 is a moiety selected from the group consisting of natural or modified: uridine, deoxyribouridine, ribothymidine, deoxyribothymidine, adenosine or deoxyadenosine, an abasic ribose moiety and an abasic deoxyribose moiety;
z" may be present or absent, but if present is a capping moiety covalently attached at the 5' terminus of N2-(N')y; and
each of Z and Z' is independently present or absent, but if present is independently 1-5 consecutive nucleotides, 1-5 consecutive non-nucleotide moieties or a combination thereof covalently attached at the 3' terminus of the strand in which it is present;
the sequence of (N')y has complementarity to the sequence of (N)x; and
the sequence of (N)x has complementarity to a consecutive sequence selected from a sequence in HES1 mRNA (SEQ ID NO:1), HES5 mRNA (SEQ ID NO:2), HEY2 mRNA (SEQ ID NO:10), CDKN1B mRNA (SEQ ID NO:7) and NOTCH1 mRNA (SEQ ID NO:11).

14. The method of claim 1, wherein the combination being administered is (i).

15. The method of claim 1, wherein the combination being administered is (ii).

16. The method of claim 1, wherein the subject is human.

17. The method of claim 1, wherein the inhibitors are administered in an amount and for a period of time sufficient to prevent, treat or delay the progression of the hearing disorder, the hearing loss and/or the balance impairment in the subject, or to prevent the loss of otic (sensory) hair cells of the inner ear in the subject.

* * * * *